United States Patent 8,394,390 (NEISSERIAL ANTIGENIC PEPTIDES) - sequence listing, part 2

SEQ ID NO: 6541 - protein, 13 aa, Neisseria
TYKERIIENRPAH

SEQ ID NO: 6542 - protein, 18 aa, Neisseria
GGDLTASGQNWLNKDSRI

SEQ ID NO: 6543 - protein, 26 aa, Neisseria
RIITDDLNQKEITNQSTTGKGRTDAV

SEQ ID NO: 6544 - protein, 29 aa, Neisseria
QWDSVTKKGWYSGRKRQRRTERNHTPYHD

SEQ ID NO: 6545 - protein, 7 aa, Neisseria
HDFDTPV

SEQ ID NO: 6546 - protein, 7 aa, Neisseria
NAASPSF

SEQ ID NO: 6547 - protein, 8 aa, Neisseria
VNGQRIHT

SEQ ID NO: 6548 - protein, 9 aa, Neisseria
TTHPDNKGW

SEQ ID NO: 6549 - protein, 17 aa, Neisseria
ETDPQFADYRRWLGSDY

SEQ ID NO: 6550 - protein, 20 aa, Neisseria
DTNHLHKRLGDGYYEQKLVN

SEQ ID NO: 6551 - protein, 22 aa, Neisseria
GYRRLDGYRSDEEQFKALMDNG

SEQ ID NO: 6552 - protein, 7 aa, Neisseria
LSDGSTQ

SEQ ID NO: 6553 - protein, 12 aa, Neisseria
LARKGDLNTSGG

SEQ ID NO: 6554 - protein, 7 aa, Neisseria
QNGNLTN

SEQ ID NO: 6555 - protein, 10 aa, Neisseria
RNINSNGNIQ

SEQ ID NO: 6556 - protein, 17 aa, Neisseria
IGLKAEKSINIDGGQVQ

SEQ ID NO: 6557 - protein, 23 aa, Neisseria
NLNGTTQTSGNERNGNTAIDRMA

SEQ ID NO: 6558 - protein, 14 aa, Neisseria
GSHTEQVDNRTSDG

SEQ ID NO: 6559 - protein, 6 aa, Neisseria
HASNDI

SEQ ID NO: 6560 - protein, 10 aa, Neisseria
VSNQVKDGTT

SEQ ID NO: 6561 - protein, 35 aa, Neisseria
IRTEHREAYGTLDDENHRHVRQSTEVGSSIRTQNG

SEQ ID NO: 6562 - protein, 19 aa, Neisseria
AGNDLKIRQGELEAEEGKT

SEQ ID NO: 6563 - protein, 45 aa, Neisseria
AGRDVTISEGRQITELDTSVSGKSKGILSSTKTHDRYRFSHDEAV

SEQ ID NO: 6564 - protein, 7 aa, Neisseria
NIGGGKM

SEQ ID NO: 6565 - protein, 18 aa, Neisseria
GQDINVRGSNLISDKGIV

SEQ ID NO: 6566 - protein, 27 aa, Neisseria
AGHDIDISTAHNRYTGNEYHESKKSGV

SEQ ID NO: 6567 - protein, 16 aa, Neisseria
TIGNRKTTDDTDRTNI

SEQ ID NO: 6568 - protein, 6 aa, Neisseria
SLNGDT

SEQ ID NO: 6569 - protein, 22 aa, Neisseria
AGNRYRQTGSTVSSPEGRNTVT

SEQ ID NO: 6570 - protein, 18 aa, Neisseria
FANNRYATDYAHTQEQKG

SEQ ID NO: 6571 - protein, 12 aa, Neisseria
QNVGKSKNKRVN

SEQ ID NO: 6572 - protein, 18 aa, Neisseria
APSSSAGQGQNNNQSPSI

SEQ ID NO: 6573 - protein, 16 aa, Neisseria
TYGEQKSRNEQKRHYT

SEQ ID NO: 6574 - protein, 5 aa, Neisseria
GKGQT

SEQ ID NO: 6575 - protein, 11 aa, Neisseria
ATGSGEQSNIN

SEQ ID NO: 6576 - protein, 5 aa, Neisseria
TGSDV

SEQ ID NO: 6577 - protein, 20 aa, Neisseria
QSAKQDGSEQSKNKSSGWNA

SEQ ID NO: 6578 - protein, 39 aa, Neisseria
AGGNIGKGKEQGGSTTHRHTHVGSTTGKTTIRSGGDTTL

SEQ ID NO: 6579 - protein, 12 aa, Neisseria
GKGIQADTRNLH

SEQ ID NO: 6580 - protein, 16 aa, Neisseria
SVQDTETYQSKQQNGN

SEQ ID NO: 6581 - protein, 15 aa, Neisseria
SASGSYRQSKVKADH

SEQ ID NO: 6582 - protein, 19 aa, Neisseria
YAGEDGYQIKVRDNTDLKG

SEQ ID NO: 6583 - protein, 12 aa, Neisseria
SQSAEDKGKNLF

SEQ ID NO: 6584 - protein, 15 aa, Neisseria
SDIQNHSRYEGRSFG

SEQ ID NO: 6585 - protein, 22 aa, Neisseria
LNGGWDGTVTDKQGRPTDRISP

SEQ ID NO: 6586 - protein, 19 aa, Neisseria
YGSDGDSKNSTTRSGVNTH

SEQ ID NO: 6587 - protein, 22 aa, Neisseria
ITDEAGQLARTGRTAKETEARI

SEQ ID NO: 6588 - protein, 42 aa, Neisseria
GIDTETADQHSGHLKNSFDKDAVAKEINLQREVTKEFGRNAA

SEQ ID NO: 6589 - protein, 21 aa, Neisseria
VADKLGNTQSYERYQEARTLL

SEQ ID NO: 6590 - protein, 15 aa, Neisseria
AELQNTDSEAEKAAF

SEQ ID NO: 6591 - protein, 19 aa, Neisseria
AENQSRYDTWKEGGIGRSI

SEQ ID NO: 6592 - protein, 13 aa, Neisseria
YLDKAAENLGPAG

SEQ ID NO: 6593 - protein, 15 aa, Neisseria
VDWNNRQLHPKEMAL

SEQ ID NO: 6594 - protein, 32 aa, Neisseria
DKYAEALKREVEKREGRKISSQEAAMRIRRQI

SEQ ID NO: 6595 - protein, 15 aa, Neisseria
WVDKGSQDGYTDQSV

SEQ ID NO: 6596 - protein, 8 aa, Neisseria
MKGEDKAL

SEQ ID NO: 6597 - protein, 32 aa, Neisseria
DYRDYGARNPQTYNDPKLFEEYRRQDKPEYRN

SEQ ID NO: 6598 - protein, 19 aa, Neisseria
HSGTKDTKIRQGERKNEEF

SEQ ID NO: 6599 - protein, 8 aa, Neisseria
NPNPRIKV

SEQ ID NO: 6600 - protein, 15 aa, Neisseria
RNLKNIKPTVTGSDP

SEQ ID NO: 6601 - protein, 40 aa, Neisseria
GNVAKGDRIPDTALASKGIKHKNRKDQLEKNKKSGEDFEM

SEQ ID NO: 6602 - protein, 45 aa, Neisseria
IYQKKVKQGFKPQRQITVKTKSGVKTRLDIISKEGGLDVCTECKA

SEQ ID NO: 6603 - protein, 18 aa, Neisseria
PLTKNQKKAFPEIERTGA

SEQ ID NO: 6604 - protein, 24 aa, Neisseria
GKGKPGYPKGTKIEPTKVIIERKR

SEQ ID NO: 6605 - protein, 6 aa, Neisseria
FNKHRN

SEQ ID NO: 6606 - protein, 12 aa, Neisseria
ENAKREGKNTAD

SEQ ID NO: 6607 - protein, 7 aa, Neisseria
VADKSAP

SEQ ID NO: 6608 - protein, 6 aa, Neisseria
NSRSNT

SEQ ID NO: 6609 - protein, 5 aa, Neisseria
GEARV

SEQ ID NO: 6610 - protein, 8 aa, Neisseria
VGGRRAEV

SEQ ID NO: 6611 - protein, 7 aa, Neisseria
SGFKIRQ

SEQ ID NO: 6612 - protein, 8 aa, Neisseria
LDARDTDY

SEQ ID NO: 6613 - protein, 5 aa, Neisseria
NDVAA

SEQ ID NO: 6614 - protein, 5 aa, Neisseria
AGIRN

SEQ ID NO: 6615 - protein, 5 aa, Neisseria
AEGKL

SEQ ID NO: 6616 - protein, 5 aa, Neisseria
TGENH

SEQ ID NO: 6617 - protein, 8 aa, Neisseria
ASQDDANI

SEQ ID NO: 6618 - protein, 9 aa, Neisseria
NLGRLKNQN

SEQ ID NO: 6619 - protein, 5 aa, Neisseria
ARLDM

SEQ ID NO: 6620 - protein, 11 aa, Neisseria
GKFDNSGKIGV

SEQ ID NO: 6621 - protein, 7 aa, Neisseria
SVSKPGS

SEQ ID NO: 6622 - protein, 7 aa, Neisseria
AKLRVSG

SEQ ID NO: 6623 - protein, 7 aa, Neisseria
VKGKLQA

SEQ ID NO: 6624 - protein, 6 aa, Neisseria
QTAKNS

SEQ ID NO: 6625 - protein, 10 aa, Neisseria
GKIDNRELHN

SEQ ID NO: 6626 - protein, 10 aa, Neisseria
RLSNDKKGNI

SEQ ID NO: 6627 - protein, 5 aa, Neisseria
GTVTT

SEQ ID NO: 6628 - protein, 8 aa, Neisseria
NNLRNTGK

SEQ ID NO: 6629 - protein, 19 aa, Neisseria
LNTEGQTLDNTRGRIEAET

SEQ ID NO: 6630 - protein, 7 aa, Neisseria
RNVDNQN

SEQ ID NO: 6631 - protein, 8 aa, Neisseria
SIHDKNQN

SEQ ID NO: 6632 - protein, 6 aa, Neisseria
NADGTI

SEQ ID NO: 6633 - protein, 9 aa, Neisseria
FVVERDLTA

SEQ ID NO: 6634 - protein, 7 aa, Neisseria
IKGRLKN

SEQ ID NO: 6635 - protein, 7 aa, Neisseria
EQTDITS

SEQ ID NO: 6636 - protein, 9 aa, Neisseria
QHVDNRGLI

SEQ ID NO: 6637 - protein, 13 aa, Neisseria
LNREETTEGSTKA

SEQ ID NO: 6638 - protein, 17 aa, Neisseria
AARKRLDIGAKEIHNQE

SEQ ID NO: 6639 - protein, 8 aa, Neisseria
NRLDEQHH

SEQ ID NO: 6640 - protein, 12 aa, Neisseria
TYLAKAEKQVRD

SEQ ID NO: 6641 - protein, 7 aa, Neisseria
AGKDGLF

SEQ ID NO: 6642 - protein, 8 aa, Neisseria
SQGQKDQT

SEQ ID NO: 6643 - protein, 7 aa, Neisseria
NGSRIEA

SEQ ID NO: 6644 - protein, 11 aa, Neisseria
TYKERIIENRP

SEQ ID NO: 6645 - protein, 7 aa, Neisseria
LNKDSRI

SEQ ID NO: 6646 - protein, 13 aa, Neisseria
IITDDLNQKEITN

SEQ ID NO: 6647 - protein, 10 aa, Neisseria
TTGKGRTDAV

SEQ ID NO: 6648 - protein, 16 aa, Neisseria
GWYSGRKRQRRTERNH

SEQ ID NO: 6649 - protein, 10 aa, Neisseria
TDPQFADYRR

SEQ ID NO: 6650 - protein, 7 aa, Neisseria
HLHKRLG

SEQ ID NO: 6651 - protein, 17 aa, Neisseria
RRLDGYRSDEEQFKALM

SEQ ID NO: 6652 - protein, 8 aa, Neisseria
ARKGDLNT

SEQ ID NO: 6653 - protein, 10 aa, Neisseria
IGLKAEKSIN

SEQ ID NO: 6654 - protein, 15 aa, Neisseria
SGNERNGNTAIDRMA

SEQ ID NO: 6655 - protein, 11 aa, Neisseria
HTEQVDNRTSD

SEQ ID NO: 6656 - protein, 8 aa, Neisseria
NQVKDGTT

SEQ ID NO: 6657 - protein, 26 aa, Neisseria
IRTEHREAYGTLDDENHRHVRQSTEV

SEQ ID NO: 6658 - protein, 5 aa, Neisseria
IRTQN

SEQ ID NO: 6659 - protein, 19 aa, Neisseria
AGNDLKIRQGELEAEEGKT

SEQ ID NO: 6660 - protein, 18 aa, Neisseria
AGRDVTISEGRQITELDT

SEQ ID NO: 6661 - protein, 8 aa, Neisseria
VSGKSKGI

SEQ ID NO: 6662 - protein, 15 aa, Neisseria
TKTHDRYRFSHDEAV

SEQ ID NO: 6663 - protein, 5 aa, Neisseria
INVRG

SEQ ID NO: 6664 - protein, 9 aa, Neisseria
NLISDKGIV

SEQ ID NO: 6665 - protein, 7 aa, Neisseria
AGHDIDI

SEQ ID NO: 6666 - protein, 10 aa, Neisseria
EYHESKKSGV

SEQ ID NO: 6667 - protein, 13 aa, Neisseria
GNRKTTDDTDRTN

SEQ ID NO: 6668 - protein, 7 aa, Neisseria
NRYRQTG

SEQ ID NO: 6669 - protein, 10 aa, Neisseria
SSPEGRNTVT

SEQ ID NO: 6670 - protein, 5 aa, Neisseria
QEQKG

SEQ ID NO: 6671 - protein, 11 aa, Neisseria
NVGKSKNKRVN

SEQ ID NO: 6672 - protein, 10 aa, Neisseria
SAGQGQNNNQ

SEQ ID NO: 6673 - protein, 14 aa, Neisseria
GEQKSRNEQKRHYT

SEQ ID NO: 6674 - protein, 7 aa, Neisseria
GSGEQSN

SEQ ID NO: 6675 - protein, 16 aa, Neisseria
QSAKQDGSEQSKNKSS

SEQ ID NO: 6676 - protein, 10 aa, Neisseria
NIGKGKEQGG

SEQ ID NO: 6677 - protein, 11 aa, Neisseria
TTIRSGGDTTL

SEQ ID NO: 6678 - protein, 9 aa, Neisseria
IQADTRNLH

SEQ ID NO: 6679 - protein, 14 aa, Neisseria
SVQDTETYQSKQQN

SEQ ID NO: 6680 - protein, 12 aa, Neisseria
GSYRQSKVKADH

SEQ ID NO: 6681 - protein, 18 aa, Neisseria
AGEDGYQIKVRDNTDLKG

SEQ ID NO: 6682 - protein, 9 aa, Neisseria
QSAEDKGKN

SEQ ID NO: 6683 - protein, 7 aa, Neisseria
SRYEGRS

SEQ ID NO: 6684 - protein, 15 aa, Neisseria
TVTDKQGRPTDRISP

SEQ ID NO: 6685 - protein, 15 aa, Neisseria
GSDGDSKNSTTRSGV

SEQ ID NO: 6686 - protein, 7 aa, Neisseria
ITDEAGQ

SEQ ID NO: 6687 - protein, 14 aa, Neisseria
ARTGRTAKETEARI

SEQ ID NO: 6688 - protein, 13 aa, Neisseria
IDTETADQHSGHL

SEQ ID NO: 6689 - protein, 24 aa, Neisseria
NSFDKDAVAKEINLQREVTKEFGR

SEQ ID NO: 6690 - protein, 7 aa, Neisseria
VADKLGN

SEQ ID NO: 6691 - protein, 13 aa, Neisseria
QSYERYQEARTLL

SEQ ID NO: 6692 - protein, 15 aa, Neisseria
AELQNTDSEAEKAAF

SEQ ID NO: 6693 - protein, 13 aa, Neisseria
NQSRYDTWKEGGI

SEQ ID NO: 6694 - protein, 13 aa, Neisseria
YLDKAAENLGPAG

SEQ ID NO: 6695 - protein, 9 aa, Neisseria
QLHPKEMAL

SEQ ID NO: 6696 - protein, 32 aa, Neisseria; identical to SEQ ID NO: 6594

SEQ ID NO: 6697 - protein, 11 aa, Neisseria
WVDKGSQDGYT

SEQ ID NO: 6698 - protein, 8 aa, Neisseria
MKGEDKAL

SEQ ID NO: 6699 - protein, 15 aa, Neisseria
DYRDYGARNPQTYND

SEQ ID NO: 6700 - protein, 15 aa, Neisseria
KLFEEYRRQDKPEYR

SEQ ID NO: 6701 - protein, 17 aa, Neisseria
GTKDTKIRQGERKNEEF

SEQ ID NO: 6702 - protein, 6 aa, Neisseria
PNPRIK

SEQ ID NO: 6703 - protein, 7 aa, Neisseria
RNLKNIK

SEQ ID NO: 6704 - protein, 10 aa, Neisseria
NVAKGDRIPD

SEQ ID NO: 6705 - protein, 24 aa, Neisseria
KGIKHKNRKDQLEKNKKSGEDFEM

SEQ ID NO: 6706 - protein, 14 aa, Neisseria
IYQKKVKQGFKPQR

SEQ ID NO: 6707 - protein, 22 aa, Neisseria
ITVKTKSGVKTRLDIISKEGGL

SEQ ID NO: 6708 - protein, 7 aa, Neisseria
VCTECKA

SEQ ID NO: 6709 - protein, 16 aa, Neisseria
LTKNQKKAFPEIERTG

SEQ ID NO: 6710 - protein, 24 aa, Neisseria
GKGKPGYPKGTKIEPTKVIIERKR

SEQ ID NO: 6711 - protein, 10 aa, Neisseria
ATCTRAMSKS

SEQ ID NO: 6712 - protein, 5 aa, Neisseria
SSWAR

SEQ ID NO: 6713 - protein, 7 aa, Neisseria
ISTWSDL

SEQ ID NO: 6714 - protein, 9 aa, Neisseria
DFMSQLDLT

SEQ ID NO: 6715 - protein, 20 aa, Neisseria
SHSGETISSCPAMASITKPN

SEQ ID NO: 6716 - protein, 7 aa, Neisseria
ANTTSAF

SEQ ID NO: 6717 - protein, 9 aa, Neisseria
MDSTLSKTC

SEQ ID NO: 6718 - protein, 13 aa, Neisseria
FARPRPAASNTSL

SEQ ID NO: 6719 - protein, 9 aa, Neisseria
FASPNDTGS

SEQ ID NO: 6720 - protein, 10 aa, Neisseria
AMSKSSAKYG

SEQ ID NO: 6721 - protein, 18 aa, Neisseria
SWARTRPTVCPPLPKPTI

SEQ ID NO: 6722 - protein, 8 aa, Neisseria
CRSSDFMS

SEQ ID NO: 6723 - protein, 19 aa, Neisseria
DLTKRPTSASLPPKRKGAI

SEQ ID NO: 6724 - protein, 7 aa, Neisseria
IDSRTAA

SEQ ID NO: 6725 - protein, 9 aa, Neisseria
SHSGETISS

SEQ ID NO: 6726 - protein, 13 aa, Neisseria
SITKPNSPPCARY

SEQ ID NO: 6727 - protein, 7 aa, Neisseria
LRLSPTE

SEQ ID NO: 6728 - protein, 13 aa, Neisseria
SIANSINTCRQPP

SEQ ID NO: 6729 - protein, 7 aa, Neisseria
ARPRPAA

SEQ ID NO: 6730 - protein, 7 aa, Neisseria
SPNDTGS

SEQ ID NO: 6731 - protein, 7 aa, Neisseria
AMSKSSA

SEQ ID NO: 6732 - protein, 5 aa, Neisseria
ARTRP

SEQ ID NO: 6733 - protein, 5 aa, Neisseria
RSSDF

SEQ ID NO: 6734 - protein, 8 aa, Neisseria
DLTKRPTS

SEQ ID NO: 6735 - protein, 9 aa, Neisseria
LPPKRKGAI

SEQ ID NO: 6736 - protein, 5 aa, Neisseria
IDSRT

SEQ ID NO: 6737 - protein, 7 aa, Neisseria
HSGETIS

SEQ ID NO: 6738 - protein, 5 aa, Neisseria
TKPNS

SEQ ID NO: 6739 - protein, 9 aa, Neisseria
PFRDGAHKM

SEQ ID NO: 6740 - protein, 7 aa, Neisseria
NIPDRPA

SEQ ID NO: 6741 - protein, 7 aa, Neisseria
VAKRELF

SEQ ID NO: 6742 - protein, 16 aa, Neisseria
IGIDRNNRREANEQLI

SEQ ID NO: 6743 - protein, 7 aa, Neisseria
GLVRKNE

SEQ ID NO: 6744 - protein, 17 aa, Neisseria
EGTRLAPGKRGKYKLGG

SEQ ID NO: 6745 - protein, 15 aa, Neisseria
SGSEAELMEKCEHLI

SEQ ID NO: 6746 - protein, 6 aa, Neisseria
MPSETA

SEQ ID NO: 6747 - protein, 18 aa, Neisseria
FAVDPNCGADGTGGKGHA

SEQ ID NO: 6748 - protein, 29 aa, Neisseria
AVGGEEGGVVADDVACADGGKADGRRIAR

SEQ ID NO: 6749 - protein, 10 aa, Neisseria
SAERAGDDFA

SEQ ID NO: 6750 - protein, 14 aa, Neisseria
PNCGADGTGGKGHA

SEQ ID NO: 6751 - protein, 14 aa, Neisseria
GGEEGGVVADDVAC

SEQ ID NO: 6752 - protein, 12 aa, Neisseria
DGGKADGRRIAR

SEQ ID NO: 6753 - protein, 10 aa, Neisseria
SAERAGDDFA

SEQ ID NO: 6754 - protein, 5 aa, Neisseria
GVYQV

SEQ ID NO: 6755 - protein, 10 aa, Neisseria
ELVQEIAREV

SEQ ID NO: 6756 - protein, 5 aa, Neisseria
ALKAV

SEQ ID NO: 6757 - protein, 18 aa, Neisseria
YALEGISDLIATVRKIRQ

SEQ ID NO: 6758 - protein, 5 aa, Neisseria
TGIVR

SEQ ID NO: 6759 - protein, 15 aa, Neisseria
AEVSEQLRSHFGDLL

SEQ ID NO: 6760 - protein, 11 aa, Neisseria
NQKGGVGKTTT

SEQ ID NO: 6761 - protein, 7 aa, Neisseria
LASRGKR

SEQ ID NO: 6762 - protein, 23 aa, Neisseria
VDLDPQGNATTGSGIDKAGLQSG

SEQ ID NO: 6763 - protein, 6 aa, Neisseria
GDADVQ

SEQ ID NO: 6764 - protein, 8 aa, Neisseria
AVRSKEGG

SEQ ID NO: 6765 - protein, 5 aa, Neisseria
AEIEL

SEQ ID NO: 6766 - protein, 21 aa, Neisseria
QEIAREVRLKNALKAVEEDYD

SEQ ID NO: 6767 - protein, 5 aa, Neisseria
CPPSL

SEQ ID NO: 6768 - protein, 16 aa, Neisseria
ATVRKIRQAVNPDLDI

SEQ ID NO: 6769 - protein, 24 aa, Neisseria
TMYDSRSRLVAEVSEQLRSHFGDL

SEQ ID NO: 6770 - protein, 14 aa, Neisseria
IPRNIRLAEAPSHG

SEQ ID NO: 6771 - protein, 7 aa, Neisseria
AQAKGTK

SEQ ID NO: 6772 - protein, 10 aa, Neisseria
DELAARVSGK

SEQ ID NO: 6773 - protein, 8 aa, Neisseria
NQKGGVGK

SEQ ID NO: 6774 - protein, 7 aa, Neisseria
LASRGKR

SEQ ID NO: 6775 - protein, 5 aa, Neisseria
LDPQG

SEQ ID NO: 6776 - protein, 8 aa, Neisseria
SGIDKAGL

SEQ ID NO: 6777 - protein, 6 aa, Neisseria
GDADVQ

SEQ ID NO: 6778 - protein, 8 aa, Neisseria
AVRSKEGG

SEQ ID NO: 6779 - protein, 5 aa, Neisseria
AEIEL

SEQ ID NO: 6780 - protein, 21 aa, Neisseria
QEIAREVRLKNALKAVEEDYD

SEQ ID NO: 6781 - protein, 8 aa, Neisseria
ATVRKIRQ

SEQ ID NO: 6782 - protein, 5 aa, Neisseria
PDLDI

SEQ ID NO: 6783 - protein, 17 aa, Neisseria
MYDSRSRLVAEVSEQLR

SEQ ID NO: 6784 - protein, 10 aa, Neisseria
RNIRLAEAPS

SEQ ID NO: 6785 - protein, 7 aa, Neisseria
AQAKGTK

SEQ ID NO: 6786 - protein, 5 aa, Neisseria
DELAA

SEQ ID NO: 6787 - protein, 6 aa, Neisseria
NIFRRI

SEQ ID NO: 6788 - protein, 5 aa, Neisseria
KACKN

SEQ ID NO: 6789 - protein, 8 aa, Neisseria
EKANTVRY

SEQ ID NO: 6790 - protein, 7 aa, Neisseria
SLAQCFT

SEQ ID NO: 6791 - protein, 9 aa, Neisseria
RPLPSIITA

SEQ ID NO: 6792 - protein, 18 aa, Neisseria
EFVGFGNVFVGQFLNRFF

SEQ ID NO: 6793 - protein, 8 aa, Neisseria
EEFFDVVV

SEQ ID NO: 6794 - protein, 9 aa, Neisseria
FNQVFAAFL

SEQ ID NO: 6795 - protein, 16 aa, Neisseria
HRHADQVADSCRVQSQ

SEQ ID NO: 6796 - protein, 21 aa, Neisseria
SASSMPCRICRLKRSRLPNIF

SEQ ID NO: 6797 - protein, 37 aa, Neisseria
FSCRRRTCFCKACKNSPIRNETSSSGRRQFSVEKANT

SEQ ID NO: 6798 - protein, 8 aa, Neisseria
SNASKPRL

SEQ ID NO: 6799 - protein, 11 aa, Neisseria
PIMRGRKRFFA

SEQ ID NO: 6800 - protein, 16 aa, Neisseria
FRGSAFKCRLNAEPCR

SEQ ID NO: 6801 - protein, 7 aa, Neisseria
VADRDAA

SEQ ID NO: 6802 - protein, 20 aa, Neisseria
GQHGHRHADQVADSCRVQSQ

SEQ ID NO: 6803 - protein, 10 aa, Neisseria
RICRLKRSRL

SEQ ID NO: 6804 - protein, 7 aa, Neisseria
CRRRTCF

SEQ ID NO: 6805 - protein, 27 aa, Neisseria
KACKNSPIRNETSSSGRRQFSVEKANT

SEQ ID NO: 6806 - protein, 6 aa, Neisseria
ASKPRL

SEQ ID NO: 6807 - protein, 9 aa, Neisseria
MRGRKRFFA

SEQ ID NO: 6808 - protein, 13 aa, Neisseria
SAFKCRLNAEPCR

SEQ ID NO: 6809 - protein, 7 aa, Neisseria
VADRDAA

SEQ ID NO: 6810 - protein, 15 aa, Neisseria
HGHRHADQVADSCRV

SEQ ID NO: 6811 - protein, 23 aa, Neisseria
AAFCGLIALIALWEYARMGGLCK

SEQ ID NO: 6812 - protein, 7 aa, Neisseria
FWLAVMP

SEQ ID NO: 6813 - protein, 10 aa, Neisseria
SPGKSWEGAI

SEQ ID NO: 6814 - protein, 6 aa, Neisseria
TVLIGL

SEQ ID NO: 6815 - protein, 16 aa, Neisseria
LTVVSVCGDLLESWLK

SEQ ID NO: 6816 - protein, 6 aa, Neisseria
GIKDSS

SEQ ID NO: 6817 - protein, 7 aa, Neisseria
CKIKTNH

SEQ ID NO: 6818 - protein, 8 aa, Neisseria
KWRLNGGW

SEQ ID NO: 6819 - protein, 10 aa, Neisseria
SLRPHPDDAL

SEQ ID NO: 6820 - protein, 8 aa, Neisseria
KAFGKHKI

SEQ ID NO: 6821 - protein, 8 aa, Neisseria
ISPGKSWE

SEQ ID NO: 6822 - protein, 14 aa, Neisseria
AAGIKDSSKLLPGH

SEQ ID NO: 6823 - protein, 8 aa, Neisseria
GVFDRTDS

SEQ ID NO: 6824 - protein, 5 aa, Neisseria
CKIKT

SEQ ID NO: 6825 - protein, 7 aa, Neisseria
PHPDDAL

SEQ ID NO: 6826 - protein, 7 aa, Neisseria
AFGKHKI

SEQ ID NO: 6827 - protein, 9 aa, Neisseria
AAGIKDSSK

SEQ ID NO: 6828 - protein, 7 aa, Neisseria
VFDRTDS

SEQ ID NO: 6829 - protein, 10 aa, Neisseria
RAFAAALIGL

SEQ ID NO: 6830 - protein, 12 aa, Neisseria
HADTFQKIGFIN

SEQ ID NO: 6831 - protein, 11 aa, Neisseria
QARKIQKTLDS

SEQ ID NO: 6832 - protein, 7 aa, Neisseria
DELQKLQ

SEQ ID NO: 6833 - protein, 6 aa, Neisseria
LRNAKK

SEQ ID NO: 6834 - protein, 8 aa, Neisseria
EKWRGLVA

SEQ ID NO: 6835 - protein, 12 aa, Neisseria
LQQNANRVIVKI

SEQ ID NO: 6836 - protein, 62 aa, Neisseria
NTERIYLESKQARKIQKTLDSEFSARQDELQKLQREGLDLERQLAEGKLRNAKKAQAEEKWR

SEQ ID NO: 6837 - protein, 21 aa, Neisseria
FRKKQAQFEEDYNLRRNEEFA

SEQ ID NO: 6838 - protein, 7 aa, Neisseria
QQNANRV

SEQ ID NO: 6839 - protein, 9 aa, Neisseria
IAKQEGYDV

SEQ ID NO: 6840 - protein, 15 aa, Neisseria
QYDVTDSVIKEMNAR

SEQ ID NO: 6841 - protein, 58 aa, Neisseria
IYLESKQARKIQKTLDSEFSARQDELQKLQREGLDLERQLAEGKLRNAKKAQAEEKWR

SEQ ID NO: 6842 - protein, 21 aa, Neisseria
FRKKQAQFEEDYNLRRNEEFA

SEQ ID NO: 6843 - protein, 7 aa, Neisseria
IAKQEGY

SEQ ID NO: 6844 - protein, 13 aa, Neisseria
DVTDSVIKEMNAR

SEQ ID NO: 6845 - protein, 5 aa, Neisseria
AVNVL

SEQ ID NO: 6846 - protein, 9 aa, Neisseria
DGARVFRAG

SEQ ID NO: 6847 - protein, 9 aa, Neisseria
AAVADFFAV

SEQ ID NO: 6848 - protein, 6 aa, Neisseria
VEVFKE

SEQ ID NO: 6849 - protein, 6 aa, Neisseria
AAGRGT

SEQ ID NO: 6850 - protein, 24 aa, Neisseria
KQAQADGARVFRAGHREEQLGGDV

SEQ ID NO: 6851 - protein, 7 aa, Neisseria
FRTERAA

SEQ ID NO: 6852 - protein, 7 aa, Neisseria
VFKEGDF

SEQ ID NO: 6853 - protein, 23 aa, Neisseria
RNADFAAEHQAREGFAQGEEPGL

SEQ ID NO: 6854 - protein, 9 aa, Neisseria
AARQGDFGV

SEQ ID NO: 6855 - protein, 6 aa, Neisseria
VAARRP

SEQ ID NO: 6856 - protein, 5 aa, Neisseria
AAGRG

SEQ ID NO: 6857 - protein, 21 aa, Neisseria
KQAQADGARVFRAGHREEQLG

SEQ ID NO: 6858 - protein, 7 aa, Neisseria
FRTERAA

SEQ ID NO: 6859 - protein, 7 aa, Neisseria
VFKEGDF

SEQ ID NO: 6860 - protein, 21 aa, Neisseria
RNADFAAEHQREGFAQGEEPG

SEQ ID NO: 6861 - protein, 6 aa, Neisseria
VAARRP

SEQ ID NO: 6862 - protein, 13 aa, Neisseria
LDVVSRHPEKFRV

SEQ ID NO: 6863 - protein, 10 aa, Neisseria
KQVEKLAAQC

SEQ ID NO: 6864 - protein, 11 aa, Neisseria
QALVDVASADE

SEQ ID NO: 6865 - protein, 14 aa, Neisseria
CAIVGAVGLPSALA

SEQ ID NO: 6866 - protein, 10 aa, Neisseria
QVLPRDYAGR

SEQ ID NO: 6867 - protein, 14 aa, Neisseria
LNTFDRITPAQAVK

SEQ ID NO: 6868 - protein, 5 aa, Neisseria
KGLEL

SEQ ID NO: 6869 - protein, 6 aa, Neisseria
IHSMVR

SEQ ID NO: 6870 - protein, 9 aa, Neisseria
GLPERIDSG

SEQ ID NO: 6871 - protein, 5 aa, Neisseria
LSALT

SEQ ID NO: 6872 - protein, 5 aa, Neisseria
VAAFL

SEQ ID NO: 6873 - protein, 25 aa, Neisseria
FTDIAKTVAHCLAQDFSDGIGDIGG

SEQ ID NO: 6874 - protein, 10 aa, Neisseria
STGSIGESTL

SEQ ID NO: 6875 - protein, 10 aa, Neisseria
VVSRHPEKFR

SEQ ID NO: 6876 - protein, 7 aa, Neisseria
KQVEKLA

SEQ ID NO: 6877 - protein, 9 aa, Neisseria
ADAEHAARL

SEQ ID NO: 6878 - protein, 9 aa, Neisseria
ALLKRDGTA

SEQ ID NO: 6879 - protein, 7 aa, Neisseria
ASADEVS

SEQ ID NO: 6880 - protein, 5 aa, Neisseria
QKGKT

SEQ ID NO: 6881 - protein, 6 aa, Neisseria
ANKETL

SEQ ID NO: 6882 - protein, 6 aa, Neisseria
TARANG

SEQ ID NO: 6883 - protein, 6 aa, Neisseria
PVDSEH

SEQ ID NO: 6884 - protein, 13 aa, Neisseria
LPRDYAGRLNEHG

SEQ ID NO: 6885 - protein, 27 aa, Neisseria
NTFDRITPAQAVKHPNWRMGRKISVDS

SEQ ID NO: 6886 - protein, 6 aa, Neisseria
NKGLEL

SEQ ID NO: 6887 - protein, 9 aa, Neisseria
NCPPDKLEV

SEQ ID NO: 6888 - protein, 8 aa, Neisseria
VRYRDGSV

SEQ ID NO: 6889 - protein, 7 aa, Neisseria
GNPDMRT

SEQ ID NO: 6890 - protein, 14 aa, Neisseria
LPERIDSGVGDLDF

SEQ ID NO: 6891 - protein, 9 aa, Neisseria
TFQKPDFDR

SEQ ID NO: 6892 - protein, 11 aa, Neisseria
QDFSDGIGDIG

SEQ ID NO: 6893 - protein, 9 aa, Neisseria
QDARTRAQA

SEQ ID NO: 6894 - protein, 10 aa, Neisseria
VVSRHPEKFR

SEQ ID NO: 6895 - protein, 7 aa, Neisseria
KQVEKLA

SEQ ID NO: 6896 - protein, 9 aa, Neisseria
ADAEHAARL

SEQ ID NO: 6897 - protein, 9 aa, Neisseria
ALLKRDGTA

SEQ ID NO: 6898 - protein, 7 aa, Neisseria
ASADEVS

SEQ ID NO: 6899 - protein, 5 aa, Neisseria
NKETL

SEQ ID NO: 6900 - protein, 6 aa, Neisseria
TARANG

SEQ ID NO: 6901 - protein, 5 aa, Neisseria
VDSEH

SEQ ID NO: 6902 - protein, 8 aa, Neisseria
DYAGRLNE

SEQ ID NO: 6903 - protein, 5 aa, Neisseria
DRITP

SEQ ID NO: 6904 - protein, 8 aa, Neisseria
RMGRKISV

SEQ ID NO: 6905 - protein, 5 aa, Neisseria
KGLEL

SEQ ID NO: 6906 - protein, 6 aa, Neisseria
PPDKLE

SEQ ID NO: 6907 - protein, 7 aa, Neisseria
VRYRDGS

SEQ ID NO: 6908 - protein, 7 aa, Neisseria
GNPDMRT

SEQ ID NO: 6909 - protein, 14 aa, Neisseria
LPERIDSGVGDLDF

SEQ ID NO: 6910 - protein, 7 aa, Neisseria
QKPDFDR

SEQ ID NO: 6911 - protein, 7 aa, Neisseria
DFSDGIG

SEQ ID NO: 6912 - protein, 9 aa, Neisseria
QDARTRAQA

SEQ ID NO: 6913 - protein, 6 aa, Neisseria
PNSLKK

SEQ ID NO: 6914 - protein, 35 aa, Neisseria
LKQAKSIPSGFYKSLDALVDRNSGRAARELAEVVD

SEQ ID NO: 6915 - protein, 6 aa, Neisseria
GKLYRQ

SEQ ID NO: 6916 - protein, 7 aa, Neisseria
MLDSPDT

SEQ ID NO: 6917 - protein, 9 aa, Neisseria
EKAVETARL

SEQ ID NO: 6918 - protein, 12 aa, Neisseria
NVGKALEANKKC

SEQ ID NO: 6919 - protein, 12 aa, Neisseria
FPAAVEAYAAIE

SEQ ID NO: 6920 - protein, 11 aa, Neisseria
MVGEKLYEAYA

SEQ ID NO: 6921 - protein, 20 aa, Neisseria
PEEGLNRLTGYMQTFPELDL

SEQ ID NO: 6922 - protein, 5 aa, Neisseria
NGVYR

SEQ ID NO: 6923 - protein, 11 aa, Neisseria
RSVIGRQLQRS

SEQ ID NO: 6924 - protein, 16 aa, Neisseria
MRPNLPNSLKKADMDN

SEQ ID NO: 6925 - protein, 44 aa, Neisseria
TVLKQAKSIPSGFYKSLDALVDRNSGRAARELAEVVDGRPQSYD

SEQ ID NO: 6926 - protein, 32 aa, Neisseria
LYRQRGENDKAINIHRTMLDSPDTVGEKRARV

SEQ ID NO: 6927 - protein, 11 aa, Neisseria
YQSAGLVDRAE

SEQ ID NO: 6928 - protein, 12 aa, Neisseria
LQDGKMAREARQ

SEQ ID NO: 6929 - protein, 13 aa, Neisseria
YQQDRDWEKAVET

SEQ ID NO: 6930 - protein, 10 aa, Neisseria
RLLSHDDQTY

SEQ ID NO: 6931 - protein, 11 aa, Neisseria
KALEANKKCTR

SEQ ID NO: 6932 - protein, 8 aa, Neisseria
DIEHRQGN

SEQ ID NO: 6933 - protein, 15 aa, Neisseria
AQGKPEEGLNRLTGY

SEQ ID NO: 6934 - protein, 7 aa, Neisseria
KCEKEAA

SEQ ID NO: 6935 - protein, 11 aa, Neisseria
ELVRRKPDLNG

SEQ ID NO: 6936 - protein, 17 aa, Neisseria
KLSDMNPAWKADADMMR

SEQ ID NO: 6937 - protein, 11 aa, Neisseria
VMYRCRNCHFK

SEQ ID NO: 6938 - protein, 17 aa, Neisseria
CPACNKWQTFTPNKIEV

SEQ ID NO: 6939 - protein, 5 aa, Neisseria
MRPNL

SEQ ID NO: 6940 - protein, 10 aa, Neisseria
NSLKKADMDN

SEQ ID NO: 6941 - protein, 9 aa, Neisseria
TVLKQAKSI

SEQ ID NO: 6942 - protein, 25 aa, Neisseria
DALVDRNSGRAARELAEVVDGRPQS

SEQ ID NO: 6943 - protein, 13 aa, Neisseria
LYRQRGENDKAIN

SEQ ID NO: 6944 - protein, 16 aa, Neisseria
TMLDSPDTVGEKRARV

SEQ ID NO: 6945 - protein, 6 aa, Neisseria
LVDRAE

SEQ ID NO: 6946 - protein, 11 aa, Neisseria
QDGKMAREARQ

SEQ ID NO: 6947 - protein, 12 aa, Neisseria
QQDRDWEKAVET

SEQ ID NO: 6948 - protein, 8 aa, Neisseria
LSHDDQTY

SEQ ID NO: 6949 - protein, 11 aa, Neisseria
KALEANKKCTR

SEQ ID NO: 6950 - protein, 8 aa, Neisseria
DIEHRQGN

SEQ ID NO: 6951 - protein, 8 aa, Neisseria
GKPEEGLN

SEQ ID NO: 6952 - protein, 7 aa, Neisseria
KCEKEAA

SEQ ID NO: 6953 - protein, 9 aa, Neisseria
ELVRRKPDL

SEQ ID NO: 6954 - protein, 9 aa, Neisseria
WKADADMMR

SEQ ID NO: 6955 - protein, 9 aa, Neisseria
VMYRCRNCH

SEQ ID NO: 6956 - protein, 5 aa, Neisseria
NKIEV

SEQ ID NO: 6957 - protein, 6 aa, Neisseria
FRKPAS

SEQ ID NO: 6958 - protein, 5 aa, Neisseria
FAEAV

SEQ ID NO: 6959 - protein, 9 aa, Neisseria
STVSGLFSA

SEQ ID NO: 6960 - protein, 6 aa, Neisseria
LSKSKS

SEQ ID NO: 6961 - protein, 5 aa, Neisseria
SSDSP

SEQ ID NO: 6962 - protein, 6 aa, Neisseria
FTSFFG

SEQ ID NO: 6963 - protein, 11 aa, Neisseria
VSTSAKVISMP

SEQ ID NO: 6964 - protein, 12 aa, Neisseria
SKVYEPPNRPSN

SEQ ID NO: 6965 - protein, 6 aa, Neisseria
AETCST

SEQ ID NO: 6966 - protein, 10 aa, Neisseria
AGFSAFASGA

SEQ ID NO: 6967 - protein, 9 aa, Neisseria
TFASGFSTG

SEQ ID NO: 6968 - protein, 5 aa, Neisseria
STVAC

SEQ ID NO: 6969 - protein, 11 aa, Neisseria
GSDGMDAVSAL

SEQ ID NO: 6970 - protein, 19 aa, Neisseria
VSGEEAFRKPASPEGEAGF

SEQ ID NO: 6971 - protein, 9 aa, Neisseria
GRLSEKSVS

SEQ ID NO: 6972 - protein, 7 aa, Neisseria
TDSGSGV

SEQ ID NO: 6973 - protein, 13 aa, Neisseria
SSSCVSAPDKMPF

SEQ ID NO: 6974 - protein, 12 aa, Neisseria
RLSKSKSMRLEG

SEQ ID NO: 6975 - protein, 15 aa, Neisseria
FADNSSSDSPSKASV

SEQ ID NO: 6976 - protein, 5 aa, Neisseria
GAGSG

SEQ ID NO: 6977 - protein, 36 aa, Neisseria
PSSAASSRSGSSSGTDSSVRRARLDWARRKSSSRAI

SEQ ID NO: 6978 - protein, 6 aa, Neisseria
APPPAS

SEQ ID NO: 6979 - protein, 12 aa, Neisseria
KVYEPPNRPSNS

SEQ ID NO: 6980 - protein, 15 aa, Neisseria
SVSSSAETCSTGSET

SEQ ID NO: 6981 - protein, 7 aa, Neisseria
GADSAAV

SEQ ID NO: 6982 - protein, 8 aa, Neisseria
GTGSGRTA

SEQ ID NO: 6983 - protein, 5 aa, Neisseria
FSTGF

SEQ ID NO: 6984 - protein, 8 aa, Neisseria
LDGSDGMD

SEQ ID NO: 6985 - protein, 19 aa, Neisseria
VSGEEAFRKPASPEGEAGF

SEQ ID NO: 6986 - protein, 9 aa, Neisseria
GRLSEKSVS

SEQ ID NO: 6987 - protein, 7 aa, Neisseria
SAPDKMP

SEQ ID NO: 6988 - protein, 12 aa, Neisseria
RLSKSKSMRLEG

SEQ ID NO: 6989 - protein, 10 aa, Neisseria
NSSSDSPSKA

SEQ ID NO: 6990 - protein, 33 aa, Neisseria
AASSRSGSSSGTDSSVRRARLDWARRKSSSRAI

SEQ ID NO: 6991 - protein, 11 aa, Neisseria
KVYEPPNRPSN

SEQ ID NO: 6992 - protein, 12 aa, Neisseria
SSAETCSTGSET

SEQ ID NO: 6993 - protein, 7 aa, Neisseria
DGSDGMD

SEQ ID NO: 6994 - protein, 7 aa, Neisseria
ASEPAAA

SEQ ID NO: 6995 - protein, 5 aa, Neisseria
SIGST

SEQ ID NO: 6996 - protein, 8 aa, Neisseria
GRSLKQMK

SEQ ID NO: 6997 - protein, 5 aa, Neisseria
TEAMQ

SEQ ID NO: 6998 - protein, 19 aa, Neisseria
QEVMMKFLQEQQAKAVEKH

SEQ ID NO: 6999 - protein, 8 aa, Neisseria
AKDGVKTT

SEQ ID NO: 7000 - protein, 11 aa, Neisseria
SQVIPGWTEGV

SEQ ID NO: 7001 - protein, 9 aa, Neisseria
ACGKKEAAP

SEQ ID NO: 7002 - protein, 7 aa, Neisseria
SASEPAA

SEQ ID NO: 7003 - protein, 11 aa, Neisseria
SSAQGDTSSIG

SEQ ID NO: 7004 - protein, 18 aa, Neisseria
DIGRSLKQMKEQGAEIDL

SEQ ID NO: 7005 - protein, 14 aa, Neisseria
YDGKEIKMTEEQAQ

SEQ ID NO: 7006 - protein, 43 aa, Neisseria
LQEQQAKAVEKHKADAKANKEKGEAFLKENAAKDGVKTTASGL

SEQ ID NO: 7007 - protein, 17 aa, Neisseria
KITKQGEGKQPTKDDIV

SEQ ID NO: 7008 - protein, 8 aa, Neisseria
EYEGRLID

SEQ ID NO: 7009 - protein, 10 aa, Neisseria
VFDSSKANGG

SEQ ID NO: 7010 - protein, 8 aa, Neisseria
QLLKEGGE

SEQ ID NO: 7011 - protein, 18 aa, Neisseria
SNLAYREQGAGDKIGPNA

SEQ ID NO: 7012 - protein, 12 aa, Neisseria
GAPENAPAKQPA

SEQ ID NO: 7013 - protein, 7 aa, Neisseria
VDIKKVN

SEQ ID NO: 7014 - protein, 8 aa, Neisseria
CGKKEAAP

SEQ ID NO: 7015 - protein, 7 aa, Neisseria
SASEPAA

SEQ ID NO: 7016 - protein, 7 aa, Neisseria
AQGDTSS

SEQ ID NO: 7017 - protein, 18 aa, Neisseria
DIGRSLKQMKEQGAEIDL

SEQ ID NO: 7018 - protein, 14 aa, Neisseria
YDGKEIKMTEEQAQ

SEQ ID NO: 7019 - protein, 37 aa, Neisseria
QQAKAVEKHKADAKANKEKGEAFLKENAAKDGVKTTA

SEQ ID NO: 7020 - protein, 16 aa, Neisseria
ITKQGEGKQPTKDDIV

SEQ ID NO: 7021 - protein, 8 aa, Neisseria
EYEGRLID

SEQ ID NO: 7022 - protein, 7 aa, Neisseria
DSSKANG

SEQ ID NO: 7023 - protein, 8 aa, Neisseria
QLLKEGGE

SEQ ID NO: 7024 - protein, 13 aa, Neisseria
AYREQGAGDKIGP

SEQ ID NO: 7025 - protein, 12 aa, Neisseria
GAPENAPAKQPA

SEQ ID NO: 7026 - protein, 7 aa, Neisseria
VDIKKVN

SEQ ID NO: 7027 - protein, 6 aa, Neisseria
GKIVGN

SEQ ID NO: 7028 - protein, 14 aa, Neisseria
AASYPKPCKSFKLA

SEQ ID NO: 7029 - protein, 6 aa, Neisseria
TVIKII

SEQ ID NO: 7030 - protein, 16 aa, Neisseria
AFVVGIIFGMFALFGR

SEQ ID NO: 7031 - protein, 8 aa, Neisseria
ELTAPPAQ

SEQ ID NO: 7032 - protein, 6 aa, Neisseria
MERNGV

SEQ ID NO: 7033 - protein, 10 aa, Neisseria
RILRMSSEHA

SEQ ID NO: 7034 - protein, 10 aa, Neisseria
SYPKPCKSFK

SEQ ID NO: 7035 - protein, 8 aa, Neisseria
LPGQKFDL

SEQ ID NO: 7036 - protein, 40 aa, Neisseria
LSLRGENGRLRAEVKKNARLTGKELTAPPAQNAPESTKQP

SEQ ID NO: 7037 - protein, 6 aa, Neisseria
MERNGV

SEQ ID NO: 7038 - protein, 10 aa, Neisseria
RILRMSSEHA

SEQ ID NO: 7039 - protein, 7 aa, Neisseria
KPCKSFK

SEQ ID NO: 7040 - protein, 26 aa, Neisseria
LSLRGENGRLRAEVKKNARLTGKELT

SEQ ID NO: 7041 - protein, 9 aa, Neisseria
NAPESTKQP

SEQ ID NO: 7042 - protein, 17 aa, Neisseria
FADFFKDFAPQFGGFQN

SEQ ID NO: 7043 - protein, 18 aa, Neisseria
DFFAAFLGGLEGNMGNTA

SEQ ID NO: 7044 - protein, 7 aa, Neisseria
NADAARF

SEQ ID NO: 7045 - protein, 5 aa, Neisseria
GKLDI

SEQ ID NO: 7046 - protein, 11 aa, Neisseria
FFKDFAPQFGG

SEQ ID NO: 7047 - protein, 9 aa, Neisseria
LEGNMGNTA

SEQ ID NO: 7048 - protein, 7 aa, Neisseria
DAARFAE

SEQ ID NO: 7049 - protein, 17 aa, Neisseria
QNIQTGNDFRLQRGGVG

SEQ ID NO: 7050 - protein, 5 aa, Neisseria
GKLDI

SEQ ID NO: 7051 - protein, 7 aa, Neisseria
DAARFAE

SEQ ID NO: 7052 - protein, 7 aa, Neisseria
NDFRLQR

SEQ ID NO: 7053 - protein, 17 aa, Neisseria
FDFLHLISVSGWEHLAE

SEQ ID NO: 7054 - protein, 5 aa, Neisseria
VAVMR

SEQ ID NO: 7055 - protein, 6 aa, Neisseria
ISFLCN

SEQ ID NO: 7056 - protein, 5 aa, Neisseria
LSNFA

SEQ ID NO: 7057 - protein, 21 aa, Neisseria
PFKVGDFIRVGGFEGYVREIK

SEQ ID NO: 7058 - protein, 7 aa, Neisseria
QVVENLR

SEQ ID NO: 7059 - protein, 7 aa, Neisseria
SLKDQLS

SEQ ID NO: 7060 - protein, 5 aa, Neisseria
RPFKV

SEQ ID NO: 7061 - protein, 15 aa, Neisseria
IRVGGFEGYVREIKM

SEQ ID NO: 7062 - protein, 12 aa, Neisseria
SLRTTDNEEVVL

SEQ ID NO: 7063 - protein, 7 aa, Neisseria
IVNRSTL

SEQ ID NO: 7064 - protein, 9 aa, Neisseria
LKVAKEAVL

SEQ ID NO: 7065 - protein, 8 aa, Neisseria
VQNEERQA

SEQ ID NO: 7066 - protein, 5 aa, Neisseria
GDNAI

SEQ ID NO: 7067 - protein, 8 aa, Neisseria
NEADRWTL

SEQ ID NO: 7068 - protein, 15 aa, Neisseria
CDLNEQVVENLRKVN

SEQ ID NO: 7069 - protein, 8 aa, Neisseria
PFPQRDIH

SEQ ID NO: 7070 - protein, 6 aa, Neisseria
SLKDQL

SEQ ID NO: 7071 - protein, 7 aa, Neisseria
YVREIKM

SEQ ID NO: 7072 - protein, 10 aa, Neisseria
LRTTDNEEVV

SEQ ID NO: 7073 - protein, 9 aa, Neisseria
LKVAKEAVL

SEQ ID NO: 7074 - protein, 8 aa, Neisseria
VQNEERQA

SEQ ID NO: 7075 - protein, 6 aa, Neisseria
NEADRW

SEQ ID NO: 7076 - protein, 14 aa, Neisseria
DLNEQVVENLRKVN

SEQ ID NO: 7077 - protein, 6 aa, Neisseria
PQRDIH

SEQ ID NO: 7078 - protein, 6 aa, Neisseria
PVSASK

SEQ ID NO: 7079 - protein, 11 aa, Neisseria
SLVKPLSQPLA

SEQ ID NO: 7080 - protein, 9 aa, Neisseria
MDSPKVGCG

SEQ ID NO: 7081 - protein, 7 aa, Neisseria
PFGPTMP

SEQ ID NO: 7082 - protein, 5 aa, Neisseria
VSASK

SEQ ID NO: 7083 - protein, 7 aa, Neisseria
ARPEAAH

SEQ ID NO: 7084 - protein, 20 aa, Neisseria
RPEALADSSVSPTHATSGEV

SEQ ID NO: 7085 - protein, 6 aa, Neisseria
MDSPKV

SEQ ID NO: 7086 - protein, 7 aa, Neisseria
ARPEAAH

SEQ ID NO: 7087 - protein, 6 aa, Neisseria
RPEALA

SEQ ID NO: 7088 - protein, 5 aa, Neisseria
TSGEV

SEQ ID NO: 7089 - protein, 6 aa, Neisseria
SHFISL

SEQ ID NO: 7090 - protein, 7 aa, Neisseria
RECFVGF

SEQ ID NO: 7091 - protein, 9 aa, Neisseria
ATAFGRINQ

SEQ ID NO: 7092 - protein, 22 aa, Neisseria
VHGFLTTFAGRIANPAHCQSQT

SEQ ID NO: 7093 - protein, 26 aa, Neisseria
GQTGIEQNTFCRRGFTRVNMGGNTDV

SEQ ID NO: 7094 - protein, 9 aa, Neisseria
VQADRGLTS

SEQ ID NO: 7095 - protein, 11 aa, Neisseria
SKLETEVRECF

SEQ ID NO: 7096 - protein, 14 aa, Neisseria
GRIANPAHCQSQTA

SEQ ID NO: 7097 - protein, 7 aa, Neisseria
VQADRGL

SEQ ID NO: 7098 - protein, 9 aa, Neisseria
SKLETEVRE

SEQ ID NO: 7099 - protein, 8 aa, Neisseria
TDNVTRLA

SEQ ID NO: 7100 - protein, 5 aa, Neisseria
VRSSL

SEQ ID NO: 7101 - protein, 11 aa, Neisseria
GETADIYTPLS

SEQ ID NO: 7102 - protein, 5 aa, Neisseria
GSPTR

SEQ ID NO: 7103 - protein, 6 aa, Neisseria
IAEDLF

SEQ ID NO: 7104 - protein, 10 aa, Neisseria
SRSWNRIYAM

SEQ ID NO: 7105 - protein, 15 aa, Neisseria
LTVIPRVWVRAFDQS

SEQ ID NO: 7106 - protein, 7 aa, Neisseria
IADYMGY

SEQ ID NO: 7107 - protein, 13 aa, Neisseria
LKGVVRGFHGYGE

SEQ ID NO: 7108 - protein, 6 aa, Neisseria
LTDNVT

SEQ ID NO: 7109 - protein, 5 aa, Neisseria
ACYDR

SEQ ID NO: 7110 - protein, 14 aa, Neisseria
LPSSAGQEGQESKA

SEQ ID NO: 7111 - protein, 12 aa, Neisseria
ETVRSSLDKGEA

SEQ ID NO: 7112 - protein, 19 aa, Neisseria
VVEKGGDALPADSAGETAD

SEQ ID NO: 7113 - protein, 9 aa, Neisseria
DLDKNDLRG

SEQ ID NO: 7114 - protein, 10 aa, Neisseria
LGVREHNPMY

SEQ ID NO: 7115 - protein, 31 aa, Neisseria
NNSPNYAPGSPTRGTTVQEKFGQQKRAETKL

SEQ ID NO: 7116 - protein, 14 aa, Neisseria
FKSKIAEDLFKTRA

SEQ ID NO: 7117 - protein, 27 aa, Neisseria
GYTQRSDWQIYNQGRKSAPFRNTDYKP

SEQ ID NO: 7118 - protein, 14 aa, Neisseria
PVKADLPFGGRLRM

SEQ ID NO: 7119 - protein, 14 aa, Neisseria
QSNGQSRPESRSWN

SEQ ID NO: 7120 - protein, 16 aa, Neisseria
AFDQSGDKNDNPDIAD

SEQ ID NO: 7121 - protein, 17 aa, Neisseria
GYGDVKLQYRLNDRQNV

SEQ ID NO: 7122 - protein, 8 aa, Neisseria
RYNPKTGY

SEQ ID NO: 7123 - protein, 9 aa, Neisseria
IKGKLKGVV

SEQ ID NO: 7124 - protein, 16 aa, Neisseria
HGYGESLIDYNHKQNG

SEQ ID NO: 7125 - protein, 6 aa, Neisseria
NDLDGI

SEQ ID NO: 7126 - protein, 10 aa, Neisseria
AGQEGQESKA

SEQ ID NO: 7127 - protein, 12 aa, Neisseria
ETVRSSLDKGEA

SEQ ID NO: 7128 - protein, 17 aa, Neisseria
EKGGDALPADSAGETAD

SEQ ID NO: 7129 - protein, 9 aa, Neisseria
DLDKNDLRG

SEQ ID NO: 7130 - protein, 7 aa, Neisseria
LGVREHN

SEQ ID NO: 7131 - protein, 22 aa, Neisseria
SPTRGTTVQEKFGQQKRAETKL

SEQ ID NO: 7132 - protein, 14 aa, Neisseria
FKSKIAEDLFKTRA

SEQ ID NO: 7133 - protein, 15 aa, Neisseria
QGRKSAPFRNTDYKP

SEQ ID NO: 7134 - protein, 5 aa, Neisseria
GRLRM

SEQ ID NO: 7135 - protein, 11 aa, Neisseria
NGQSRPESRSW

SEQ ID NO: 7136 - protein, 15 aa, Neisseria
FDQSGDKNDNPDIAD

SEQ ID NO: 7137 - protein, 5 aa, Neisseria
GDVKL

SEQ ID NO: 7138 - protein, 8 aa, Neisseria
YRLNDRQN

SEQ ID NO: 7139 - protein, 7 aa, Neisseria
GKLKGVV

SEQ ID NO: 7140 - protein, 5 aa, Neisseria
NHKQN

SEQ ID NO: 7141 - protein, 10 aa, Neisseria
HLAFCAFCGI

SEQ ID NO: 7142 - protein, 13 aa, Neisseria
RLHNRMYNAAAAR

SEQ ID NO: 7143 - protein, 5 aa, Neisseria
VTDAQ

SEQ ID NO: 7144 - protein, 8 aa, Neisseria
SKNGDKQI

SEQ ID NO: 7145 - protein, 6 aa, Neisseria
DTHPQP

SEQ ID NO: 7146 - protein, 8 aa, Neisseria
GYAGYCDQ

SEQ ID NO: 7147 - protein, 8 aa, Neisseria
DNGGNHTD

SEQ ID NO: 7148 - protein, 10 aa, Neisseria
GYGQCQNQGA

SEQ ID NO: 7149 - protein, 11 aa, Neisseria
TAGNRLHNRMY

SEQ ID NO: 7150 - protein, 74 aa, Neisseria
GIGRGNGSQQQFGKSETVTDAQRFSSKNGDKQISDTHPQPCFEQTARNHNCDGNQPNQRIGERTQRIAHRRARF

SEQ ID NO: 7151 - protein, 67 aa, Neisseria
GYAGTYCDQPDGNNRQRAQRHGLADNGGNHTDKHGQQRPSLRLDPVGYGQCQNQGAQYCGNGEGYRF

SEQ ID NO: 7152 - protein, 13 aa, Neisseria
DLRKKDRPEKSEK

SEQ ID NO: 7153 - protein, 5 aa, Neisseria
NRLHN

SEQ ID NO: 7154 - protein, 8 aa, Neisseria
GIGRGNGS

SEQ ID NO: 7155 - protein, 28 aa, Neisseria
QFGKSETVTDAQRFSSKNGDKQISDTHP

SEQ ID NO: 7156 - protein, 31 aa, Neisseria
QTARNHNCDGNQPNQRIGERTQRIAHRRARF

SEQ ID NO: 7157 - protein, 13 aa, Neisseria
DQPDGNNRQRAQR

SEQ ID NO: 7158 - protein, 24 aa, Neisseria
GLADNGGNHTDKHGQQRPSLRLDP

SEQ ID NO: 7159 - protein, 5 aa, Neisseria
EGYRF

SEQ ID NO: 7160 - protein, 13 aa, Neisseria
DLRKKDRPEKSEK

SEQ ID NO: 7161 - protein, 7 aa, Neisseria
EFSESAG

SEQ ID NO: 7162 - protein, 13 aa, Neisseria
AEFVKKFNKFIRK

SEQ ID NO: 7163 - protein, 12 aa, Neisseria
DFDELNRFIADI

SEQ ID NO: 7164 - protein, 7 aa, Neisseria
IDQVSKD

SEQ ID NO: 7165 - protein, 6 aa, Neisseria
LAGVLG

SEQ ID NO: 7166 - protein, 5 aa, Neisseria
GSHIA

SEQ ID NO: 7167 - protein, 8 aa, Neisseria
QAKMLRAM

SEQ ID NO: 7168 - protein, 7 aa, Neisseria
VAQDTMS

SEQ ID NO: 7169 - protein, 9 aa, Neisseria
AEGRDKNAV

SEQ ID NO: 7170 - protein, 60 aa, Neisseria
EFVKKFNKFIRKSKNGSFKTELVSRSAMPRYQYTNGRRIQTGWEERAEFKVEGRDFDELN

SEQ ID NO: 7171 - protein, 20 aa, Neisseria
HVSRERRNEVIDQVSKDAVL

SEQ ID NO: 7172 - protein, 9 aa, Neisseria
FKARAEKLA

SEQ ID NO: 7173 - protein, 5 aa, Neisseria
IAGGG

SEQ ID NO: 7174 - protein, 16 aa, Neisseria
NMEGADSAAPGVEEIS

SEQ ID NO: 7175 - protein, 9 aa, Neisseria
AEGRDKNAV

SEQ ID NO: 7176 - protein, 24 aa, Neisseria
EFVKKFNKFIRKSKNGSFKTELVS

SEQ ID NO: 7177 - protein, 26 aa, Neisseria
NGRRIQTGWEERAEFKVEGRDFDELN

SEQ ID NO: 7178 - protein, 20 aa, Neisseria
HVSRERRNEVIDQVSKDAVL

SEQ ID NO: 7179 - protein, 9 aa, Neisseria
FKARAEKLA

SEQ ID NO: 7180 - protein, 16 aa, Neisseria
NMEGADSAAPGVEEIS

SEQ ID NO: 7181 - protein, 12 aa, Neisseria
RIFATFCAVIVC

SEQ ID NO: 7182 - protein, 9 aa, Neisseria
TTLMGSIIS

SEQ ID NO: 7183 - protein, 9 aa, Neisseria
REILTEWKD

SEQ ID NO: 7184 - protein, 5 aa, Neisseria
NRYID

SEQ ID NO: 7185 - protein, 10 aa, Neisseria
KDWDKLQARR

SEQ ID NO: 7186 - protein, 6 aa, Neisseria
PLAPIW

SEQ ID NO: 7187 - protein, 20 aa, Neisseria
LAGNIAKPIRILGNGMDRVA

SEQ ID NO: 7188 - protein, 12 aa, Neisseria
FDKMVEKLEKLV

SEQ ID NO: 7189 - protein, 5 aa, Neisseria
EMRSP

SEQ ID NO: 7190 - protein, 8 aa, Neisseria
MQAIVGLI

SEQ ID NO: 7191 - protein, 6 aa, Neisseria
LKRLEG

SEQ ID NO: 7192 - protein, 14 aa, Neisseria
LYRAFDNVIRNAVN

SEQ ID NO: 7193 - protein, 12 aa, Neisseria
IIEQHCGKIIAE

SEQ ID NO: 7194 - protein, 10 aa, Neisseria
NQFNQRRTIE

SEQ ID NO: 7195 - protein, 22 aa, Neisseria
FRARGDAGAREILTEWKDSPVS

SEQ ID NO: 7196 - protein, 9 aa, Neisseria
QGDEKKDIL

SEQ ID NO: 7197 - protein, 8 aa, Neisseria
YTIERARL

SEQ ID NO: 7198 - protein, 7 aa, Neisseria
EYDRFGE

SEQ ID NO: 7199 - protein, 14 aa, Neisseria
KDWDKLQARRLPSP

SEQ ID NO: 7200 - protein, 17 aa, Neisseria
LGNGMDRVANGELETRI

SEQ ID NO: 7201 - protein, 11 aa, Neisseria
QQVDDRDDELS

SEQ ID NO: 7202 - protein, 16 aa, Neisseria
KMVEKLEKLVAKERHL

SEQ ID NO: 7203 - protein, 8 aa, Neisseria
HEMRSPLA

SEQ ID NO: 7204 - protein, 24 aa, Neisseria
AQPQKQEQYLKRLEGELTRMDTLA

SEQ ID NO: 7205 - protein, 16 aa, Neisseria
SRLETSNMALEKESLK

SEQ ID NO: 7206 - protein, 14 aa, Neisseria
LVEDNQSIAQKNGQ

SEQ ID NO: 7207 - protein, 10 aa, Neisseria
SADGKIPENT

SEQ ID NO: 7208 - protein, 7 aa, Neisseria
YSPEGST

SEQ ID NO: 7209 - protein, 8 aa, Neisseria
NIGQDHKH

SEQ ID NO: 7210 - protein, 13 aa, Neisseria
DVTDNGPGVDEMQ

SEQ ID NO: 7211 - protein, 13 aa, Neisseria
YRADSSANKPGTG

SEQ ID NO: 7212 - protein, 18 aa, Neisseria
EQHCGKIIAENIKPNGLR

SEQ ID NO: 7213 - protein, 16 aa, Neisseria
ILPKKKTGSKTEKSAN

SEQ ID NO: 7214 - protein, 9 aa, Neisseria
QFNQRRTIE

SEQ ID NO: 7215 - protein, 21 aa, Neisseria
FRARGDAGAREILTEWKDSPV

SEQ ID NO: 7216 - protein, 9 aa, Neisseria
QGDEKKDIL

SEQ ID NO: 7217 - protein, 7 aa, Neisseria
TIERARL

SEQ ID NO: 7218 - protein, 7 aa, Neisseria
EYDRFGE

SEQ ID NO: 7219 - protein, 12 aa, Neisseria
KDWDKLQARRLP

SEQ ID NO: 7220 - protein, 14 aa, Neisseria
GMDRVANGELETRI

SEQ ID NO: 7221 - protein, 11 aa, Neisseria
QQVDDRDDELS

SEQ ID NO: 7222 - protein, 16 aa, Neisseria
KMVEKLEKLVAKERHL

SEQ ID NO: 7223 - protein, 7 aa, Neisseria
HEMRSPL

SEQ ID NO: 7224 - protein, 23 aa, Neisseria
QPQKQEQYLKRLEGELTRMDTLA

SEQ ID NO: 7225 - protein, 5 aa, Neisseria
SRLET

SEQ ID NO: 7226 - protein, 8 aa, Neisseria
ALEKESLK

SEQ ID NO: 7227 - protein, 14 aa, Neisseria
LVEDNQSIAQKNGQ

SEQ ID NO: 7228 - protein, 7 aa, Neisseria
ADGKIPE

SEQ ID NO: 7229 - protein, 12 aa, Neisseria
VTDNGPGVDEMQ

SEQ ID NO: 7230 - protein, 11 aa, Neisseria
RADSSANKPGT

SEQ ID NO: 7231 - protein, 7 aa, Neisseria
IIAENIK

SEQ ID NO: 7232 - protein, 15 aa, Neisseria
LPKKKTGSKTEKSAN

SEQ ID NO: 7233 - protein, 9 aa, Neisseria
DNFKYFWKT

SEQ ID NO: 7234 - protein, 6 aa, Neisseria
ILAALG

SEQ ID NO: 7235 - protein, 12 aa, Neisseria
VLANIVEKAQSK

SEQ ID NO: 7236 - protein, 10 aa, Neisseria
LQQSYPHSIS

SEQ ID NO: 7237 - protein, 22 aa, Neisseria
SQEALKNYGQALEKMPQDSVGR

SEQ ID NO: 7238 - protein, 10 aa, Neisseria
HLEEQQELDN

SEQ ID NO: 7239 - protein, 12 aa, Neisseria
YQNRKVSQNQEA

SEQ ID NO: 7240 - protein, 23 aa, Neisseria
IVEKAQSKAPQSEINAELTKLQQ

SEQ ID NO: 7241 - protein, 13 aa, Neisseria
TEFDAQRYDVAEG

SEQ ID NO: 7242 - protein, 8 aa, Neisseria
LSNQKDSL

SEQ ID NO: 7243 - protein, 7 aa, Neisseria
QQKKYDA

SEQ ID NO: 7244 - protein, 7 aa, Neisseria
TPVEADF

SEQ ID NO: 7245 - protein, 7 aa, Neisseria
METKGDV

SEQ ID NO: 7246 - protein, 29 aa, Neisseria
AQGKSQEALKNYGQALEKMPQDSVGRELV

SEQ ID NO: 7247 - protein, 6 aa, Neisseria
KLDSLK

SEQ ID NO: 7248 - protein, 10 aa, Neisseria
HLEEQQELDN

SEQ ID NO: 7249 - protein, 11 aa, Neisseria
QNRKVSQNQEA

SEQ ID NO: 7250 - protein, 20 aa, Neisseria
IVEKAQSKAPQSEINAELTK

SEQ ID NO: 7251 - protein, 13 aa, Neisseria
TEFDAQRYDVAEG

SEQ ID NO: 7252 - protein, 6 aa, Neisseria
NQKDSL

SEQ ID NO: 7253 - protein, 7 aa, Neisseria
QQKKYDA

SEQ ID NO: 7254 - protein, 7 aa, Neisseria
TPVEADF

SEQ ID NO: 7255 - protein, 7 aa, Neisseria
METKGDV

SEQ ID NO: 7256 - protein, 9 aa, Neisseria
QGKSQEALK

SEQ ID NO: 7257 - protein, 15 aa, Neisseria
ALEKMPQDSVGRELV

SEQ ID NO: 7258 - protein, 6 aa, Neisseria
KLDSLK

SEQ ID NO: 7259 - protein, 12 aa, Neisseria
LPALPAILPLST

SEQ ID NO: 7260 - protein, 7 aa, Neisseria
NGSKTLS

SEQ ID NO: 7261 - protein, 13 aa, Neisseria
DIMTDKGKWKLET

SEQ ID NO: 7262 - protein, 10 aa, Neisseria
LNSENNRAEL

SEQ ID NO: 7263 - protein, 10 aa, Neisseria
EIQENGSNTD

SEQ ID NO: 7264 - protein, 10 aa, Neisseria
GNTDIYGSGS

SEQ ID NO: 7265 - protein, 19 aa, Neisseria
HEERKLDGNSKTRNKRMSD

SEQ ID NO: 7266 - protein, 9 aa, Neisseria
FLKDDKNPA

SEQ ID NO: 7267 - protein, 15 aa, Neisseria
TVYEKSRNKASSGKS

SEQ ID NO: 7268 - protein, 20 aa, Neisseria
YRINGSKTLSDGIRYKSGNY

SEQ ID NO: 7269 - protein, 10 aa, Neisseria
ANDRISLTGG

SEQ ID NO: 7270 - protein, 19 aa, Neisseria
GRQPDRTDGKRESSRNTST

SEQ ID NO: 7271 - protein, 11 aa, Neisseria
VSGQSSSELKF

SEQ ID NO: 7272 - protein, 11 aa, Neisseria
DIMTDKGKWKL

SEQ ID NO: 7273 - protein, 7 aa, Neisseria
ENNRAEL

SEQ ID NO: 7274 - protein, 9 aa, Neisseria
EIQENGSNT

SEQ ID NO: 7275 - protein, 19 aa, Neisseria
HEERKLDGNSKTRNKRMSD

SEQ ID NO: 7276 - protein, 8 aa, Neisseria
FLKDDKNP

SEQ ID NO: 7277 - protein, 13 aa, Neisseria
TVYEKSRNKASSG

SEQ ID NO: 7278 - protein, 11 aa, Neisseria
KTLSDGIRYKS

SEQ ID NO: 7279 - protein, 6 aa, Neisseria
ANDRIS

SEQ ID NO: 7280 - protein, 16 aa, Neisseria
RQPDRTDGKRESSRNT

SEQ ID NO: 7281 - protein, 7 aa, Neisseria
SSSELKF

SEQ ID NO: 7282 - protein, 10 aa, Neisseria
QDGRNYTGSF

SEQ ID NO: 7283 - protein, 5 aa, Neisseria
GTFKK

SEQ ID NO: 7284 - protein, 46 aa, Neisseria
SYQEPGCTYDGNVGKDGKPAGKGTWRCQDGRNYTGSFKNGKFDGQG

SEQ ID NO: 7285 - protein, 14 aa, Neisseria
IFIEPFNSDSTKFR

SEQ ID NO: 7286 - protein, 19 aa, Neisseria
TFKKGLAHGRFTVSQNGET

SEQ ID NO: 7287 - protein, 15 aa, Neisseria
CENGMIKEVKLPKNK

SEQ ID NO: 7288 - protein, 10 aa, Neisseria
NVGKDGKPAG

SEQ ID NO: 7289 - protein, 11 aa, Neisseria
GTWRCQDGRNY

SEQ ID NO: 7290 - protein, 8 aa, Neisseria
FKNGKFDG

SEQ ID NO: 7291 - protein, 9 aa, Neisseria
FNSDSTKFR

SEQ ID NO: 7292 - protein, 7 aa, Neisseria
TFKKGLA

SEQ ID NO: 7293 - protein, 15 aa, Neisseria
CENGMIKEVKLPKNK

SEQ ID NO: 7294 - protein, 8 aa, Neisseria
ASRIEKVL

SEQ ID NO: 7295 - protein, 11 aa, Neisseria
VADILAKIIEK

SEQ ID NO: 7296 - protein, 8 aa, Neisseria
SVVQLWLA

SEQ ID NO: 7297 - protein, 7 aa, Neisseria
MDVLVTI

SEQ ID NO: 7298 - protein, 11 aa, Neisseria
FVSLGKFLEHR

SEQ ID NO: 7299 - protein, 6 aa, Neisseria
VQRNGE

SEQ ID NO: 7300 - protein, 7 aa, Neisseria
QIGDLIR

SEQ ID NO: 7301 - protein, 15 aa, Neisseria
QTQLGDMMNALSEAQ

SEQ ID NO: 7302 - protein, 9 aa, Neisseria
APIARVADK

SEQ ID NO: 7303 - protein, 5 aa, Neisseria
MGKAV

SEQ ID NO: 7304 - protein, 6 aa, Neisseria
IVSAAQ

SEQ ID NO: 7305 - protein, 5 aa, Neisseria
IPAAQ

SEQ ID NO: 7306 - protein, 6 aa, Neisseria
GVGLVK

SEQ ID NO: 7307 - protein, 16 aa, Neisseria
LALPKFLDGVWDIASI

SEQ ID NO: 7308 - protein, 8 aa, Neisseria
FALADALK

SEQ ID NO: 7309 - protein, 9 aa, Neisseria
DTAEAIGRL

SEQ ID NO: 7310 - protein, 8 aa, Neisseria
EVQKLKAA

SEQ ID NO: 7311 - protein, 9 aa, Neisseria
VGDGINDAP

SEQ ID NO: 7312 - protein, 7 aa, Neisseria
ADVAEHT

SEQ ID NO: 7313 - protein, 9 aa, Neisseria
QHSVNQLAD

SEQ ID NO: 7314 - protein, 7 aa, Neisseria
AFFYNIL

SEQ ID NO: 7315 - protein, 9 aa, Neisseria
MQQKIRFQI

SEQ ID NO: 7316 - protein, 17 aa, Neisseria
CASRIEKVLNKKDFVES

SEQ ID NO: 7317 - protein, 16 aa, Neisseria
ASEEAQVVFDDSKTSV

SEQ ID NO: 7318 - protein, 25 aa, Neisseria
KIIEKTGYGAKEKTEDTLPQPEAEH

SEQ ID NO: 7319 - protein, 5 aa, Neisseria
GRHDW

SEQ ID NO: 7320 - protein, 5 aa, Neisseria
IKGGL

SEQ ID NO: 7321 - protein, 11 aa, Neisseria
LEHRTKKSSLN

SEQ ID NO: 7322 - protein, 16 aa, Neisseria
VNVQRNGEWKQLPIDQ

SEQ ID NO: 7323 - protein, 8 aa, Neisseria
NHGERIAA

SEQ ID NO: 7324 - protein, 28 aa, Neisseria
GIIESGSGWADESHLTGESNPEEKKAGG

SEQ ID NO: 7325 - protein, 5 aa, Neisseria
TEGSV

SEQ ID NO: 7326 - protein, 10 aa, Neisseria
SEAQGSKAPI

SEQ ID NO: 7327 - protein, 7 aa, Neisseria
RVADKAA

SEQ ID NO: 7328 - protein, 5 aa, Neisseria
IKGDW

SEQ ID NO: 7329 - protein, 6 aa, Neisseria
MGKAVK

SEQ ID NO: 7330 - protein, 9 aa, Neisseria
AAAMEEAAH

SEQ ID NO: 7331 - protein, 14 aa, Neisseria
VLDKTGTLTEGSPQ

SEQ ID NO: 7332 - protein, 10 aa, Neisseria
PDSGFDEDAL

SEQ ID NO: 7333 - protein, 5 aa, Neisseria
VEQNA

SEQ ID NO: 7334 - protein, 5 aa, Neisseria
AEVEG

SEQ ID NO: 7335 - protein, 8 aa, Neisseria
KAGKAEFA

SEQ ID NO: 7336 - protein, 8 aa, Neisseria
SVDNKPIG

SEQ ID NO: 7337 - protein, 19 aa, Neisseria
DALKADTAEAIGRLKKHNI

SEQ ID NO: 7338 - protein, 12 aa, Neisseria
SGDNQGTVEYVA

SEQ ID NO: 7339 - protein, 19 aa, Neisseria
GNMSPRDKAAEVQKLKAAG

SEQ ID NO: 7340 - protein, 8 aa, Neisseria
VGDGINDA

SEQ ID NO: 7341 - protein, 9 aa, Neisseria
MKGGADVAE

SEQ ID NO: 7342 - protein, 11 aa, Neisseria
NALRLKRVKID

SEQ ID NO: 7343 - protein, 9 aa, Neisseria
MQQKIRFQI

SEQ ID NO: 7344 - protein, 14 aa, Neisseria
SRIEKVLNKKDFVE

SEQ ID NO: 7345 - protein, 16 aa, Neisseria
ASEEAQVVFDDSKTSV

SEQ ID NO: 7346 - protein, 20 aa, Neisseria
TGYGAKEKTEDTLPQPEAEH

SEQ ID NO: 7347 - protein, 10 aa, Neisseria
LEHRTKKSSL

SEQ ID NO: 7348 - protein, 9 aa, Neisseria
NVQRNGEWK

SEQ ID NO: 7349 - protein, 8 aa, Neisseria
NHGERIAA

SEQ ID NO: 7350 - protein, 5 aa, Neisseria
GIIES

SEQ ID NO: 7351 - protein, 20 aa, Neisseria
WADESHLTGESNPEEKKAGG

SEQ ID NO: 7352 - protein, 10 aa, Neisseria
SEAQGSKAPI

SEQ ID NO: 7353 - protein, 7 aa, Neisseria
RVADKAA

SEQ ID NO: 7354 - protein, 9 aa, Neisseria
AAAMEEAAH

SEQ ID NO: 7355 - protein, 13 aa, Neisseria
VLDKTGTLTEGSP

SEQ ID NO: 7356 - protein, 8 aa, Neisseria
SGFDEDAL

SEQ ID NO: 7357 - protein, 5 aa, Neisseria
VEQNA

SEQ ID NO: 7358 - protein, 5 aa, Neisseria
AEVEG

SEQ ID NO: 7359 - protein, 8 aa, Neisseria
KAGKAEFA

SEQ ID NO: 7360 - protein, 5 aa, Neisseria
VDNKP

SEQ ID NO: 7361 - protein, 19 aa, Neisseria
DALKADTAEAIGRLKKHNI

SEQ ID NO: 7362 - protein, 5 aa, Neisseria
GDNQG

SEQ ID NO: 7363 - protein, 16 aa, Neisseria
SPRDKAAEVQKLKAAG

SEQ ID NO: 7364 - protein, 7 aa, Neisseria
GGADVAE

SEQ ID NO: 7365 - protein, 9 aa, Neisseria
LRLKRVKID

SEQ ID NO: 7366 - protein, 22 aa, Neisseria
YLPDNLKTVLEQPVTLVNHITH

SEQ ID NO: 7367 - protein, 6 aa, Neisseria
PFAGGF

SEQ ID NO: 7368 - protein, 8 aa, Neisseria
KVLERFFG

SEQ ID NO: 7369 - protein, 6 aa, Neisseria
QVPASL

SEQ ID NO: 7370 - protein, 11 aa, Neisseria
YQKGFKSYRNG

SEQ ID NO: 7371 - protein, 8 aa, Neisseria
TSDGINPL

SEQ ID NO: 7372 - protein, 7 aa, Neisseria
NELVNLV

SEQ ID NO: 7373 - protein, 5 aa, Neisseria
KRKFA

SEQ ID NO: 7374 - protein, 5 aa, Neisseria
KMLED

SEQ ID NO: 7375 - protein, 9 aa, Neisseria
DINETLRLM

SEQ ID NO: 7376 - protein, 5 aa, Neisseria
DSTVQ

SEQ ID NO: 7377 - protein, 5 aa, Neisseria
MKKPL

SEQ ID NO: 7378 - protein, 14 aa, Neisseria
KAEESLTQQQKILQ

SEQ ID NO: 7379 - protein, 9 aa, Neisseria
ESHQYERGW

SEQ ID NO: 7380 - protein, 9 aa, Neisseria
TVIRLKPEL

SEQ ID NO: 7381 - protein, 15 aa, Neisseria
NNARKYLPDNLKTVL

SEQ ID NO: 7382 - protein, 14 aa, Neisseria
TEFKYAPETEKVLE

SEQ ID NO: 7383 - protein, 7 aa, Neisseria
FFGKQVP

SEQ ID NO: 7384 - protein, 8 aa, Neisseria
NGSGKMEV

SEQ ID NO: 7385 - protein, 7 aa, Neisseria
DYEELSG

SEQ ID NO: 7386 - protein, 17 aa, Neisseria
TVYQKGFKSYRNGYDAP

SEQ ID NO: 7387 - protein, 11 aa, Neisseria
KLADKGDAAFE

SEQ ID NO: 7388 - protein, 12 aa, Neisseria
VHFDSETSDGIN

SEQ ID NO: 7389 - protein, 11 aa, Neisseria
FSLEWKEGVDY

SEQ ID NO: 7390 - protein, 14 aa, Neisseria
NPNGSIAPSKIEVG

SEQ ID NO: 7391 - protein, 10 aa, Neisseria
FSTKTGESGA

SEQ ID NO: 7392 - protein, 11 aa, Neisseria
INSEGQFRFDT

SEQ ID NO: 7393 - protein, 9 aa, Neisseria
VYGDEKYGP

SEQ ID NO: 7394 - protein, 6 aa, Neisseria
LKRKFA

SEQ ID NO: 7395 - protein, 14 aa, Neisseria
SAKKMTEEQIRNDL

SEQ ID NO: 7396 - protein, 16 aa, Neisseria
VKGEASGLFTNNPVLD

SEQ ID NO: 7397 - protein, 10 aa, Neisseria
LPSGKIDVGG

SEQ ID NO: 7398 - protein, 13 aa, Neisseria
IMFKDMKKEDLNQ

SEQ ID NO: 7399 - protein, 10 aa, Neisseria
LKKTEADIRM

SEQ ID NO: 7400 - protein, 19 aa, Neisseria
NAEDEAEGRASLDDINETL

SEQ ID NO: 7401 - protein, 6 aa, Neisseria
MAREKY

SEQ ID NO: 7402 - protein, 6 aa, Neisseria
NGDQID

SEQ ID NO: 7403 - protein, 32 aa, Neisseria
LKNNQLKLNGKTLQNEPEPDFDEGGMVSEPQQ

SEQ ID NO: 7404 - protein, 5 aa, Neisseria
MKKPL

SEQ ID NO: 7405 - protein, 8 aa, Neisseria
KAEESLTQ

SEQ ID NO: 7406 - protein, 9 aa, Neisseria
TVIRLKPEL

SEQ ID NO: 7407 - protein, 15 aa, Neisseria
NNARKYLPDNLKTVL

SEQ ID NO: 7408 - protein, 14 aa, Neisseria
TEFKYAPETEKVLE

SEQ ID NO: 7409 - protein, 5 aa, Neisseria
GKMEV

SEQ ID NO: 7410 - protein, 7 aa, Neisseria
DYEELSG

SEQ ID NO: 7411 - protein, 9 aa, Neisseria
GFKSYRNGY

SEQ ID NO: 7412 - protein, 11 aa, Neisseria
KLADKGDAAFE

SEQ ID NO: 7413 - protein, 10 aa, Neisseria
VHFDSETSDG

SEQ ID NO: 7414 - protein, 11 aa, Neisseria
FSLEWKEGVDY

SEQ ID NO: 7415 - protein, 6 aa, Neisseria
SKIEVG

SEQ ID NO: 7416 - protein, 7 aa, Neisseria
GDEKYGP

SEQ ID NO: 7417 - protein, 6 aa, Neisseria
LKRKFA

SEQ ID NO: 7418 - protein, 14 aa, Neisseria
SAKKMTEEQIRNDL

SEQ ID NO: 7419 - protein, 5 aa, Neisseria
VKGEA

SEQ ID NO: 7420 - protein, 7 aa, Neisseria
GKIDVGG

SEQ ID NO: 7421 - protein, 12 aa, Neisseria
IMFKDMKKEDLN

SEQ ID NO: 7422 - protein, 10 aa, Neisseria
LKKTEADIRM

SEQ ID NO: 7423 - protein, 19 aa, Neisseria
NAEDEAEGRASLDDINETL

SEQ ID NO: 7424 - protein, 6 aa, Neisseria
MAREKY

SEQ ID NO: 7425 - protein, 9 aa, Neisseria
KNNQLKLNG

SEQ ID NO: 7426 - protein, 21 aa, Neisseria
TLQNEPEPDFDEGGMVSEPQQ

SEQ ID NO: 7427 - protein, 5 aa, Neisseria
AFIFA

SEQ ID NO: 7428 - protein, 10 aa, Neisseria
LHEFGHYIVA

SEQ ID NO: 7429 - protein, 9 aa, Neisseria
LGGYVKMVD

SEQ ID NO: 7430 - protein, 15 aa, Neisseria
GDKIQSVNGTPVADW

SEQ ID NO: 7431 - protein, 22 aa, Neisseria
SGAQTVRTIDAAGTPEAGKIAK

SEQ ID NO: 7432 - protein, 6 aa, Neisseria
AGGVEK

SEQ ID NO: 7433 - protein, 5 aa, Neisseria
PGDRL

SEQ ID NO: 7434 - protein, 13 aa, Neisseria
PIASWQEWANLTR

SEQ ID NO: 7435 - protein, 5 aa, Neisseria
RAGQT

SEQ ID NO: 7436 - protein, 7 aa, Neisseria
AWDAQIR

SEQ ID NO: 7437 - protein, 10 aa, Neisseria
YRPSVVRAFG

SEQ ID NO: 7438 - protein, 8 aa, Neisseria
GWEKTVSH

SEQ ID NO: 7439 - protein, 9 aa, Neisseria
TLKFFGKLI

SEQ ID NO: 7440 - protein, 9 aa, Neisseria
HISGPLTIA

SEQ ID NO: 7441 - protein, 7 aa, Neisseria
YLEFLAL

SEQ ID NO: 7442 - protein, 10 aa, Neisseria
FFTRKRGDTE

SEQ ID NO: 7443 - protein, 13 aa, Neisseria
VDTREGEVSEADL

SEQ ID NO: 7444 - protein, 9 aa, Neisseria
FDKQHPAKR

SEQ ID NO: 7445 - protein, 7 aa, Neisseria
VEPDTIA

SEQ ID NO: 7446 - protein, 10 aa, Neisseria
GFQSGDKIQS

SEQ ID NO: 7447 - protein, 5 aa, Neisseria
WGSAQ

SEQ ID NO: 7448 - protein, 18 aa, Neisseria
RTIDAAGTPEAGKIKNQG

SEQ ID NO: 7449 - protein, 28 aa, Neisseria
GGVEKGSPAEKAGLKPGDRLTAADGKPI

SEQ ID NO: 7450 - protein, 11 aa, Neisseria
NLTRQSPGKKI

SEQ ID NO: 7451 - protein, 9 aa, Neisseria
NYERAGQTH

SEQ ID NO: 7452 - protein, 13 aa, Neisseria
ADIRPDTVEQSDH

SEQ ID NO: 7453 - protein, 11 aa, Neisseria
VGLRPQPDRAW

SEQ ID NO: 7454 - protein, 11 aa, Neisseria
AQIRRSYRPSV

SEQ ID NO: 7455 - protein, 6 aa, Neisseria
KTVSHS

SEQ ID NO: 7456 - protein, 5 aa, Neisseria
ISGNA

SEQ ID NO: 7457 - protein, 5 aa, Neisseria
AGQSA

SEQ ID NO: 7458 - protein, 11 aa, Neisseria
IRGKPLGERVQ

SEQ ID NO: 7459 - protein, 9 aa, Neisseria
FFTRKRGDT

SEQ ID NO: 7460 - protein, 13 aa, Neisseria
VDTREGEVSEADL

SEQ ID NO: 7461 - protein, 9 aa, Neisseria
FDKQHPAKR

SEQ ID NO: 7462 - protein, 7 aa, Neisseria
VEPDTIA

SEQ ID NO: 7463 - protein, 10 aa, Neisseria
GFQSGDKIQS

SEQ ID NO: 7464 - protein, 10 aa, Neisseria
GTPEAGKIAK

SEQ ID NO: 7465 - protein, 26 aa, Neisseria
GVEKGSPAEKAGLKPGDRLTAADGKP

SEQ ID NO: 7466 - protein, 9 aa, Neisseria
TRQSPGKKI

SEQ ID NO: 7467 - protein, 6 aa, Neisseria
YERAGQ

SEQ ID NO: 7468 - protein, 12 aa, Neisseria
ADIRPDTVEQSD

SEQ ID NO: 7469 - protein, 7 aa, Neisseria
PQPDRAW

SEQ ID NO: 7470 - protein, 7 aa, Neisseria
QIRRSYR

SEQ ID NO: 7471 - protein, 5 aa, Neisseria
AGQSA

SEQ ID NO: 7472 - protein, 8 aa, Neisseria
KPLGERVQ

SEQ ID NO: 7473 - protein, 6 aa, Neisseria
FGQIFS

SEQ ID NO: 7474 - protein, 8 aa, Neisseria
GGLLGGLI

SEQ ID NO: 7475 - protein, 8 aa, Neisseria
APNAAAAA

SEQ ID NO: 7476 - protein, 12 aa, Neisseria
QGMIQMLGVFVD

SEQ ID NO: 7477 - protein, 5 aa, Neisseria
PYGDL

SEQ ID NO: 7478 - protein, 7 aa, Neisseria
VSQVGQW

SEQ ID NO: 7479 - protein, 6 aa, Neisseria
TAVFRM

SEQ ID NO: 7480 - protein, 6 aa, Neisseria
YFGAVA

SEQ ID NO: 7481 - protein, 14 aa, Neisseria
IMAWINLVAILLLS

SEQ ID NO: 7482 - protein, 19 aa, Neisseria
GIKRGLYSNEAGMGSAPNA

SEQ ID NO: 7483 - protein, 7 aa, Neisseria
AEVKHPV

SEQ ID NO: 7484 - protein, 8 aa, Neisseria
QPYGDLSG

SEQ ID NO: 7485 - protein, 7 aa, Neisseria
AYAESNV

SEQ ID NO: 7486 - protein, 32 aa, Neisseria; identical to SEQ ID NO: 5466

SEQ ID NO: 7487 - protein, 7 aa, Neisseria
GIKRGLY

SEQ ID NO: 7488 - protein, 5 aa, Neisseria
AEVKH

SEQ ID NO: 7489 - protein, 13 aa, Neisseria
LKMGKDPEFKLSE

SEQ ID NO: 7490 - protein, 9 aa, Neisseria
PGLKRRIKS

SEQ ID NO: 7491 - protein, 10 aa, Neisseria
GLCKRFGNKT

SEQ ID NO: 7492 - protein, 10 aa, Neisseria
STLLNIIAGI

SEQ ID NO: 7493 - protein, 6 aa, Neisseria
HMSALE

SEQ ID NO: 7494 - protein, 12 aa, Neisseria
AHRKPEKLSGGE

SEQ ID NO: 7495 - protein, 5 aa, Neisseria
FSSLD

SEQ ID NO: 7496 - protein, 7 aa, Neisseria
HLRGTLR

SEQ ID NO: 7497 - protein, 19 aa, Neisseria
PETLVKTPSCVQVARLMGL

SEQ ID NO: 7498 - protein, 12 aa, Neisseria
GLCKRFGNKTVA

SEQ ID NO: 7499 - protein, 6 aa, Neisseria
VGRGKI

SEQ ID NO: 7500 - protein, 10 aa, Neisseria
LGRSGCGKST

SEQ ID NO: 7501 - protein, 8 aa, Neisseria
IVRPDGGE

SEQ ID NO: 7502 - protein, 15 aa, Neisseria
NGENITRMPPEKRRI

SEQ ID NO: 7503 - protein, 14 aa, Neisseria
KMQKMPKAEAERLA

SEQ ID NO: 7504 - protein, 24 aa, Neisseria
VGLENEAHRKPEKLSGGEKQRLAL

SEQ ID NO: 7505 - protein, 6 aa, Neisseria
ESFSSL

SEQ ID NO: 7506 - protein, 16 aa, Neisseria
GTLRRMTAERIRNGGI

SEQ ID NO: 7507 - protein, 15 aa, Neisseria
HSPEEACTTADEIAV

SEQ ID NO: 7508 - protein, 5 aa, Neisseria
HKGRI

SEQ ID NO: 7509 - protein, 11 aa, Neisseria
GTPETLVKTPS

SEQ ID NO: 7510 - protein, 11 aa, Neisseria
GLPNTDDNRHI

SEQ ID NO: 7511 - protein, 14 aa, Neisseria
VRFDQDGMECRVLS

SEQ ID NO: 7512 - protein, 6 aa, Neisseria
TCLPES

SEQ ID NO: 7513 - protein, 9 aa, Neisseria
GAVSGKDTV

SEQ ID NO: 7514 - protein, 11 aa, Neisseria
HIEEREIVRFR

SEQ ID NO: 7515 - protein, 8 aa, Neisseria
GLCKRFGN

SEQ ID NO: 7516 - protein, 5 aa, Neisseria
GRGKI

SEQ ID NO: 7517 - protein, 5 aa, Neisseria
SGCGK

SEQ ID NO: 7518 - protein, 6 aa, Neisseria
VRPDGG

SEQ ID NO: 7519 - protein, 8 aa, Neisseria
MPPEKRRI

SEQ ID NO: 7520 - protein, 14 aa, Neisseria
KMQKMPKAEAERLA

SEQ ID NO: 7521 - protein, 24 aa, Neisseria
VGLENEAHRKPEKLSGGEKQRLAL

SEQ ID NO: 7522 - protein, 13 aa, Neisseria
GTLRRMTAERIRN

SEQ ID NO: 7523 - protein, 14 aa, Neisseria
SPEEACTTADEIAV

SEQ ID NO: 7524 - protein, 5 aa, Neisseria
HKGRI

SEQ ID NO: 7525 - protein, 8 aa, Neisseria
NTDDNRHI

SEQ ID NO: 7526 - protein, 14 aa, Neisseria
VRFDQDGMECRVLS

SEQ ID NO: 7527 - protein, 7 aa, Neisseria
VSGKDTV

SEQ ID NO: 7528 - protein, 11 aa, Neisseria
HIEEREIVRFR

SEQ ID NO: 7529 - protein, 5 aa, Neisseria
SILRL

SEQ ID NO: 7530 - protein, 11 aa, Neisseria
AGRECQETAAA

SEQ ID NO: 7531 - protein, 6 aa, Neisseria
AIKRCN

SEQ ID NO: 7532 - protein, 16 aa, Neisseria
MGADTDGDKDVRLNRT

SEQ ID NO: 7533 - protein, 7 aa, Neisseria
VEHPNRF

SEQ ID NO: 7534 - protein, 8 aa, Neisseria
HLDGSTGG

SEQ ID NO: 7535 - protein, 16 aa, Neisseria
FRREKTGHKRRCHTQC

SEQ ID NO: 7536 - protein, 13 aa, Neisseria
HSARAAGRECQET

SEQ ID NO: 7537 - protein, 7 aa, Neisseria
RAIKRCN

SEQ ID NO: 7538 - protein, 15 aa, Neisseria
MGADTDGDKDVRLNR

SEQ ID NO: 7539 - protein, 13 aa, Neisseria
FRREKTGHKRRCH

SEQ ID NO: 7540 - protein, 11 aa, Neisseria
ARAAGRECQET

SEQ ID NO: 7541 - protein, 7 aa, Neisseria
RAIKRCN

SEQ ID NO: 7542 - protein, 6 aa, Neisseria
CQPPEA

SEQ ID NO: 7543 - protein, 11 aa, Neisseria
ADLEKLSQPLA

SEQ ID NO: 7544 - protein, 8 aa, Neisseria
QGEVKELV

SEQ ID NO: 7545 - protein, 14 aa, Neisseria
TFTEAVKAGDIEKA

SEQ ID NO: 7546 - protein, 13 aa, Neisseria
IEPIAELFSELDP

SEQ ID NO: 7547 - protein, 8 aa, Neisseria
AGFTGFHR

SEQ ID NO: 7548 - protein, 22 aa, Neisseria
SGVKEIAAKLMTDVEALQKEID

SEQ ID NO: 7549 - protein, 13 aa, Neisseria
VGGASELIEEVAG

SEQ ID NO: 7550 - protein, 13 aa, Neisseria
DGSKKIVDLFRPL

SEQ ID NO: 7551 - protein, 10 aa, Neisseria
FKQVNEILAK

SEQ ID NO: 7552 - protein, 11 aa, Neisseria
DGFETYDKLGE

SEQ ID NO: 7553 - protein, 22 aa, Neisseria
ALQASINALAEDLAQLRGILGL

SEQ ID NO: 7554 - protein, 5 aa, Neisseria
MRKFN

SEQ ID NO: 7555 - protein, 10 aa, Neisseria
QPPEAEKAAP

SEQ ID NO: 7556 - protein, 13 aa, Neisseria
ASGEAQTANEGGS

SEQ ID NO: 7557 - protein, 9 aa, Neisseria
NDNACEPME

SEQ ID NO: 7558 - protein, 13 aa, Neisseria
IKNNSGRKLEWEI

SEQ ID NO: 7559 - protein, 10 aa, Neisseria
MVVDERENIA

SEQ ID NO: 7560 - protein, 7 aa, Neisseria
GLSDKMT

SEQ ID NO: 7561 - protein, 7 aa, Neisseria
LPGEYEM

SEQ ID NO: 7562 - protein, 27 aa, Neisseria
TNPRGKLVVTDSGFKDTANEADLEKLS

SEQ ID NO: 7563 - protein, 30 aa, Neisseria
GEVKELVAKTKTFTEAVKAGDIEKAKSLFA

SEQ ID NO: 7564 - protein, 11 aa, Neisseria
TRVHYERIEPI

SEQ ID NO: 7565 - protein, 22 aa, Neisseria
SELDPVIDAREDDFKDGAKDAG

SEQ ID NO: 7566 - protein, 13 aa, Neisseria
VEKDVSGVKEIAA

SEQ ID NO: 7567 - protein, 13 aa, Neisseria
LMTDVEALQKEID

SEQ ID NO: 7568 - protein, 9 aa, Neisseria
PPGKVVGGA

SEQ ID NO: 7569 - protein, 38 aa, Neisseria
ELIEEVAGSKISGEEDRYSHTDLSDFQANVDGSKKIVD

SEQ ID NO: 7570 - protein, 20 aa, Neisseria
IEAKNKALLEKTDTNFKQVN

SEQ ID NO: 7571 - protein, 23 aa, Neisseria
AKYRTKDGFETYDKLGEADRKAL

SEQ ID NO: 7572 - protein, 7 aa, Neisseria
LAEDLAQ

SEQ ID NO: 7573 - protein, 5 aa, Neisseria
MRKFN

SEQ ID NO: 7574 - protein, 10 aa, Neisseria
QPPEAEKAAP

SEQ ID NO: 7575 - protein, 13 aa, Neisseria
ASGEAQTANEGGS

SEQ ID NO: 7576 - protein, 7 aa, Neisseria
NACEPME

SEQ ID NO: 7577 - protein, 11 aa, Neisseria
NNSGRKLEWEI

SEQ ID NO: 7578 - protein, 9 aa, Neisseria
MVVDERENI

SEQ ID NO: 7579 - protein, 6 aa, Neisseria
LSDKMT

SEQ ID NO: 7580 - protein, 5 aa, Neisseria
GEYEM

SEQ ID NO: 7581 - protein, 7 aa, Neisseria
PRGKLVV

SEQ ID NO: 7582 - protein, 16 aa, Neisseria
SGFKDTANEADLEKLS

SEQ ID NO: 7583 - protein, 30 aa, Neisseria; identical to SEQ ID NO: 7563

SEQ ID NO: 7584 - protein, 11 aa, Neisseria
TRVHYERIEPI

SEQ ID NO: 7585 - protein, 22 aa, Neisseria
SELDPVIDAREDDFKDGAKDAG

SEQ ID NO: 7586 - protein, 13 aa, Neisseria
VEKDVSGVKEIAA

SEQ ID NO: 7587 - protein, 13 aa, Neisseria
LMTDVEALQKEID

SEQ ID NO: 7588 - protein, 8 aa, Neisseria
ELIEEVAG

SEQ ID NO: 7589 - protein, 11 aa, Neisseria
KISGEEDRYSH

SEQ ID NO: 7590 - protein, 9 aa, Neisseria
VDGSKKIVD

SEQ ID NO: 7591 - protein, 16 aa, Neisseria
IEAKNKALLEKTDTNF

SEQ ID NO: 7592 - protein, 21 aa, Neisseria
YRTKDGFETYDKLGEADRKAL

SEQ ID NO: 7593 - protein, 7 aa, Neisseria
LAEDLAQ

SEQ ID NO: 7594 - protein, 8 aa, Neisseria
MLRVSKVV

SEQ ID NO: 7595 - protein, 9 aa, Neisseria
LRIMAGVDK

SEQ ID NO: 7596 - protein, 26 aa, Neisseria
VREEVESGLGEVAAAQKRLEEVYAEY

SEQ ID NO: 7597 - protein, 6 aa, Neisseria
PTNHLD

SEQ ID NO: 7598 - protein, 12 aa, Neisseria
EWLEQFLVRFPG

SEQ ID NO: 7599 - protein, 9 aa, Neisseria
ARFEEMSNY

SEQ ID NO: 7600 - protein, 15 aa, Neisseria
LGNEVIEFVNVSKSF

SEQ ID NO: 7601 - protein, 6 aa, Neisseria
STLFKM

SEQ ID NO: 7602 - protein, 5 aa, Neisseria
DNIAE

SEQ ID NO: 7603 - protein, 13 aa, Neisseria
DQSKIAGQLSGGE

SEQ ID NO: 7604 - protein, 12 aa, Neisseria
LRALEDALLEFA

SEQ ID NO: 7605 - protein, 12 aa, Neisseria
VPPQKTIIKDIS

SEQ ID NO: 7606 - protein, 9 aa, Neisseria
LNGAGKSTV

SEQ ID NO: 7607 - protein, 11 aa, Neisseria
AGVDKEFEGEA

SEQ ID NO: 7608 - protein, 21 aa, Neisseria
LPQEPELDPEKTVREEVESGL

SEQ ID NO: 7609 - protein, 11 aa, Neisseria
AAAQKRLEEVY

SEQ ID NO: 7610 - protein, 19 aa, Neisseria
YANPDADFDALAEEQGRLE

SEQ ID NO: 7611 - protein, 20 aa, Neisseria
GSSTGGGAEHELEIAADALR

SEQ ID NO: 7612 - protein, 19 aa, Neisseria
PEWDAKIDNLSGGEKRRVA

SEQ ID NO: 7613 - protein, 6 aa, Neisseria
LSKPDM

SEQ ID NO: 7614 - protein, 11 aa, Neisseria
DEPTNHLDAES

SEQ ID NO: 7615 - protein, 6 aa, Neisseria
THDRYF

SEQ ID NO: 7616 - protein, 9 aa, Neisseria
LELDRGHGI

SEQ ID NO: 7617 - protein, 7 aa, Neisseria
WKGNYSS

SEQ ID NO: 7618 - protein, 28 aa, Neisseria
LEQKEKRLENEAKSEAARVKAMKQELEW

SEQ ID NO: 7619 - protein, 34 aa, Neisseria
RQNAKGRQAKSKARLARFEEMSNYEYQKRNETQE

SEQ ID NO: 7620 - protein, 8 aa, Neisseria
AERLGNEV

SEQ ID NO: 7621 - protein, 6 aa, Neisseria
SKSFGD

SEQ ID NO: 7622 - protein, 9 aa, Neisseria
PNGAGKSTL

SEQ ID NO: 7623 - protein, 14 aa, Neisseria
ISGKEQPDSGEVKI

SEQ ID NO: 7624 - protein, 13 aa, Neisseria
DQSREGLQNDKTV

SEQ ID NO: 7625 - protein, 8 aa, Neisseria
IAEGRDIL

SEQ ID NO: 7626 - protein, 21 aa, Neisseria
IPARQYLGRFNFKGSDQSKIA

SEQ ID NO: 7627 - protein, 12 aa, Neisseria
QLSGGERGRLHL

SEQ ID NO: 7628 - protein, 12 aa, Neisseria
LDEPSNDLDVET

SEQ ID NO: 7629 - protein, 6 aa, Neisseria
SHDRWF

SEQ ID NO: 7630 - protein, 8 aa, Neisseria
ACEGDSKW

SEQ ID NO: 7631 - protein, 32 aa, Neisseria
DGNYQEYEADKKRRLGEEGAKPKRIKYKPVTR

SEQ ID NO: 7632 - protein, 11 aa, Neisseria
AGVDKEFEGEA

SEQ ID NO: 7633 - protein, 19 aa, Neisseria
QEPELDPEKTVREEVESGL

SEQ ID NO: 7634 - protein, 11 aa, Neisseria
AAAQKRLEEVY

SEQ ID NO: 7635 - protein, 18 aa, Neisseria
ANPDADFDALAEEQGRLE

SEQ ID NO: 7636 - protein, 15 aa, Neisseria
GGAEHELEIAADALR

SEQ ID NO: 7637 - protein, 9 aa, Neisseria
PEWDAKIDN

SEQ ID NO: 7638 - protein, 9 aa, Neisseria
SGGEKRRVA

SEQ ID NO: 7639 - protein, 5 aa, Neisseria
LSKPD

SEQ ID NO: 7640 - protein, 5 aa, Neisseria
DEPTN

SEQ ID NO: 7641 - protein, 5 aa, Neisseria
LDAES

SEQ ID NO: 7642 - protein, 7 aa, Neisseria
LELDRGH

SEQ ID NO: 7643 - protein, 28 aa, Neisseria
LEQKEKRLENEAKSEAARVKAMKQELEW

SEQ ID NO: 7644 - protein, 23 aa, Neisseria
RQNAKGRQAKSKARLARFEEMSN

SEQ ID NO: 7645 - protein, 9 aa, Neisseria
EYQKRNETQ

SEQ ID NO: 7646 - protein, 8 aa, Neisseria
AERLGNEV

SEQ ID NO: 7647 - protein, 14 aa, Neisseria
ISGKEQPDSGEVKI

SEQ ID NO: 7648 - protein, 13 aa, Neisseria
DQSREGLQNDKTV

SEQ ID NO: 7649 - protein, 8 aa, Neisseria
IAEGRDIL

SEQ ID NO: 7650 - protein, 10 aa, Neisseria
NFKGSDQSKI

SEQ ID NO: 7651 - protein, 10 aa, Neisseria
SGGERGRLHL

SEQ ID NO: 7652 - protein, 11 aa, Neisseria
DEPSNDLDVET

SEQ ID NO: 7653 - protein, 5 aa, Neisseria
CEGDS

SEQ ID NO: 7654 - protein, 25 aa, Neisseria
NYQEYEADKKRRLGEEGAKPKRIKY

SEQ ID NO: 7655 - protein, 5 aa, Neisseria
AEVKK

SEQ ID NO: 7656 - protein, 15 aa, Neisseria
KEAAKEGKESKKTAK

SEQ ID NO: 7657 - protein, 9 aa, Neisseria
QSARKGREG

SEQ ID NO: 7658 - protein, 5 aa, Neisseria
AHGKP

SEQ ID NO: 7659 - protein, 9 aa, Neisseria
QGNPRKGGK

SEQ ID NO: 7660 - protein, 19 aa, Neisseria
SDKNGKAVKQDKKYREEKN

SEQ ID NO: 7661 - protein, 10 aa, Neisseria
VSNSLKQLQE

SEQ ID NO: 7662 - protein, 7 aa, Neisseria
WDKFQKL

SEQ ID NO: 7663 - protein, 8 aa, Neisseria
QISRFVSG

SEQ ID NO: 7664 - protein, 9 aa, Neisseria
LRYTRYVNA

SEQ ID NO: 7665 - protein, 12 aa, Neisseria
NREVVKDLEKQQ

SEQ ID NO: 7666 - protein, 10 aa, Neisseria
INNELARLKK

SEQ ID NO: 7667 - protein, 6 aa, Neisseria
ANVQSL

SEQ ID NO: 7668 - protein, 7 aa, Neisseria
DAAEQTE

SEQ ID NO: 7669 - protein, 8 aa, Neisseria
AKIAKDAR

SEQ ID NO: 7670 - protein, 5 aa, Neisseria
NKLLS

SEQ ID NO: 7671 - protein, 29 aa, Neisseria
PSVMGIGSADGFSRMQGRLKKPVDGVPTG

SEQ ID NO: 7672 - protein, 8 aa, Neisseria
PATVESIA

SEQ ID NO: 7673 - protein, 11 aa, Neisseria
SYADELDGYGK

SEQ ID NO: 7674 - protein, 6 aa, Neisseria
SIYAGL

SEQ ID NO: 7675 - protein, 169 aa, Neisseria
DAAHNRSAEVKKQTKNKKEQPEAAEGKKEKGKNGAVKDKKTGGKEAAKEGKESKKTAKNRKEAEKEATSRQSARKGREGDKKSKAEHKKAHGKPVSGSKEKNAKTQPENKQGKKEAKGQGNPRKGGKAEKDTVSANKKVRSDKNGKAVKQDKKYREEKNAKTDSDELKA

SEQ ID NO: 7676 - protein, 17 aa, Neisseria
ATNDVENKKALLKQSEG

SEQ ID NO: 7677 - protein, 23 aa, Neisseria
NSLKQLQEERIRQERIRQARGNL

SEQ ID NO: 7678 - protein, 29 aa, Neisseria
SVNRKQREAWDKFQKLNTELNRLKTEVAA

SEQ ID NO: 7679 - protein, 10 aa, Neisseria
SGNYKNSQPN

SEQ ID NO: 7680 - protein, 10 aa, Neisseria
NAEPGQKNRF

SEQ ID NO: 7681 - protein, 17 aa, Neisseria
VNASNREVVKDLEKQQK

SEQ ID NO: 7682 - protein, 16 aa, Neisseria
QEQKINNELARLKKIQ

SEQ ID NO: 7683 - protein, 40 aa, Neisseria
LLKKQGVTDAAEQTESRRQNAKIAKDARKLLEQKGNEQQL

SEQ ID NO: 7684 - protein, 64 aa, Neisseria
LLSNLEKKKAEHRIQDAEAKRKLAEARLAAAEKARKEAAQQKAEARRAEMSNLTAEDRNIQAPS

SEQ ID NO: 7685 - protein, 22 aa, Neisseria
GSADGFSRMQGRLKKPVDGVPT

SEQ ID NO: 7686 - protein, 9 aa, Neisseria
GQNRSGGDI

SEQ ID NO: 7687 - protein, 10 aa, Neisseria
SYADELDGYG

SEQ ID NO: 7688 - protein, 6 aa, Neisseria
DHGENY

SEQ ID NO: 7689 - protein, 18 aa, Neisseria
AGSKIGSSGSLPDGEEGL

SEQ ID NO: 7690 - protein, 7 aa, Neisseria
VLNPSSW

SEQ ID NO: 7691 - protein, 169 aa, Neisseria; identical to SEQ ID NO: 7675

SEQ ID NO: 7692 - protein, 14 aa, Neisseria
NDVENKKALLKQSE

SEQ ID NO: 7693 - protein, 21 aa, Neisseria
SLKQLQEERIRQERIRQARGN

SEQ ID NO: 7694 - protein, 28 aa, Neisseria
VNRKQREAWDKFQKLNTELNRLKTEVAA

SEQ ID NO: 7695 - protein, 5 aa, Neisseria
YKNSQ

SEQ ID NO: 7696 - protein, 10 aa, Neisseria
NAEPGQKNRF

SEQ ID NO: 7697 - protein, 14 aa, Neisseria
SNREVVKDLEKQQK

SEQ ID NO: 7698 - protein, 16 aa, Neisseria
QEQKINNELARLKKIQ

SEQ ID NO: 7699 - protein, 40 aa, Neisseria; identical to SEQ ID NO: 7683

SEQ ID NO: 7700 - protein, 48 aa, Neisseria
SNLEKKKAEHRIQDAEAKRKLAEARLAAAEKARKEAAQQKAEARRAEM

SEQ ID NO: 7701 - protein, 8 aa, Neisseria
TAEDRNIQ

SEQ ID NO: 7702 - protein, 10 aa, Neisseria
MQGRLKKPVD

SEQ ID NO: 7703 - protein, 7 aa, Neisseria
NRSGGDI

SEQ ID NO: 7704 - protein, 9 aa, Neisseria
YADELDGYG

SEQ ID NO: 7705 - protein, 5 aa, Neisseria
SKIGS

SEQ ID NO: 7706 - protein, 9 aa, Neisseria
SLPDGEEGL

SEQ ID NO: 7707 - protein, 5 aa, Neisseria
AAREA

SEQ ID NO: 7708 - protein, 6 aa, Neisseria
RVLGSP

SEQ ID NO: 7709 - protein, 15 aa, Neisseria
PYGKQIDGLGNASSS

SEQ ID NO: 7710 - protein, 6 aa, Neisseria
FVDWSG

SEQ ID NO: 7711 - protein, 7 aa, Neisseria
CGNLTAA

SEQ ID NO: 7712 - protein, 9 aa, Neisseria
WQKNIGKTI

SEQ ID NO: 7713 - protein, 12 aa, Neisseria
LVDEIDVPNIGR

SEQ ID NO: 7714 - protein, 7 aa, Neisseria
AGIPTVF

SEQ ID NO: 7715 - protein, 27 aa, Neisseria
GKELQDDINNDAAALEKFEKIRAYGAL

SEQ ID NO: 7716 - protein, 11 aa, Neisseria
MGLISDVSEAA

SEQ ID NO: 7717 - protein, 7 aa, Neisseria
SSGKTVN

SEQ ID NO: 7718 - protein, 13 aa, Neisseria
AAAVPGTLVNLAA

SEQ ID NO: 7719 - protein, 5 aa, Neisseria
GAAAE

SEQ ID NO: 7720 - protein, 31 aa, Neisseria
YRGGTSKGVFFKRSDLPEAAREAGSARDKIL

SEQ ID NO: 7721 - protein, 22 aa, Neisseria
GSPDPYGKQIDGLGNASSSTSK

SEQ ID NO: 7722 - protein, 15 aa, Neisseria
VILDKSERADHDVDY

SEQ ID NO: 7723 - protein, 6 aa, Neisseria
SIDKPF

SEQ ID NO: 7724 - protein, 7 aa, Neisseria
DWSGNCG

SEQ ID NO: 7725 - protein, 12 aa, Neisseria
GLVDKGKIPSDG

SEQ ID NO: 7726 - protein, 9 aa, Neisseria
WQKNIGKTI

SEQ ID NO: 7727 - protein, 7 aa, Neisseria
ETGDFEL

SEQ ID NO: 7728 - protein, 9 aa, Neisseria
DPADGEGSM

SEQ ID NO: 7729 - protein, 18 aa, Neisseria
PTGNLVDEIDVPNIGRLK

SEQ ID NO: 7730 - protein, 26 aa, Neisseria
GYTGKELQDDINNDAAALEKFEKIRA

SEQ ID NO: 7731 - protein, 12 aa, Neisseria
DVSEAAARAHTP

SEQ ID NO: 7732 - protein, 10 aa, Neisseria
YTASSGKTVN

SEQ ID NO: 7733 - protein, 19 aa, Neisseria
AGGGTRKEVRFGHPSGTLR

SEQ ID NO: 7734 - protein, 7 aa, Neisseria
AECQDGQ

SEQ ID NO: 7735 - protein, 9 aa, Neisseria
VMSRSARVM

SEQ ID NO: 7736 - protein, 8 aa, Neisseria
VRVPEDCF

SEQ ID NO: 7737 - protein, 20 aa, Neisseria
KRSDLPEAAREAGSARDKIL

SEQ ID NO: 7738 - protein, 8 aa, Neisseria
DPYGKQID

SEQ ID NO: 7739 - protein, 5 aa, Neisseria
SSSTS

SEQ ID NO: 7740 - protein, 13 aa, Neisseria
VILDKSERADHDV

SEQ ID NO: 7741 - protein, 6 aa, Neisseria
SIDKPF

SEQ ID NO: 7742 - protein, 10 aa, Neisseria
GLVDKGKIPS

SEQ ID NO: 7743 - protein, 5 aa, Neisseria
GDFEL

SEQ ID NO: 7744 - protein, 7 aa, Neisseria
DPADGEG

SEQ ID NO: 7745 - protein, 7 aa, Neisseria
LVDEIDV

SEQ ID NO: 7746 - protein, 25 aa, Neisseria
YTGKELQDDINNDAAALEKFEKIRA

SEQ ID NO: 7747 - protein, 11 aa, Neisseria
DVSEAAARAHT

SEQ ID NO: 7748 - protein, 8 aa, Neisseria
ASSGKTVN

SEQ ID NO: 7749 - protein, 9 aa, Neisseria
GGTRKEVRF

SEQ ID NO: 7750 - protein, 5 aa, Neisseria
AECQD

SEQ ID NO: 7751 - protein, 6 aa, Neisseria
RSARVM

SEQ ID NO: 7752 - protein, 6 aa, Neisseria
VPEDCF

SEQ ID NO: 7753 - protein, 6 aa, Neisseria
VNRHGQ

SEQ ID NO: 7754 - protein, 7 aa, Neisseria
GGLDAFC

SEQ ID NO: 7755 - protein, 6 aa, Neisseria
RQIAQI

SEQ ID NO: 7756 - protein, 9 aa, Neisseria
AGLHVCNSV

SEQ ID NO: 7757 - protein, 11 aa, Neisseria
HVIVEMCAWYG

SEQ ID NO: 7758 - protein, 10 aa, Neisseria
QCDKTRHMRP

SEQ ID NO: 7759 - protein, 16 aa, Neisseria
RQVNRHGQTGNGGLDA

SEQ ID NO: 7760 - protein, 21 aa, Neisseria
CSLQGNRKAQVFDTDLIDRQI

SEQ ID NO: 7761 - protein, 5 aa, Neisseria
SAGEY

SEQ ID NO: 7762 - protein, 6 aa, Neisseria
QMRDYI

SEQ ID NO: 7763 - protein, 9 aa, Neisseria
QCDKTRHMR

SEQ ID NO: 7764 - protein, 7 aa, Neisseria
QVNRHGQ

SEQ ID NO: 7765 - protein, 9 aa, Neisseria
QGNRKAQVF

SEQ ID NO: 7766 - protein, 7 aa, Neisseria
DLIDRQI

SEQ ID NO: 7767 - protein, 8 aa, Neisseria
MLLNELEK

SEQ ID NO: 7768 - protein, 10 aa, Neisseria
VMDELNACIP

SEQ ID NO: 7769 - protein, 11 aa, Neisseria
HNPANISGILA

SEQ ID NO: 7770 - protein, 9 aa, Neisseria
HFPGLPNVG

SEQ ID NO: 7771 - protein, 7 aa, Neisseria
SFHQTMP

SEQ ID NO: 7772 - protein, 6 aa, Neisseria
AVPREL

SEQ ID NO: 7773 - protein, 19 aa, Neisseria
EAARILGKPLEDIRMIIAH

SEQ ID NO: 7774 - protein, 14 aa, Neisseria
NGASITAIKNGKSV

SEQ ID NO: 7775 - protein, 5 aa, Neisseria
TPIEG

SEQ ID NO: 7776 - protein, 6 aa, Neisseria
YSYLTS

SEQ ID NO: 7777 - protein, 5 aa, Neisseria
LGISE

SEQ ID NO: 7778 - protein, 5 aa, Neisseria
SNDCR

SEQ ID NO: 7779 - protein, 9 aa, Neisseria
RLAKYIASM

SEQ ID NO: 7780 - protein, 5 aa, Neisseria
VSYLD

SEQ ID NO: 7781 - protein, 16 aa, Neisseria
GSSSLKGAVIDRKSGS

SEQ ID NO: 7782 - protein, 10 aa, Neisseria
LGERLTTPEA

SEQ ID NO: 7783 - protein, 19 aa, Neisseria
TFNKDGNKRQVPLSGRNCH

SEQ ID NO: 7784 - protein, 15 aa, Neisseria
ELEKHGLHDRIKAIG

SEQ ID NO: 7785 - protein, 9 aa, Neisseria
AHGGEKYSE

SEQ ID NO: 7786 - protein, 7 aa, Neisseria
AVMDELN

SEQ ID NO: 7787 - protein, 7 aa, Neisseria
TMPERAY

SEQ ID NO: 7788 - protein, 20 aa, Neisseria
RELRKKYAFRRYGFHGTSMR

SEQ ID NO: 7789 - protein, 14 aa, Neisseria
EAARILGKPLEDIR

SEQ ID NO: 7790 - protein, 5 aa, Neisseria
LGNGA

SEQ ID NO: 7791 - protein, 14 aa, Neisseria
TAIKNGKSVDTSMG

SEQ ID NO: 7792 - protein, 10 aa, Neisseria
TRCGDIDPGV

SEQ ID NO: 7793 - protein, 12 aa, Neisseria
AQVDEMLNKKSG

SEQ ID NO: 7794 - protein, 23 aa, Neisseria
SELSNDCRTLEIAADEGHEGARL

SEQ ID NO: 7795 - protein, 13 aa, Neisseria
GIGENSRNIRAKT

SEQ ID NO: 7796 - protein, 16 aa, Neisseria
IDTKANMEKRYGNSGI

SEQ ID NO: 7797 - protein, 7 aa, Neisseria
SPTDSSP

SEQ ID NO: 7798 - protein, 6 aa, Neisseria
PTNEEL

SEQ ID NO: 7799 - protein, 8 aa, Neisseria
AVIDRKSG

SEQ ID NO: 7800 - protein, 7 aa, Neisseria
LGERLTT

SEQ ID NO: 7801 - protein, 18 aa, Neisseria
FNKDGNKRQVPLSGRNCH

SEQ ID NO: 7802 - protein, 15 aa, Neisseria
ELEKHGLHDRIKAIG

SEQ ID NO: 7803 - protein, 8 aa, Neisseria
HGGEKYSE

SEQ ID NO: 7804 - protein, 7 aa, Neisseria
AVMDELN

SEQ ID NO: 7805 - protein, 6 aa, Neisseria
MPERAY

SEQ ID NO: 7806 - protein, 9 aa, Neisseria
RELRKKYAF

SEQ ID NO: 7807 - protein, 14 aa, Neisseria
EAARILGKPLEDIR

SEQ ID NO: 7808 - protein, 8 aa, Neisseria
KNGKSVDT

SEQ ID NO: 7809 - protein, 7 aa, Neisseria
RCGDIDP

SEQ ID NO: 7810 - protein, 12 aa, Neisseria
AQVDEMLNKKSG

SEQ ID NO: 7811 - protein, 22 aa, Neisseria
ELSNDCRTLEIAADEGHEGARL

SEQ ID NO: 7812 - protein, 12 aa, Neisseria
IGENSRNIRAKT

SEQ ID NO: 7813 - protein, 12 aa, Neisseria
IDTKANMEKRYG

SEQ ID NO: 7814 - protein, 5 aa, Neisseria
TNEEL

SEQ ID NO: 7815 - protein, 7 aa, Neisseria
HRVVQFA

SEQ ID NO: 7816 - protein, 9 aa, Neisseria
VGGVHGFAT

SEQ ID NO: 7817 - protein, 11 aa, Neisseria
RTVSADFLEFF

SEQ ID NO: 7818 - protein, 19 aa, Neisseria
DVVLQLFACVAQVGGIQEN

SEQ ID NO: 7819 - protein, 13 aa, Neisseria
RHINFIDQIAGWE

SEQ ID NO: 7820 - protein, 8 aa, Neisseria
VGWIKKFD

SEQ ID NO: 7821 - protein, 9 aa, Neisseria
FQNCAVLHR

SEQ ID NO: 7822 - protein, 25 aa, Neisseria
AACGKVDQRTGYGGGGRNGNRGGTH

SEQ ID NO: 7823 - protein, 18 aa, Neisseria
GGGRDEGDFRRVRASGSF

SEQ ID NO: 7824 - protein, 5 aa, Neisseria
QSRGI

SEQ ID NO: 7825 - protein, 17 aa, Neisseria
GIQENGRNARVDERGFQ

SEQ ID NO: 7826 - protein, 10 aa, Neisseria
YFGCRERYAV

SEQ ID NO: 7827 - protein, 5 aa, Neisseria
MGNNG

SEQ ID NO: 7828 - protein, 10 aa, Neisseria
LPDFDRADAV

SEQ ID NO: 7829 - protein, 9 aa, Neisseria
GKVDQRTGY

SEQ ID NO: 7830 - protein, 12 aa, Neisseria
GGGRNGNRGGTH

SEQ ID NO: 7831 - protein, 13 aa, Neisseria
GGRDEGDFRRVRA

SEQ ID NO: 7832 - protein, 16 aa, Neisseria
GIQENGRNARVDERGF

SEQ ID NO: 7833 - protein, 7 aa, Neisseria
CRERYAV

SEQ ID NO: 7834 - protein, 8 aa, Neisseria
DFDRADAV

SEQ ID NO: 7835 - protein, 8 aa, Neisseria
RQIWKIAD

SEQ ID NO: 7836 - protein, 16 aa, Neisseria
TLFYRFISENFTDYMQ

SEQ ID NO: 7837 - protein, 9 aa, Neisseria
KLKEIFTAI

SEQ ID NO: 7838 - protein, 9 aa, Neisseria
IKGLFDDFD

SEQ ID NO: 7839 - protein, 5 aa, Neisseria
RLGST

SEQ ID NO: 7840 - protein, 9 aa, Neisseria
AVLKGVAEL

SEQ ID NO: 7841 - protein, 14 aa, Neisseria
IDLFGDAYEYLISN

SEQ ID NO: 7842 - protein, 6 aa, Neisseria
AANAGK

SEQ ID NO: 7843 - protein, 7 aa, Neisseria
VSKLIAR

SEQ ID NO: 7844 - protein, 9 aa, Neisseria
EKVNKIYDP

SEQ ID NO: 7845 - protein, 5 aa, Neisseria
FDEHI

SEQ ID NO: 7846 - protein, 11 aa, Neisseria
DSKPFDAIVSN

SEQ ID NO: 7847 - protein, 5 aa, Neisseria
HALNY

SEQ ID NO: 7848 - protein, 5 aa, Neisseria
VSFPG

SEQ ID NO: 7849 - protein, 11 aa, Neisseria
EHIAEIVKLFA

SEQ ID NO: 7850 - protein, 8 aa, Neisseria
AQNAAQQT

SEQ ID NO: 7851 - protein, 7 aa, Neisseria
TREIIDI

SEQ ID NO: 7852 - protein, 25 aa, Neisseria
AEIGETVAKIERLRREIDEVIAEIE

SEQ ID NO: 7853 - protein, 7 aa, Neisseria
MQQRAQL

SEQ ID NO: 7854 - protein, 13 aa, Neisseria
IADEVRGAVDGWD

SEQ ID NO: 7855 - protein, 17 aa, Neisseria
ISENFTDYMQAGDSSID

SEQ ID NO: 7856 - protein, 5 aa, Neisseria
AMPDS

SEQ ID NO: 7857 - protein, 10 aa, Neisseria
PEIKDDAVKV

SEQ ID NO: 7858 - protein, 13 aa, Neisseria
AHQNEELNTKLKE

SEQ ID NO: 7859 - protein, 27 aa, Neisseria
ESSASGYPSEQDIKGLFDDFDTTSSRL

SEQ ID NO: 7860 - protein, 8 aa, Neisseria
VADKNKRL

SEQ ID NO: 7861 - protein, 11 aa, Neisseria
NAGKSGGEFFT

SEQ ID NO: 7862 - protein, 17 aa, Neisseria
GQEKVNKIYDPACGSGS

SEQ ID NO: 7863 - protein, 7 aa, Neisseria
QAKKQFD

SEQ ID NO: 7864 - protein, 8 aa, Neisseria
EINHTTYN

SEQ ID NO: 7865 - protein, 17 aa, Neisseria
LGDTLTNPKLKDSKPFD

SEQ ID NO: 7866 - protein, 16 aa, Neisseria
IGSDDPTLINDDRFAP

SEQ ID NO: 7867 - protein, 6 aa, Neisseria
PKSKAD

SEQ ID NO: 7868 - protein, 9 aa, Neisseria
YLSGRGRAA

SEQ ID NO: 7869 - protein, 10 aa, Neisseria
YRGGAEQKIR

SEQ ID NO: 7870 - protein, 9 aa, Neisseria
LSKHKDNTD

SEQ ID NO: 7871 - protein, 13 aa, Neisseria
GFFKKETNNNVLI

SEQ ID NO: 7872 - protein, 7 aa, Neisseria
FADKADV

SEQ ID NO: 7873 - protein, 8 aa, Neisseria
QTVKDNGY

SEQ ID NO: 7874 - protein, 11 aa, Neisseria
VEAEDTREIID

SEQ ID NO: 7875 - protein, 21 aa, Neisseria
EIGETVAKIERLRREIDEVIA

SEQ ID NO: 7876 - protein, 7 aa, Neisseria
MQQRAQL

SEQ ID NO: 7877 - protein, 10 aa, Neisseria
IADEVRGAVD

SEQ ID NO: 7878 - protein, 5 aa, Neisseria
GDSSI

SEQ ID NO: 7879 - protein, 10 aa, Neisseria
PEIKDDAVKV

SEQ ID NO: 7880 - protein, 13 aa, Neisseria
AHQNEELNTKLKE

SEQ ID NO: 7881 - protein, 21 aa, Neisseria
YPSEQDIKGLFDDFDTTSSRL

SEQ ID NO: 7882 - protein, 8 aa, Neisseria
VADKNKRL

SEQ ID NO: 7883 - protein, 6 aa, Neisseria
AGKSGG

SEQ ID NO: 7884 - protein, 10 aa, Neisseria
GQEKVNKIYD

SEQ ID NO: 7885 - protein, 7 aa, Neisseria
QAKKQFD

SEQ ID NO: 7886 - protein, 9 aa, Neisseria
PKLKDSKPF

SEQ ID NO: 7887 - protein, 14 aa, Neisseria
GSDDPTLINDDRFA

SEQ ID NO: 7888 - protein, 6 aa, Neisseria
PKSKAD

SEQ ID NO: 7889 - protein, 5 aa, Neisseria
GRGRA

SEQ ID NO: 7890 - protein, 8 aa, Neisseria
GGAEQKIR

SEQ ID NO: 7891 - protein, 8 aa, Neisseria
SKHKDNTD

SEQ ID NO: 7892 - protein, 8 aa, Neisseria
GFFKKETN

SEQ ID NO: 7893 - protein, 7 aa, Neisseria
FADKADV

SEQ ID NO: 7894 - protein, 7 aa, Neisseria
QTVKDNG

SEQ ID NO: 7895 - protein, 11 aa, Neisseria
VEAEDTREIID

SEQ ID NO: 7896 - protein, 21 aa, Neisseria
EIGETVAKIERLRREIDEVIA

SEQ ID NO: 7897 - protein, 9 aa, Neisseria
LLDHMTRDE

SEQ ID NO: 7898 - protein, 7 aa, Neisseria
AHVGNGD

SEQ ID NO: 7899 - protein, 11 aa, Neisseria
LTLIQGVVNTF

SEQ ID NO: 7900 - protein, 5 aa, Neisseria
RIIAN

SEQ ID NO: 7901 - protein, 16 aa, Neisseria
SMVFQILFGFLASLIV

SEQ ID NO: 7902 - protein, 14 aa, Neisseria
KLVGAPKMISALQR

SEQ ID NO: 7903 - protein, 8 aa, Neisseria
DLPEEMNA

SEQ ID NO: 7904 - protein, 12 aa, Neisseria
EVIDTPRTEEEA

SEQ ID NO: 7905 - protein, 13 aa, Neisseria
EAQARQWNLKTPE

SEQ ID NO: 7906 - protein, 7 aa, Neisseria
HSPEPNA

SEQ ID NO: 7907 - protein, 8 aa, Neisseria
TGASRNSS

SEQ ID NO: 7908 - protein, 9 aa, Neisseria
HMTRDEVEA

SEQ ID NO: 7909 - protein, 5 aa, Neisseria
VGNGD

SEQ ID NO: 7910 - protein, 13 aa, Neisseria
IARNNDGSQSQGT

SEQ ID NO: 7911 - protein, 11 aa, Neisseria
RQREYRADAGA

SEQ ID NO: 7912 - protein, 16 aa, Neisseria
LQRLKGNPVDLPEEMN

SEQ ID NO: 7913 - protein, 23 aa, Neisseria
GDTRDSLLSTHPSLDNRIARLKS

SEQ ID NO: 7914 - protein, 12 aa, Neisseria
EVIDTPRTEEEA

SEQ ID NO: 7915 - protein, 5 aa, Neisseria
ASRNS

SEQ ID NO: 7916 - protein, 9 aa, Neisseria
HMTRDEVEA

SEQ ID NO: 7917 - protein, 8 aa, Neisseria
RNNDGSQS

SEQ ID NO: 7918 - protein, 11 aa, Neisseria
RQREYRADAGA

SEQ ID NO: 7919 - protein, 7 aa, Neisseria
QRLKGNP

SEQ ID NO: 7920 - protein, 7 aa, Neisseria
DLPEEMN

SEQ ID NO: 7921 - protein, 7 aa, Neisseria
GDTRDSL

SEQ ID NO: 7922 - protein, 12 aa, Neisseria
PSLDNRIARLKS

SEQ ID NO: 7923 - protein, 8 aa, Neisseria
RLLTTLAL

SEQ ID NO: 7924 - protein, 14 aa, Neisseria
FMGIMAALNPMIAQ

SEQ ID NO: 7925 - protein, 7 aa, Neisseria
TDEVGET

SEQ ID NO: 7926 - protein, 33 aa, Neisseria
GLFLGVFGMVLMWAAITPFRNWLTLSDYVEGTM

SEQ ID NO: 7927 - protein, 12 aa, Neisseria
MVHRALHAYTSS

SEQ ID NO: 7928 - protein, 6 aa, Neisseria
FFRPFG

SEQ ID NO: 7929 - protein, 9 aa, Neisseria
FKQIWKIGA

SEQ ID NO: 7930 - protein, 7 aa, Neisseria
ARYISGV

SEQ ID NO: 7931 - protein, 7 aa, Neisseria
ITVLSLV

SEQ ID NO: 7932 - protein, 14 aa, Neisseria
FQPADFTQCIASYA

SEQ ID NO: 7933 - protein, 9 aa, Neisseria
YGFWTALIA

SEQ ID NO: 7934 - protein, 5 aa, Neisseria
KEVRL

SEQ ID NO: 7935 - protein, 8 aa, Neisseria
GAGKEDLA

SEQ ID NO: 7936 - protein, 16 aa, Neisseria
GAGKTDEVGETGRQGI

SEQ ID NO: 7937 - protein, 5 aa, Neisseria
PFRNW

SEQ ID NO: 7938 - protein, 8 aa, Neisseria
LSDYVEGT

SEQ ID NO: 7939 - protein, 9 aa, Neisseria
TSSLNRPRL

SEQ ID NO: 7940 - protein, 8 aa, Neisseria
AKFGKPDW

SEQ ID NO: 7941 - protein, 14 aa, Neisseria
SLGRREFSRARYIS

SEQ ID NO: 7942 - protein, 5 aa, Neisseria
YNNDP

SEQ ID NO: 7943 - protein, 7 aa, Neisseria
RGYKVTK

SEQ ID NO: 7944 - protein, 13 aa, Neisseria
LCSREMVRSHKAV

SEQ ID NO: 7945 - protein, 5 aa, Neisseria
KEVRL

SEQ ID NO: 7946 - protein, 8 aa, Neisseria
GAGKEDLA

SEQ ID NO: 7947 - protein, 11 aa, Neisseria
GKTDEVGETGR

SEQ ID NO: 7948 - protein, 5 aa, Neisseria
LNRPR

SEQ ID NO: 7949 - protein, 8 aa, Neisseria
LGRREFSR

SEQ ID NO: 7950 - protein, 5 aa, Neisseria
YKVTK

SEQ ID NO: 7951 - protein, 13 aa, Neisseria
LCSREMVRSHKAV

SEQ ID NO: 7952 - protein, 7 aa, Neisseria
AVQKILQ

SEQ ID NO: 7953 - protein, 5 aa, Neisseria
VLSLL

SEQ ID NO: 7954 - protein, 13 aa, Neisseria
RASDELARIFGTQ

SEQ ID NO: 7955 - protein, 26 aa, Neisseria
DIGHGIKQIGRNIAEQIGGFSRESES

SEQ ID NO: 7956 - protein, 28 aa, Neisseria
NEALADCLDEISRLRDGVERLNERLDRL

SEQ ID NO: 7957 - protein, 10 aa, Neisseria
LQSPDSRSEL

SEQ ID NO: 7958 - protein, 28 aa, Neisseria
LAGRITEDGLLSAGNGFADTEITFRNSA

SEQ ID NO: 7959 - protein, 15 aa, Neisseria
LQGGEPGAGDIGLEG

SEQ ID NO: 7960 - protein, 12 aa, Neisseria
GSLRSRASDELA

SEQ ID NO: 7961 - protein, 11 aa, Neisseria
TQADIGSRAAD

SEQ ID NO: 7962 - protein, 7 aa, Neisseria
QIGRNIA

SEQ ID NO: 7963 - protein, 47 aa, Neisseria
IGGFSRESESANIGNEALADCLDEISRLRDGVERLNERLDRLERDIW

SEQ ID NO: 7964 - protein, 8 aa, Neisseria
SPDSRSEL

SEQ ID NO: 7965 - protein, 10 aa, Neisseria
LAGRITEDGL

SEQ ID NO: 7966 - protein, 7 aa, Neisseria
ADTEITF

SEQ ID NO: 7967 - protein, 6 aa, Neisseria
GEPGAG

SEQ ID NO: 7968 - protein, 5 aa, Neisseria
IGLEG

SEQ ID NO: 7969 - protein, 10 aa, Neisseria
LRSRASDELA

SEQ ID NO: 7970 - protein, 9 aa, Neisseria
ADIGSRAAD

SEQ ID NO: 7971 - protein, 11 aa, Neisseria
FSRESESANIG

SEQ ID NO: 7972 - protein, 31 aa, Neisseria
ALADCLDEISRLRDGVERLNERLDRLERDIW

SEQ ID NO: 7973 - protein, 6 aa, Neisseria
TLDAFV

SEQ ID NO: 7974 - protein, 14 aa, Neisseria
HHIFHEFRVFVGFF

SEQ ID NO: 7975 - protein, 6 aa, Neisseria
FEQAVE

SEQ ID NO: 7976 - protein, 5 aa, Neisseria
IDDFL

SEQ ID NO: 7977 - protein, 6 aa, Neisseria
VAVCPV

SEQ ID NO: 7978 - protein, 7 aa, Neisseria
ALDDETL

SEQ ID NO: 7979 - protein, 10 aa, Neisseria
VGNQRSSDIA

SEQ ID NO: 7980 - protein, 9 aa, Neisseria
DFLDTDFGI

SEQ ID NO: 7981 - protein, 8 aa, Neisseria
SQADGNVR

SEQ ID NO: 7982 - protein, 13 aa, Neisseria
GTRAKRGYGNHDL

SEQ ID NO: 7983 - protein, 7 aa, Neisseria
FARETDI

SEQ ID NO: 7984 - protein, 7 aa, Neisseria
ALDDETL

SEQ ID NO: 7985 - protein, 6 aa, Neisseria
QRSSDI

SEQ ID NO: 7986 - protein, 7 aa, Neisseria
SQADGNV

SEQ ID NO: 7987 - protein, 8 aa, Neisseria
TRAKRGYG

SEQ ID NO: 7988 - protein, 7 aa, Neisseria
FARETDI

SEQ ID NO: 7989 - protein, 6 aa, Neisseria
MQFPYR

SEQ ID NO: 7990 - protein, 6 aa, Neisseria
MRRMRR

SEQ ID NO: 7991 - protein, 7 aa, Neisseria
ERAQEAY

SEQ ID NO: 7992 - protein, 10 aa, Neisseria
PSTVRALRER

SEQ ID NO: 7993 - protein, 6 aa, Neisseria
IREALE

SEQ ID NO: 7994 - protein, 11 aa, Neisseria
YASAFYGPFRD

SEQ ID NO: 7995 - protein, 8 aa, Neisseria
SGNLGKAD

SEQ ID NO: 7996 - protein, 10 aa, Neisseria
LDVVRRVKDE

SEQ ID NO: 7997 - protein, 5 aa, Neisseria
AAIAN

SEQ ID NO: 7998 - protein, 30 aa, Neisseria
RNVPASRMRRMRRDDFSRRLMREHTLTADD

SEQ ID NO: 7999 - protein, 20 aa, Neisseria
GSAREEDVPSMPGVKRQSLD

SEQ ID NO: 8000 - protein, 6 aa, Neisseria
AEEAVK

SEQ ID NO: 8001 - protein, 17 aa, Neisseria
ANKTERAQEAYNPEGLV

SEQ ID NO: 8002 - protein, 8 aa, Neisseria
RALRERFP

SEQ ID NO: 8003 - protein, 18 aa, Neisseria
GQDGLTDENGYVMNDETV

SEQ ID NO: 8004 - protein, 22 aa, Neisseria
APSDMMDGRIGAIREALEDAGH

SEQ ID NO: 8005 - protein, 32 aa, Neisseria
PFRDAVGSSGNLGKADKKTYQMDPANTDEALH

SEQ ID NO: 8006 - protein, 8 aa, Neisseria
LDIQEGAD

SEQ ID NO: 8007 - protein, 11 aa, Neisseria
VVRRVKDEFGV

SEQ ID NO: 8008 - protein, 9 aa, Neisseria
GWLDGGKVV

SEQ ID NO: 8009 - protein, 7 aa, Neisseria
KRAGADG

SEQ ID NO: 8010 - protein, 8 aa, Neisseria
EAAKMLKR

SEQ ID NO: 8011 - protein, 25 aa, Neisseria
PASRMRRMRRDDFSRRLMREHTLTA

SEQ ID NO: 8012 - protein, 10 aa, Neisseria
GSAREEDVPS

SEQ ID NO: 8013 - protein, 9 aa, Neisseria
PGVKRQSLD

SEQ ID NO: 8014 - protein, 6 aa, Neisseria
AEEAVK

SEQ ID NO: 8015 - protein, 11 aa, Neisseria
NKTERAQEAYN

SEQ ID NO: 8016 - protein, 8 aa, Neisseria
RALRERFP

SEQ ID NO: 8017 - protein, 8 aa, Neisseria
DGLTDENG

SEQ ID NO: 8018 - protein, 6 aa, Neisseria
MNDETV

SEQ ID NO: 8019 - protein, 18 aa, Neisseria
DMMDGRIGAIREALEDAG

SEQ ID NO: 8020 - protein, 6 aa, Neisseria
FRDAVG

SEQ ID NO: 8021 - protein, 11 aa, Neisseria
NLGKADKKTYQ

SEQ ID NO: 8022 - protein, 9 aa, Neisseria
PANTDEALH

SEQ ID NO: 8023 - protein, 8 aa, Neisseria
LDIQEGAD

SEQ ID NO: 8024 - protein, 10 aa, Neisseria
VVRRVKDEFG

SEQ ID NO: 8025 - protein, 5 aa, Neisseria
KRAGA

SEQ ID NO: 8026 - protein, 8 aa, Neisseria
EAAKMLKR

SEQ ID NO: 8027 - protein, 9 aa, Neisseria
CRLFGKLSL

SEQ ID NO: 8028 - protein, 6 aa, Neisseria
RLLLGL

SEQ ID NO: 8029 - protein, 7 aa, Neisseria
RSVRRVI

SEQ ID NO: 8030 - protein, 5 aa, Neisseria
QVVAV

SEQ ID NO: 8031 - protein, 7 aa, Neisseria
VFIEDFV

SEQ ID NO: 8032 - protein, 9 aa, Neisseria
GFLGNVLRT

SEQ ID NO: 8033 - protein, 13 aa, Neisseria
MPSENGMGKRQLA

SEQ ID NO: 8034 - protein, 10 aa, Neisseria
CRSGVCRGRC

SEQ ID NO: 8035 - protein, 16 aa, Neisseria
FPSRSVRRVIFRRVRI

SEQ ID NO: 8036 - protein, 7 aa, Neisseria
NPADFRV

SEQ ID NO: 8037 - protein, 5 aa, Neisseria
ASQED

SEQ ID NO: 8038 - protein, 13 aa, Neisseria
MPSENGMGKRQLA

SEQ ID NO: 8039 - protein, 7 aa, Neisseria
GVCRGRC

SEQ ID NO: 8040 - protein, 8 aa, Neisseria
VIFRRVRI

SEQ ID NO: 8041 - protein, 5 aa, Neisseria
ADFRV

SEQ ID NO: 8042 - protein, 5 aa, Neisseria
ASQED

SEQ ID NO: 8043 - protein, 10 aa, Neisseria
NIAKKLAGVD

SEQ ID NO: 8044 - protein, 11 aa, Neisseria
KAVEKCAENVL

SEQ ID NO: 8045 - protein, 5 aa, Neisseria
GNFPN

SEQ ID NO: 8046 - protein, 9 aa, Neisseria
IAKKLAGVD

SEQ ID NO: 8047 - protein, 13 aa, Neisseria
DFGRDDAVRHSGV

SEQ ID NO: 8048 - protein, 8 aa, Neisseria
KAVEKCAE

SEQ ID NO: 8049 - protein, 9 aa, Neisseria
GHHRNPYKS

SEQ ID NO: 8050 - protein, 9 aa, Neisseria
IAKKLAGVD

SEQ ID NO: 8051 - protein, 8 aa, Neisseria
FGRDDAVR

SEQ ID NO: 8052 - protein, 8 aa, Neisseria
KAVEKCAE

SEQ ID NO: 8053 - protein, 5 aa, Neisseria
NPYKS

SEQ ID NO: 8054 - protein, 5 aa, Neisseria
SRRSL

SEQ ID NO: 8055 - protein, 6 aa, Neisseria
MPRMRS

SEQ ID NO: 8056 - protein, 6 aa, Neisseria
SPMSPA

SEQ ID NO: 8057 - protein, 10 aa, Neisseria
RIFCTALLRK

SEQ ID NO: 8058 - protein, 7 aa, Neisseria
SSVMRPA

SEQ ID NO: 8059 - protein, 7 aa, Neisseria
LSGLCRI

SEQ ID NO: 8060 - protein, 18 aa, Neisseria
MSRSSRSRRSLRRSTPSR

SEQ ID NO: 8061 - protein, 8 aa, Neisseria
SSRQSARA

SEQ ID NO: 8062 - protein, 14 aa, Neisseria
FADSDSRENPPICS

SEQ ID NO: 8063 - protein, 22 aa, Neisseria
PKIRANSSDARERRLPSRDSTA

SEQ ID NO: 8064 - protein, 19 aa, Neisseria
PRMRSPSSPMSPAPGSPPW

SEQ ID NO: 8065 - protein, 18 aa, Neisseria
AKPFPAESKPSSVMRPAS

SEQ ID NO: 8066 - protein, 15 aa, Neisseria
AASSERLSGLCRIRR

SEQ ID NO: 8067 - protein, 15 aa, Neisseria
MMGRRADIFSDRGGE

SEQ ID NO: 8068 - protein, 9 aa, Neisseria
LSRYRKRYG

SEQ ID NO: 8069 - protein, 17 aa, Neisseria
MSRSSRSRRSLRRSTPS

SEQ ID NO: 8070 - protein, 7 aa, Neisseria
SRQSARA

SEQ ID NO: 8071 - protein, 10 aa, Neisseria
ADSDSRENPP

SEQ ID NO: 8072 - protein, 22 aa, Neisseria
PKIRANSSDARERRLPSRDSTA

SEQ ID NO: 8073 - protein, 7 aa, Neisseria
PRMRSPS

SEQ ID NO: 8074 - protein, 12 aa, Neisseria
FPAESKPSSVMR

SEQ ID NO: 8075 - protein, 9 aa, Neisseria
AASSERLSG

SEQ ID NO: 8076 - protein, 5 aa, Neisseria
CRIRR

SEQ ID NO: 8077 - protein, 15 aa, Neisseria
MMGRRADIFSDRGGE

SEQ ID NO: 8078 - protein, 8 aa, Neisseria
SRYRKRYG

SEQ ID NO: 8079 - protein, 7 aa, Neisseria
SQFIQQV

SEQ ID NO: 8080 - protein, 8 aa, Neisseria
NLIKTLLD

SEQ ID NO: 8081 - protein, 10 aa, Neisseria
ALFYSLLPVL

SEQ ID NO: 8082 - protein, 27 aa, Neisseria
VAGCDEAKEEVQEIVDYLKAPNRYQSL

SEQ ID NO: 8083 - protein, 7 aa, Neisseria
DFVEMFV

SEQ ID NO: 8084 - protein, 8 aa, Neisseria
RVRDMFEQ

SEQ ID NO: 8085 - protein, 7 aa, Neisseria
EIDAVGR

SEQ ID NO: 8086 - protein, 10 aa, Neisseria
PALQRPGRFD

SEQ ID NO: 8087 - protein, 8 aa, Neisseria
SVDLLSLA

SEQ ID NO: 8088 - protein, 8 aa, Neisseria
ADLANLVN

SEQ ID NO: 8089 - protein, 10 aa, Neisseria
SNDFERATQM

SEQ ID NO: 8090 - protein, 5 aa, Neisseria
SEKTQ

SEQ ID NO: 8091 - protein, 7 aa, Neisseria
EIRRILD

SEQ ID NO: 8092 - protein, 11 aa, Neisseria
TMCKALMEWET

SEQ ID NO: 8093 - protein, 5 aa, Neisseria
DYSHN

SEQ ID NO: 8094 - protein, 6 aa, Neisseria
PAPADT

SEQ ID NO: 8095 - protein, 12 aa, Neisseria
LDGKKEDNGQIE

SEQ ID NO: 8096 - protein, 8 aa, Neisseria
VNNGEVSG

SEQ ID NO: 8097 - protein, 12 aa, Neisseria
LIKGERTDKSTF

SEQ ID NO: 8098 - protein, 8 aa, Neisseria
APLDDNLI

SEQ ID NO: 8099 - protein, 18 aa, Neisseria
LLDKNVRVKVTPEEKPSA

SEQ ID NO: 8100 - protein, 10 aa, Neisseria
MQTGGGGKGG

SEQ ID NO: 8101 - protein, 16 aa, Neisseria
SFGKSRARLLDKDANK

SEQ ID NO: 8102 - protein, 12 aa, Neisseria
AGCDEAKEEVQE

SEQ ID NO: 8103 - protein, 17 aa, Neisseria
LKAPNRYQSLGGRVPRG

SEQ ID NO: 8104 - protein, 10 aa, Neisseria
GSPGTGKTLL

SEQ ID NO: 8105 - protein, 5 aa, Neisseria
SGSDF

SEQ ID NO: 8106 - protein, 16 aa, Neisseria
GASRVRDMFEQAKKNA

SEQ ID NO: 8107 - protein, 25 aa, Neisseria
DEIDAVGRQRGAGLGGGNDEREQTL

SEQ ID NO: 8108 - protein, 8 aa, Neisseria
MDGFESNQ

SEQ ID NO: 8109 - protein, 19 aa, Neisseria
TNRPDVLDPALQRPGRFDR

SEQ ID NO: 8110 - protein, 10 aa, Neisseria
LPDIRGREQI

SEQ ID NO: 8111 - protein, 13 aa, Neisseria
VHSKKVPLDESVD

SEQ ID NO: 8112 - protein, 8 aa, Neisseria
RGTPGFSG

SEQ ID NO: 8113 - protein, 41 aa, Neisseria
AGRRNKVKVDQSDFEDAKDKIYMGPERRSMVMHEDEKRATA

SEQ ID NO: 8114 - protein, 8 aa, Neisseria
TIMPRGRA

SEQ ID NO: 8115 - protein, 15 aa, Neisseria
QLPERDRISMYKDQM

SEQ ID NO: 8116 - protein, 7 aa, Neisseria
FGGRIAE

SEQ ID NO: 8117 - protein, 20 aa, Neisseria
STGASNDFERATQMAREMVT

SEQ ID NO: 8118 - protein, 8 aa, Neisseria
YGMSDKMG

SEQ ID NO: 8119 - protein, 9 aa, Neisseria
AENEGEVFL

SEQ ID NO: 8120 - protein, 28 aa, Neisseria
SVTRSQNISEKTQQDIDAEIRRILDEQY

SEQ ID NO: 8121 - protein, 13 aa, Neisseria
ILDENRDKMETMC

SEQ ID NO: 8122 - protein, 8 aa, Neisseria
ETIDRDQV

SEQ ID NO: 8123 - protein, 57 aa, Neisseria
MAGKQPSPPKDYSHNLRENADAAEDNAPHAPTREETEAPAPADTASTESEQQPENKA

SEQ ID NO: 8124 - protein, 10 aa, Neisseria
LDGKKEDNGQ

SEQ ID NO: 8125 - protein, 6 aa, Neisseria
NNGEVS

SEQ ID NO: 8126 - protein, 10 aa, Neisseria
IKGERTDKST

SEQ ID NO: 8127 - protein, 7 aa, Neisseria
PLDDNLI

SEQ ID NO: 8128 - protein, 18 aa, Neisseria
LLDKNVRVKVTPEEKPSA

SEQ ID NO: 8129 - protein, 6 aa, Neisseria
GGGKGG

SEQ ID NO: 8130 - protein, 14 aa, Neisseria
GKSRARLLDKDANK

SEQ ID NO: 8131 - protein, 12 aa, Neisseria
AGCDEAKEEVQE

SEQ ID NO: 8132 - protein, 5 aa, Neisseria
KAPNR

SEQ ID NO: 8133 - protein, 6 aa, Neisseria
GGRVPR

SEQ ID NO: 8134 - protein, 14 aa, Neisseria
SRVRDMFEQAKKNA

SEQ ID NO: 8135 - protein, 13 aa, Neisseria
DEIDAVGRQRGAG

SEQ ID NO: 8136 - protein, 9 aa, Neisseria
GGNDEREQT

SEQ ID NO: 8137 - protein, 5 aa, Neisseria
DGFES

SEQ ID NO: 8138 - protein, 8 aa, Neisseria
TNRPDVLD

SEQ ID NO: 8139 - protein, 10 aa, Neisseria
ALQRPGRFDR

SEQ ID NO: 8140 - protein, 9 aa, Neisseria
PDIRGREQI

SEQ ID NO: 8141 - protein, 12 aa, Neisseria
HSKKVPLDESVD

SEQ ID NO: 8142 - protein, 41 aa, Neisseria; identical to SEQ ID NO: 8113

SEQ ID NO: 8143 - protein, 5 aa, Neisseria
PRGRA

SEQ ID NO: 8144 - protein, 11 aa, Neisseria
LPERDRISMYK

SEQ ID NO: 8145 - protein, 17 aa, Neisseria
ASNDFERATQMAREMVT

SEQ ID NO: 8146 - protein, 7 aa, Neisseria
GMSDKMG

SEQ ID NO: 8147 - protein, 9 aa, Neisseria
AENEGEVFL

SEQ ID NO: 8148 - protein, 28 aa, Neisseria
SVTRSQNISEKTQQDIDAEIRRILDEQY

SEQ ID NO: 8149 - protein, 13 aa, Neisseria
ILDENRDKMETMC

SEQ ID NO: 8150 - protein, 8 aa, Neisseria
ETIDRDQV

SEQ ID NO: 8151 - protein, 25 aa, Neisseria
KQPSPPKDYSHNLRENADAAEDNAP

SEQ ID NO: 8152 - protein, 28 aa, Neisseria
APTREETEAPAPADTASTESEQQPENKA

SEQ ID NO: 8153 - protein, 6 aa, Neisseria
KMVVGL

SEQ ID NO: 8154 - protein, 7 aa, Neisseria
NPGKEYE

SEQ ID NO: 8155 - protein, 7 aa, Neisseria
FGEVARA

SEQ ID NO: 8156 - protein, 9 aa, Neisseria
VAALAQFYK

SEQ ID NO: 8157 - protein, 8 aa, Neisseria
GHNGLKDI

SEQ ID NO: 8158 - protein, 33 aa, Neisseria
HRRQIDDAVAKSLQAIPDILAGKWEEATRFLHS

SEQ ID NO: 8159 - protein, 17 aa, Neisseria
LGNPGKEYEQTRHNAGF

SEQ ID NO: 8160 - protein, 10 aa, Neisseria
ASFKEEKKFF

SEQ ID NO: 8161 - protein, 5 aa, Neisseria
ALPDG

SEQ ID NO: 8162 - protein, 7 aa, Neisseria
MNRSGQA

SEQ ID NO: 8163 - protein, 5 aa, Neisseria
IKPEE

SEQ ID NO: 8164 - protein, 12 aa, Neisseria
DELDIPCGRIKF

SEQ ID NO: 8165 - protein, 16 aa, Neisseria
LGGGNGGHNGLKDIQA

SEQ ID NO: 8166 - protein, 7 aa, Neisseria
GTADYYR

SEQ ID NO: 8167 - protein, 9 aa, Neisseria
IGHPGDRNL

SEQ ID NO: 8168 - protein, 17 aa, Neisseria
LNKPSTEHRRQIDDAVA

SEQ ID NO: 8169 - protein, 7 aa, Neisseria
KWEEATR

SEQ ID NO: 8170 - protein, 11 aa, Neisseria
NPGKEYEQTRH

SEQ ID NO: 8171 - protein, 10 aa, Neisseria
ASFKEEKKFF

SEQ ID NO: 8172 - protein, 5 aa, Neisseria
IKPEE

SEQ ID NO: 8173 - protein, 12 aa, Neisseria
DELDIPCGRIKF

SEQ ID NO: 8174 - protein, 8 aa, Neisseria
NGLKDIQA

SEQ ID NO: 8175 - protein, 7 aa, Neisseria
HPGDRNL

SEQ ID NO: 8176 - protein, 14 aa, Neisseria
PSTEHRRQIDDAVA

SEQ ID NO: 8177 - protein, 7 aa, Neisseria
KWEEATR

SEQ ID NO: 8178 - protein, 6 aa, Neisseria
KLAALL

SEQ ID NO: 8179 - protein, 8 aa, Neisseria
QLFQTLTN

SEQ ID NO: 8180 - protein, 6 aa, Neisseria
QGGRDL

SEQ ID NO: 8181 - protein, 17 aa, Neisseria
GVIFGILFRSLSSLLSR

SEQ ID NO: 8182 - protein, 5 aa, Neisseria
DPEEF

SEQ ID NO: 8183 - protein, 11 aa, Neisseria
NMFAGFNTVHS

SEQ ID NO: 8184 - protein, 21 aa, Neisseria
AVVGPVSFFGLLAASLANHFS

SEQ ID NO: 8185 - protein, 5 aa, Neisseria
EHLLG

SEQ ID NO: 8186 - protein, 7 aa, Neisseria
LSVVVEF

SEQ ID NO: 8187 - protein, 7 aa, Neisseria
MPSEKNI

SEQ ID NO: 8188 - protein, 6 aa, Neisseria
AGSSRP

SEQ ID NO: 8189 - protein, 7 aa, Neisseria
NVKGDWD

SEQ ID NO: 8190 - protein, 9 aa, Neisseria
IKQGGRDLS

SEQ ID NO: 8191 - protein, 8 aa, Neisseria
MIDPEEFT

SEQ ID NO: 8192 - protein, 8 aa, Neisseria
WRERYRLD

SEQ ID NO: 8193 - protein, 6 aa, Neisseria
GRDQAV

SEQ ID NO: 8194 - protein, 9 aa, Neisseria
FSPSVKHSV

SEQ ID NO: 8195 - protein, 7 aa, Neisseria
MPSEKNI

SEQ ID NO: 8196 - protein, 7 aa, Neisseria
QGGRDLS

SEQ ID NO: 8197 - protein, 8 aa, Neisseria
MIDPEEFT

SEQ ID NO: 8198 - protein, 7 aa, Neisseria
WRERYRL

SEQ ID NO: 8199 - protein, 5 aa, Neisseria
GRDQA

SEQ ID NO: 8200 - protein, 5 aa, Neisseria
VKHSV

SEQ ID NO: 8201 - protein, 12 aa, Neisseria
VAVSALSACRQA

SEQ ID NO: 8202 - protein, 6 aa, Neisseria
ISDRSV

SEQ ID NO: 8203 - protein, 34 aa, Neisseria
STIKQMFGYTKLPEEPKGIRVIYVTDMGNVTDWT

SEQ ID NO: 8204 - protein, 5 aa, Neisseria
QAEKF

SEQ ID NO: 8205 - protein, 24 aa, Neisseria
SACRQAEEGPPPLPRQISDRSVGH

SEQ ID NO: 8206 - protein, 10 aa, Neisseria
NLTEHNGPKA

SEQ ID NO: 8207 - protein, 8 aa, Neisseria
NGKPDQPV

SEQ ID NO: 8208 - protein, 11 aa, Neisseria
YTKLPEEPKGI

SEQ ID NO: 8209 - protein, 17 aa, Neisseria
TDWTNPNADTEWMDAKK

SEQ ID NO: 8210 - protein, 37 aa, Neisseria
GMGAEDALPFGNKEQAEKFAKDKGGKVVGFDDMPDTY

SEQ ID NO: 8211 - protein, 10 aa, Neisseria
RQAEEGPPPL

SEQ ID NO: 8212 - protein, 7 aa, Neisseria
QISDRSV

SEQ ID NO: 8213 - protein, 6 aa, Neisseria
EHNGPK

SEQ ID NO: 8214 - protein, 5 aa, Neisseria
GKPDQ

SEQ ID NO: 8215 - protein, 9 aa, Neisseria
KLPEEPKGI

SEQ ID NO: 8216 - protein, 11 aa, Neisseria
NADTEWMDAKK

SEQ ID NO: 8217 - protein, 6 aa, Neisseria
GAEDAL

SEQ ID NO: 8218 - protein, 16 aa, Neisseria
GNKEQAEKFAKDKGGK

SEQ ID NO: 8219 - protein, 5 aa, Neisseria
DDMPD

SEQ ID NO: 8220 - protein, 10 aa, Neisseria
LPKAVRNLAR

SEQ ID NO: 8221 - protein, 9 aa, Neisseria
EEIIRWLAD

SEQ ID NO: 8222 - protein, 13 aa, Neisseria
ILGQIKDAVRVAQ

SEQ ID NO: 8223 - protein, 9 aa, Neisseria
KKLNALFQK

SEQ ID NO: 8224 - protein, 6 aa, Neisseria
SVAKEV

SEQ ID NO: 8225 - protein, 9 aa, Neisseria
EQIFPDIGD

SEQ ID NO: 8226 - protein, 7 aa, Neisseria
EMIELVA

SEQ ID NO: 8227 - protein, 7 aa, Neisseria
AQELCDK

SEQ ID NO: 8228 - protein, 7 aa, Neisseria
DLPAILH

SEQ ID NO: 8229 - protein, 5 aa, Neisseria
DLNDA

SEQ ID NO: 8230 - protein, 11 aa, Neisseria
VDDMVNIVQSG

SEQ ID NO: 8231 - protein, 10 aa, Neisseria
EKVAEFVRQQ

SEQ ID NO: 8232 - protein, 7 aa, Neisseria
LRDEGEK

SEQ ID NO: 8233 - protein, 13 aa, Neisseria
KQVLENAMKQLAK

SEQ ID NO: 8234 - protein, 11 aa, Neisseria
EVLERLSVQLT

SEQ ID NO: 8235 - protein, 15 aa, Neisseria
KLLHSPTQTLNKAGE

SEQ ID NO: 8236 - protein, 7 aa, Neisseria
SIREKLA

SEQ ID NO: 8237 - protein, 12 aa, Neisseria
KAVRNLARSNAA

SEQ ID NO: 8238 - protein, 6 aa, Neisseria
TCNRTE

SEQ ID NO: 8239 - protein, 9 aa, Neisseria
CVGDSEEII

SEQ ID NO: 8240 - protein, 7 aa, Neisseria
PIEEIRP

SEQ ID NO: 8241 - protein, 8 aa, Neisseria
DMQETVRH

SEQ ID NO: 8242 - protein, 19 aa, Neisseria
QIKDAVRVAQEQESMGKKL

SEQ ID NO: 8243 - protein, 17 aa, Neisseria
SVAKEVRTDTAVGENSV

SEQ ID NO: 8244 - protein, 6 aa, Neisseria
DIGDLN

SEQ ID NO: 8245 - protein, 5 aa, Neisseria
KSPRL

SEQ ID NO: 8246 - protein, 17 aa, Neisseria
TLARAQELCDKLGVNAE

SEQ ID NO: 8247 - protein, 12 aa, Neisseria
GMVERALKQRQS

SEQ ID NO: 8248 - protein, 15 aa, Neisseria
AVPRDIEAEVGDLND

SEQ ID NO: 8249 - protein, 13 aa, Neisseria
QSGKEARQKAAAA

SEQ ID NO: 8250 - protein, 19 aa, Neisseria
LVSEKVAEFVRQQQGRQSV

SEQ ID NO: 8251 - protein, 15 aa, Neisseria
KALRDEGEKARKQVL

SEQ ID NO: 8252 - protein, 8 aa, Neisseria
ATAEEVLE

SEQ ID NO: 8253 - protein, 24 aa, Neisseria
LTNKLLHSPTQTLNKAGEEDKDLV

SEQ ID NO: 8254 - protein, 7 aa, Neisseria
SIREKLA

SEQ ID NO: 8255 - protein, 12 aa, Neisseria
KAVRNLARSNAA

SEQ ID NO: 8256 - protein, 7 aa, Neisseria
GDSEEII

SEQ ID NO: 8257 - protein, 6 aa, Neisseria
PIEEIR

SEQ ID NO: 8258 - protein, 8 aa, Neisseria
DMQETVRH

SEQ ID NO: 8259 - protein, 19 aa, Neisseria
QIKDAVRVAQEQESMGKKL

SEQ ID NO: 8260 - protein, 17 aa, Neisseria
SVAKEVRTDTAVGENSV

SEQ ID NO: 8261 - protein, 10 aa, Neisseria
TLARAQELCD

SEQ ID NO: 8262 - protein, 12 aa, Neisseria
GMVERALKQRQS

SEQ ID NO: 8263 - protein, 14 aa, Neisseria
AVPRDIEAEVGDLN

SEQ ID NO: 8264 - protein, 13 aa, Neisseria
QSGKEARQKAAAA

SEQ ID NO: 8265 - protein, 11 aa, Neisseria
LVSEKVAEFVR

SEQ ID NO: 8266 - protein, 6 aa, Neisseria
QQGRQS

SEQ ID NO: 8267 - protein, 15 aa, Neisseria
KALRDEGEKARKQVL

SEQ ID NO: 8268 - protein, 8 aa, Neisseria
ATAEEVLE

SEQ ID NO: 8269 - protein, 13 aa, Neisseria
TLNKAGEEDKDLV

SEQ ID NO: 8270 - protein, 11 aa, Neisseria
LLLGIIGIFLP

SEQ ID NO: 8271 - protein, 8 aa, Neisseria
RFYRWLHR

SEQ ID NO: 8272 - protein, 5 aa, Neisseria
PMVHN

SEQ ID NO: 8273 - protein, 9 aa, Neisseria
FPQRWWVGA

SEQ ID NO: 8274 - protein, 10 aa, Neisseria
SSVFCSLVAI

SEQ ID NO: 8275 - protein, 7 aa, Neisseria
KASPRFY

SEQ ID NO: 8276 - protein, 9 aa, Neisseria
LHRHRYFGP

SEQ ID NO: 8277 - protein, 12 aa, Neisseria
WEQNGAVPRKAK

SEQ ID NO: 8278 - protein, 5 aa, Neisseria
RRPES

SEQ ID NO: 8279 - protein, 8 aa, Neisseria
GAVPRKAK

SEQ ID NO: 8280 - protein, 5 aa, Neisseria
RRPES

SEQ ID NO: 8281 - protein, 9 aa, Neisseria
SGRIISIAA

SEQ ID NO: 8282 - protein, 10 aa, Neisseria
KMPPEMVYRA

SEQ ID NO: 8283 - protein, 13 aa, Neisseria
RKMKKMTMCTRRV

SEQ ID NO: 8284 - protein, 11 aa, Neisseria
PFKSPQTKMPP

SEQ ID NO: 8285 - protein, 8 aa, Neisseria
ASSSRMKG

SEQ ID NO: 8286 - protein, 16 aa, Neisseria
DAPKTKLNGMRKSNVQ

SEQ ID NO: 8287 - protein, 13 aa, Neisseria
RKMKKMTMCTRRV

SEQ ID NO: 8288 - protein, 8 aa, Neisseria
SPQTKMPP

SEQ ID NO: 8289 - protein, 7 aa, Neisseria
SSSRMKG

SEQ ID NO: 8290 - protein, 16 aa, Neisseria
DAPKTKLNGMRKSNVQ

SEQ ID NO: 8291 - protein, 17 aa, Neisseria
WHHHYGKITAFWTLLFL

SEQ ID NO: 8292 - protein, 6 aa, Neisseria
TVAHAL

SEQ ID NO: 8293 - protein, 10 aa, Neisseria
VGTALASIMG

SEQ ID NO: 8294 - protein, 7 aa, Neisseria
IGGGLTP

SEQ ID NO: 8295 - protein, 6 aa, Neisseria
FLKGVD

SEQ ID NO: 8296 - protein, 6 aa, Neisseria
AIFGKW

SEQ ID NO: 8297 - protein, 5 aa, Neisseria
VVGAV

SEQ ID NO: 8298 - protein, 5 aa, Neisseria
LQNLV

SEQ ID NO: 8299 - protein, 45 aa, Neisseria
IAEVGKLFLGIFITIFPVLSILKAGEAGALGGVVSLVHDTAGHPI

SEQ ID NO: 8300 - protein, 10 aa, Neisseria
GILSAFLDNA

SEQ ID NO: 8301 - protein, 8 aa, Neisseria
FHSLLAVS

SEQ ID NO: 8302 - protein, 17 aa, Neisseria
FMGALTYIGNAPNFMVK

SEQ ID NO: 8303 - protein, 5 aa, Neisseria
TFFGY

SEQ ID NO: 8304 - protein, 6 aa, Neisseria
DLDGAN

SEQ ID NO: 8305 - protein, 8 aa, Neisseria
DLNGTPKL

SEQ ID NO: 8306 - protein, 12 aa, Neisseria
LLKANQNRTRRV

SEQ ID NO: 8307 - protein, 5 aa, Neisseria
NIGGG

SEQ ID NO: 8308 - protein, 7 aa, Neisseria
TPLGDPP

SEQ ID NO: 8309 - protein, 21 aa, Neisseria
RFFKQESIAQDTPAQQEKPEK

SEQ ID NO: 8310 - protein, 10 aa, Neisseria
GLWKPEHPGF

SEQ ID NO: 8311 - protein, 13 aa, Neisseria
TPKQVRAGNEFNF

SEQ ID NO: 8312 - protein, 5 aa, Neisseria
DTAGH

SEQ ID NO: 8313 - protein, 5 aa, Neisseria
AGGDA

SEQ ID NO: 8314 - protein, 9 aa, Neisseria
AIAEQRGVP

SEQ ID NO: 8315 - protein, 8 aa, Neisseria
NQNRTRRV

SEQ ID NO: 8316 - protein, 5 aa, Neisseria
ESIAQ

SEQ ID NO: 8317 - protein, 10 aa, Neisseria
TPAQQEKPEK

SEQ ID NO: 8318 - protein, 7 aa, Neisseria
WKPEHPG

SEQ ID NO: 8319 - protein, 7 aa, Neisseria
KQVRAGN

SEQ ID NO: 8320 - protein, 8 aa, Neisseria
AIAEQRGV

SEQ ID NO: 8321 - protein, 23 aa, Neisseria
CGPPNSCVSMLAAFSDGTSAPAA

SEQ ID NO: 8322 - protein, 7 aa, Neisseria
QTWILRS

SEQ ID NO: 8323 - protein, 10 aa, Neisseria
KPAGCGPPNS

SEQ ID NO: 8324 - protein, 7 aa, Neisseria
FSDGTSA

SEQ ID NO: 8325 - protein, 16 aa, Neisseria
SVKRLNTNRPRLKSSA

SEQ ID NO: 8326 - protein, 8 aa, Neisseria
MANGSAST

SEQ ID NO: 8327 - protein, 23 aa, Neisseria
GRVRSAVHKPDWIRLRRTSSPLK

SEQ ID NO: 8328 - protein, 16 aa, Neisseria
SVKRLNTNRPRLKSSA

SEQ ID NO: 8329 - protein, 9 aa, Neisseria
GRVRSAVHK

SEQ ID NO: 8330 - protein, 10 aa, Neisseria
DWIRLRRTSS

SEQ ID NO: 8331 - protein, 7 aa, Neisseria
RWSDVFS

SEQ ID NO: 8332 - protein, 8 aa, Neisseria
ISRLPRTF

SEQ ID NO: 8333 - protein, 8 aa, Neisseria
VAALIGML

SEQ ID NO: 8334 - protein, 11 aa, Neisseria
IFGGVIEAVAT

SEQ ID NO: 8335 - protein, 9 aa, Neisseria
MLGVWQQGD

SEQ ID NO: 8336 - protein, 6 aa, Neisseria
ILGLGE

SEQ ID NO: 8337 - protein, 17 aa, Neisseria
VVPNIISRLMGDRLRQS

SEQ ID NO: 8338 - protein, 5 aa, Neisseria
IIGRV

SEQ ID NO: 8339 - protein, 6 aa, Neisseria
TVFGVL

SEQ ID NO: 8340 - protein, 6 aa, Neisseria
SLSDSQ

SEQ ID NO: 8341 - protein, 5 aa, Neisseria
RLPRT

SEQ ID NO: 8342 - protein, 13 aa, Neisseria
NRFVEPSMVGASQ

SEQ ID NO: 8343 - protein, 7 aa, Neisseria
RRLPPTA

SEQ ID NO: 8344 - protein, 9 aa, Neisseria
LMGDRLRQS

SEQ ID NO: 8345 - protein, 8 aa, Neisseria
LMGDRLRQ

SEQ ID NO: 8346 - protein, 7 aa, Neisseria
FLEKIEP

SEQ ID NO: 8347 - protein, 6 aa, Neisseria
WYALYE

SEQ ID NO: 8348 - protein, 11 aa, Neisseria
LFPAMFYGMYN

SEQ ID NO: 8349 - protein, 14 aa, Neisseria
LLQQNIANDWHYAF

SEQ ID NO: 8350 - protein, 8 aa, Neisseria
GFWEVLFA

SEQ ID NO: 8351 - protein, 8 aa, Neisseria
FGGTGKNF

SEQ ID NO: 8352 - protein, 14 aa, Neisseria
AVDGYSGATALAQW

SEQ ID NO: 8353 - protein, 8 aa, Neisseria
ADGLKNAV

SEQ ID NO: 8354 - protein, 15 aa, Neisseria
DAFIGKLPGSIGEVS

SEQ ID NO: 8355 - protein, 14 aa, Neisseria
FARIASWRIIAGVM

SEQ ID NO: 8356 - protein, 9 aa, Neisseria
IAMSSLFNF

SEQ ID NO: 8357 - protein, 26 aa, Neisseria
VSASFTNVGKWWYGALIGVMCVLIRV

SEQ ID NO: 8358 - protein, 14 aa, Neisseria
ILFANLFAPIFDYF

SEQ ID NO: 8359 - protein, 6 aa, Neisseria
FLEKIE

SEQ ID NO: 8360 - protein, 7 aa, Neisseria
PGGKHEK

SEQ ID NO: 8361 - protein, 20 aa, Neisseria
SGAVTRKAAHVRDALDSKRM

SEQ ID NO: 8362 - protein, 12 aa, Neisseria
NMSSEAGVSDKM

SEQ ID NO: 8363 - protein, 8 aa, Neisseria
VRKHEINE

SEQ ID NO: 8364 - protein, 10 aa, Neisseria
VFGGTGKNFM

SEQ ID NO: 8365 - protein, 9 aa, Neisseria
YPANLSGDA

SEQ ID NO: 8366 - protein, 6 aa, Neisseria
GADGLK

SEQ ID NO: 8367 - protein, 6 aa, Neisseria
LPGSIG

SEQ ID NO: 8368 - protein, 6 aa, Neisseria
GSDTNA

SEQ ID NO: 8369 - protein, 11 aa, Neisseria
NIKRRKARSNG

SEQ ID NO: 8370 - protein, 6 aa, Neisseria
FLEKIE

SEQ ID NO: 8371 - protein, 5 aa, Neisseria
GKHEK

SEQ ID NO: 8372 - protein, 18 aa, Neisseria
AVTRKAAHVRDALDSKRM

SEQ ID NO: 8373 - protein, 9 aa, Neisseria
MSSEAGVSD

SEQ ID NO: 8374 - protein, 7 aa, Neisseria
VRKHEIN

SEQ ID NO: 8375 - protein, 11 aa, Neisseria
NIKRRKARSNG

SEQ ID NO: 8376 - protein, 7 aa, Neisseria
IVDIVEH

SEQ ID NO: 8377 - protein, 11 aa, Neisseria
DIVEYFEPLGK

SEQ ID NO: 8378 - protein, 13 aa, Neisseria
PFGNVVADDLRTG

SEQ ID NO: 8379 - protein, 6 aa, Neisseria
RIGRTM

SEQ ID NO: 8380 - protein, 13 aa, Neisseria
ERYVRRVYGYGTP

SEQ ID NO: 8381 - protein, 12 aa, Neisseria
PVAFDGCGTVGR

SEQ ID NO: 8382 - protein, 10 aa, Neisseria
SQFERIARPG

SEQ ID NO: 8383 - protein, 5 aa, Neisseria
ADGDI

SEQ ID NO: 8384 - protein, 6 aa, Neisseria
PLGKHQ

SEQ ID NO: 8385 - protein, 7 aa, Neisseria
VDGETQI

SEQ ID NO: 8386 - protein, 8 aa, Neisseria
AGIGKNAV

SEQ ID NO: 8387 - protein, 13 aa, Neisseria
VADDLRTGCVPNG

SEQ ID NO: 8388 - protein, 6 aa, Neisseria
QSRVAD

SEQ ID NO: 8389 - protein, 6 aa, Neisseria
YADRII

SEQ ID NO: 8390 - protein, 8 aa, Neisseria
NQGARGSF

SEQ ID NO: 8391 - protein, 6 aa, Neisseria
INTGIH

SEQ ID NO: 8392 - protein, 15 aa, Neisseria
HTGTGNGQVAERYVR

SEQ ID NO: 8393 - protein, 5 aa, Neisseria
YGYGT

SEQ ID NO: 8394 - protein, 16 aa, Neisseria
DGCGTVGRPFNRNRFV

SEQ ID NO: 8395 - protein, 17 aa, Neisseria
AGSQFERIARPGAGKCG

SEQ ID NO: 8396 - protein, 5 aa, Neisseria
ADGDI

SEQ ID NO: 8397 - protein, 7 aa, Neisseria
VDGETQI

SEQ ID NO: 8398 - protein, 7 aa, Neisseria
VADDLRT

SEQ ID NO: 8399 - protein, 5 aa, Neisseria
SRVAD

SEQ ID NO: 8400 - protein, 8 aa, Neisseria
QVAERYVR

SEQ ID NO: 8401 - protein, 11 aa, Neisseria
QFERIARPGAG

SEQ ID NO: 8402 - protein, 5 aa, Neisseria
YKNNR

SEQ ID NO: 8403 - protein, 7 aa, Neisseria
LKVFDNI

SEQ ID NO: 8404 - protein, 14 aa, Neisseria
VNYSDIHDNIINKA

SEQ ID NO: 8405 - protein, 10 aa, Neisseria
YDKLFANHFE

SEQ ID NO: 8406 - protein, 5 aa, Neisseria
APVSR

SEQ ID NO: 8407 - protein, 8 aa, Neisseria
QFPAVLPG

SEQ ID NO: 8408 - protein, 8 aa, Neisseria
DELLKEVE

SEQ ID NO: 8409 - protein, 5 aa, Neisseria
EETAP

SEQ ID NO: 8410 - protein, 8 aa, Neisseria
HNNILDNS

SEQ ID NO: 8411 - protein, 10 aa, Neisseria
AMVRENKIVG

SEQ ID NO: 8412 - protein, 11 aa, Neisseria
ATLRVNERGNG

SEQ ID NO: 8413 - protein, 28 aa, Neisseria
GNDISKGRDGIFSNTSTHNTYKNNRFSD

SEQ ID NO: 8414 - protein, 9 aa, Neisseria
YTNDSEISG

SEQ ID NO: 8415 - protein, 6 aa, Neisseria
ISVGNN

SEQ ID NO: 8416 - protein, 5 aa, Neisseria
ERLKV

SEQ ID NO: 8417 - protein, 8 aa, Neisseria
VGSRDQGI

SEQ ID NO: 8418 - protein, 13 aa, Neisseria
SDIHDNIINKAGK

SEQ ID NO: 8419 - protein, 20 aa, Neisseria
EGTSLHDNSFINNESQVKYV

SEQ ID NO: 8420 - protein, 16 aa, Neisseria
DWSEGGHGNYWSDNSA

SEQ ID NO: 8421 - protein, 17 aa, Neisseria
LNGDGFGDSAYRPNGII

SEQ ID NO: 8422 - protein, 19 aa, Neisseria
GGVVDSKPLMKPYAPKIQT

SEQ ID NO: 8423 - protein, 27 aa, Neisseria
QAMKDELLKEVETRQSEWGRAENGSLN

SEQ ID NO: 8424 - protein, 10 aa, Neisseria
AMVRENKIVG

SEQ ID NO: 8425 - protein, 10 aa, Neisseria
ATLRVNERGN

SEQ ID NO: 8426 - protein, 9 aa, Neisseria
DISKGRDGI

SEQ ID NO: 8427 - protein, 8 aa, Neisseria
YKNNRFSD

SEQ ID NO: 8428 - protein, 7 aa, Neisseria
NDSEISG

SEQ ID NO: 8429 - protein, 5 aa, Neisseria
ERLKV

SEQ ID NO: 8430 - protein, 6 aa, Neisseria
GSRDQG

SEQ ID NO: 8431 - protein, 8 aa, Neisseria
VVDSKPLM

SEQ ID NO: 8432 - protein, 25 aa, Neisseria
QAMKDELLKEVETRQSEWGRAENGS

SEQ ID NO: 8433 - protein, 8 aa, Neisseria
SILKSIGI

SEQ ID NO: 8434 - protein, 6 aa, Neisseria
SIKRMS

SEQ ID NO: 8435 - protein, 17 aa, Neisseria
LPAYAERLPDFLAKIQP

SEQ ID NO: 8436 - protein, 5 aa, Neisseria
RYGKP

SEQ ID NO: 8437 - protein, 7 aa, Neisseria
AKLVDHH

SEQ ID NO: 8438 - protein, 11 aa, Neisseria
IPHLPAPGRAI

SEQ ID NO: 8439 - protein, 6 aa, Neisseria
SNWLPA

SEQ ID NO: 8440 - protein, 10 aa, Neisseria
KRMSAFRARI

SEQ ID NO: 8441 - protein, 8 aa, Neisseria
YAERLPDF

SEQ ID NO: 8442 - protein, 24 aa, Neisseria
AKIQPSEIFPGADRYGKPEGKPMV

SEQ ID NO: 8443 - protein, 9 aa, Neisseria
RVYKGDEQL

SEQ ID NO: 8444 - protein, 13 aa, Neisseria
AVNTRGYSSKPID

SEQ ID NO: 8445 - protein, 7 aa, Neisseria
KLVDHHE

SEQ ID NO: 8446 - protein, 9 aa, Neisseria
LPAPGRAIR

SEQ ID NO: 8447 - protein, 9 aa, Neisseria
NRLRLKGLP

SEQ ID NO: 8448 - protein, 9 aa, Neisseria
VPQPSKATG

SEQ ID NO: 8449 - protein, 10 aa, Neisseria
KRMSAFRARI

SEQ ID NO: 8450 - protein, 6 aa, Neisseria
YAERLP

SEQ ID NO: 8451 - protein, 15 aa, Neisseria
PGADRYGKPEGKPMV

SEQ ID NO: 8452 - protein, 8 aa, Neisseria
VYKGDEQL

SEQ ID NO: 8453 - protein, 7 aa, Neisseria
KLVDHHE

SEQ ID NO: 8454 - protein, 7 aa, Neisseria
APGRAIR

SEQ ID NO: 8455 - protein, 7 aa, Neisseria
NRLRLKG

SEQ ID NO: 8456 - protein, 7 aa, Neisseria
QPSKATG

SEQ ID NO: 8457 - protein, 8 aa, Neisseria
IKHIVRAF

SEQ ID NO: 8458 - protein, 21 aa, Neisseria
GVSAFKTLRTQEFLQHLRGGV

SEQ ID NO: 8459 - protein, 5 aa, Neisseria
FRGEG

SEQ ID NO: 8460 - protein, 5 aa, Neisseria
DDVRL

SEQ ID NO: 8461 - protein, 15 aa, Neisseria
DVAVKNLGNLMAAPD

SEQ ID NO: 8462 - protein, 19 aa, Neisseria
FQIFKDVFHNAVRHADQLQ

SEQ ID NO: 8463 - protein, 8 aa, Neisseria
VDGVTDGA

SEQ ID NO: 8464 - protein, 11 aa, Neisseria
QVDDFGEFAVF

SEQ ID NO: 8465 - protein, 5 aa, Neisseria
FRGVD

SEQ ID NO: 8466 - protein, 28 aa, Neisseria
HLQTLRDLRFIAELLQWLQHQRAFDAGT

SEQ ID NO: 8467 - protein, 6 aa, Neisseria
PRNPQD

SEQ ID NO: 8468 - protein, 10 aa, Neisseria
MRHPPQSAAL

SEQ ID NO: 8469 - protein, 18 aa, Neisseria
LLHRPKSVCRRRKCRLKA

SEQ ID NO: 8470 - protein, 8 aa, Neisseria
PLSDGIAC

SEQ ID NO: 8471 - protein, 7 aa, Neisseria
VQQEGCG

SEQ ID NO: 8472 - protein, 18 aa, Neisseria
LYEDKESGDDFADKDFLQ

SEQ ID NO: 8473 - protein, 7 aa, Neisseria
EAADVFR

SEQ ID NO: 8474 - protein, 8 aa, Neisseria
AGDGGKAG

SEQ ID NO: 8475 - protein, 8 aa, Neisseria
FGGGADKL

SEQ ID NO: 8476 - protein, 15 aa, Neisseria
FKNREGADVDSDIAG

SEQ ID NO: 8477 - protein, 7 aa, Neisseria
KTLRTQE

SEQ ID NO: 8478 - protein, 11 aa, Neisseria
FRGEGFDDVRL

SEQ ID NO: 8479 - protein, 11 aa, Neisseria
GDGGNRRNGMA

SEQ ID NO: 8480 - protein, 5 aa, Neisseria
DEFDV

SEQ ID NO: 8481 - protein, 21 aa, Neisseria
RHADQLQAAADKDVLERAQTG

SEQ ID NO: 8482 - protein, 5 aa, Neisseria
HGGCR

SEQ ID NO: 8483 - protein, 12 aa, Neisseria
FGIDAVDGVTDG

SEQ ID NO: 8484 - protein, 12 aa, Neisseria
CFGDEQQVDDFG

SEQ ID NO: 8485 - protein, 10 aa, Neisseria
FGGNEEEVAL

SEQ ID NO: 8486 - protein, 5 aa, Neisseria
VDVNG

SEQ ID NO: 8487 - protein, 8 aa, Neisseria
CNRRAGGF

SEQ ID NO: 8488 - protein, 5 aa, Neisseria
FGNTQ

SEQ ID NO: 8489 - protein, 8 aa, Neisseria
QTLRDLRF

SEQ ID NO: 8490 - protein, 11 aa, Neisseria
RAFDAGTQRNG

SEQ ID NO: 8491 - protein, 11 aa, Neisseria
VMPRNPQDFLD

SEQ ID NO: 8492 - protein, 7 aa, Neisseria
EGQQQTR

SEQ ID NO: 8493 - protein, 5 aa, Neisseria
MRHPP

SEQ ID NO: 8494 - protein, 18 aa, Neisseria
LLHRPKSVCRRRKCRLKA

SEQ ID NO: 8495 - protein, 17 aa, Neisseria
LYEDKESGDDFADKDFL

SEQ ID NO: 8496 - protein, 7 aa, Neisseria
EAADVFR

SEQ ID NO: 8497 - protein, 5 aa, Neisseria
DGGKA

SEQ ID NO: 8498 - protein, 5 aa, Neisseria
GADKL

SEQ ID NO: 8499 - protein, 13 aa, Neisseria
FKNREGADVDSDI

SEQ ID NO: 8500 - protein, 5 aa, Neisseria
KTLRT

SEQ ID NO: 8501 - protein, 8 aa, Neisseria
EGFDDVRL

SEQ ID NO: 8502 - protein, 10 aa, Neisseria
GDGGNRRNGM

SEQ ID NO: 8503 - protein, 5 aa, Neisseria
DEFDV

SEQ ID NO: 8504 - protein, 20 aa, Neisseria
RHADQLQAAADKDVLERAQT

SEQ ID NO: 8505 - protein, 8 aa, Neisseria
AVDGVTDG

SEQ ID NO: 8506 - protein, 12 aa, Neisseria
CFGDEQQVDDFG

SEQ ID NO: 8507 - protein, 8 aa, Neisseria
GNEEEVAL

SEQ ID NO: 8508 - protein, 6 aa, Neisseria
CNRRAG

SEQ ID NO: 8509 - protein, 7 aa, Neisseria
TLRDLRF

SEQ ID NO: 8510 - protein, 6 aa, Neisseria
GTQRNG

SEQ ID NO: 8511 - protein, 5 aa, Neisseria
RNPQD

SEQ ID NO: 8512 - protein, 5 aa, Neisseria
EGQQQ

SEQ ID NO: 8513 - protein, 28 aa, Neisseria
MDTAAFLKHIESAFRRIFSDGIDLMRYL

SEQ ID NO: 8514 - protein, 12 aa, Neisseria
QFEIQEVLRIAG

SEQ ID NO: 8515 - protein, 8 aa, Neisseria
QPLQEFGD

SEQ ID NO: 8516 - protein, 12 aa, Neisseria
REMQSYYEYIDG

SEQ ID NO: 8517 - protein, 5 aa, Neisseria
YWQGN

SEQ ID NO: 8518 - protein, 8 aa, Neisseria
LAKVIDLL

SEQ ID NO: 8519 - protein, 8 aa, Neisseria
AGLRAFQN

SEQ ID NO: 8520 - protein, 19 aa, Neisseria
MTHGIMEYILENLERYVRN

SEQ ID NO: 8521 - protein, 9 aa, Neisseria
EILYRYVCH

SEQ ID NO: 8522 - protein, 9 aa, Neisseria
VSPVAPVAH

SEQ ID NO: 8523 - protein, 8 aa, Neisseria
ANIVKTLA

SEQ ID NO: 8524 - protein, 5 aa, Neisseria
QMLQK

SEQ ID NO: 8525 - protein, 8 aa, Neisseria
FTIFEGPN

SEQ ID NO: 8526 - protein, 13 aa, Neisseria
MLYAEIYDQFVRA

SEQ ID NO: 8527 - protein, 5 aa, Neisseria
DRLQT

SEQ ID NO: 8528 - protein, 8 aa, Neisseria
LPEDIRSF

SEQ ID NO: 8529 - protein, 7 aa, Neisseria
GKIIARL

SEQ ID NO: 8530 - protein, 12 aa, Neisseria
HTEPSAQPSTMD

SEQ ID NO: 8531 - protein, 5 aa, Neisseria
IESAF

SEQ ID NO: 8532 - protein, 7 aa, Neisseria
IFSDGID

SEQ ID NO: 8533 - protein, 7 aa, Neisseria
LPEDKWL

SEQ ID NO: 8534 - protein, 16 aa, Neisseria
FLDKKYGGRKGSQFEI

SEQ ID NO: 8535 - protein, 8 aa, Neisseria
EFGDEAQV

SEQ ID NO: 8536 - protein, 9 aa, Neisseria
FKGEGGGLG

SEQ ID NO: 8537 - protein, 7 aa, Neisseria
TEPETSG

SEQ ID NO: 8538 - protein, 8 aa, Neisseria
AIAREMQS

SEQ ID NO: 8539 - protein, 8 aa, Neisseria
YEYIDGQT

SEQ ID NO: 8540 - protein, 10 aa, Neisseria
YWQGNSQSDF

SEQ ID NO: 8541 - protein, 11 aa, Neisseria
AKERKNGKLAK

SEQ ID NO: 8542 - protein, 5 aa, Neisseria
KTYIR

SEQ ID NO: 8543 - protein, 9 aa, Neisseria
ETLASEGLR

SEQ ID NO: 8544 - protein, 9 aa, Neisseria
AVNRIDAEM

SEQ ID NO: 8545 - protein, 8 aa, Neisseria
LSQSDAAG

SEQ ID NO: 8546 - protein, 26 aa, Neisseria
NLERYVRNDIKFVDYERREIRRRHQV

SEQ ID NO: 8547 - protein, 11 aa, Neisseria
KGFERGHTAGN

SEQ ID NO: 8548 - protein, 7 aa, Neisseria
EGPNDML

SEQ ID NO: 8549 - protein, 28 aa, Neisseria
ATAEEKEAGMKLDKNQTLLDRLQTDARF

SEQ ID NO: 8550 - protein, 16 aa, Neisseria
AVARDYTLPEDIRSFL

SEQ ID NO: 8551 - protein, 7 aa, Neisseria
AKHEDTA

SEQ ID NO: 8552 - protein, 13 aa, Neisseria
DIRKDILDCRYCG

SEQ ID NO: 8553 - protein, 5 aa, Neisseria
IESAF

SEQ ID NO: 8554 - protein, 7 aa, Neisseria
IFSDGID

SEQ ID NO: 8555 - protein, 7 aa, Neisseria
LPEDKWL

SEQ ID NO: 8556 - protein, 12 aa, Neisseria
LDKKYGGRKGSQ

SEQ ID NO: 8557 - protein, 8 aa, Neisseria
EFGDEAQV

SEQ ID NO: 8558 - protein, 6 aa, Neisseria
FKGEGG

SEQ ID NO: 8559 - protein, 7 aa, Neisseria
TEPETSG

SEQ ID NO: 8560 - protein, 8 aa, Neisseria
AIAREMQS

SEQ ID NO: 8561 - protein, 11 aa, Neisseria
AKERKNGKLAK

SEQ ID NO: 8562 - protein, 9 aa, Neisseria
AVNRIDAEM

SEQ ID NO: 8563 - protein, 7 aa, Neisseria
SQSDAAG

SEQ ID NO: 8564 - protein, 26 aa, Neisseria
NLERYVRNDIKFVDYERREIRRRHQV

SEQ ID NO: 8565 - protein, 8 aa, Neisseria
KGFERGHT

SEQ ID NO: 8566 - protein, 28 aa, Neisseria
ATAEEKEAGMKLDKNQTLLDRLQTDARF

SEQ ID NO: 8567 - protein, 7 aa, Neisseria
EDIRSFL

SEQ ID NO: 8568 - protein, 7 aa, Neisseria
AKHEDTA

SEQ ID NO: 8569 - protein, 8 aa, Neisseria
DIRKDILD

SEQ ID NO: 8570 - protein, 8 aa, Neisseria
NTLNRCCK

SEQ ID NO: 8571 - protein, 11 aa, Neisseria
RTLPSLKGLTK

SEQ ID NO: 8572 - protein, 28 aa, Neisseria
VEQSNTLNRCCKKSRMTCSSSRSRSCPC

SEQ ID NO: 8573 - protein, 15 aa, Neisseria
PMRASGSRVSSRSRI

SEQ ID NO: 8574 - protein, 25 aa, Neisseria
SLCRKNTCPPRLSSRNTASRTLPSL

SEQ ID NO: 8575 - protein, 8 aa, Neisseria
LTARRRLG

SEQ ID NO: 8576 - protein, 10 aa, Neisseria
ISEKSRSPSN

SEQ ID NO: 8577 - protein, 10 aa, Neisseria
TLARRRLSCS

SEQ ID NO: 8578 - protein, 5 aa, Neisseria
QSNTL

SEQ ID NO: 8579 - protein, 19 aa, Neisseria
RCCKKSRMTCSSSRSRSCP

SEQ ID NO: 8580 - protein, 14 aa, Neisseria
MRASGSRVSSRSRI

SEQ ID NO: 8581 - protein, 7 aa, Neisseria
LCRKNTC

SEQ ID NO: 8582 - protein, 12 aa, Neisseria
PRLSSRNTASRT

SEQ ID NO: 8583 - protein, 8 aa, Neisseria
LTARRRLG

SEQ ID NO: 8584 - protein, 9 aa, Neisseria
ISEKSRSPS

SEQ ID NO: 8585 - protein, 8 aa, Neisseria
TLARRRLS

SEQ ID NO: 8586 - protein, 10 aa, Neisseria
GKVCRCFEQV

SEQ ID NO: 8587 - protein, 10 aa, Neisseria
TVFRQIISIV

SEQ ID NO: 8588 - protein, 8 aa, Neisseria
GLVKERAR

SEQ ID NO: 8589 - protein, 6 aa, Neisseria
KVCRCF

SEQ ID NO: 8590 - protein, 10 aa, Neisseria
GTVGQTERGT

SEQ ID NO: 8591 - protein, 15 aa, Neisseria
ADAERTAAHSRGTRG

SEQ ID NO: 8592 - protein, 8 aa, Neisseria
GLVKERAR

SEQ ID NO: 8593 - protein, 8 aa, Neisseria
VGQTERGT

SEQ ID NO: 8594 - protein, 15 aa, Neisseria
ADAERTAAHSRGTRG

SEQ ID NO: 8595 - protein, 7 aa, Neisseria
RIERAVR

SEQ ID NO: 8596 - protein, 9 aa, Neisseria
AVIDVLNVD

SEQ ID NO: 8597 - protein, 8 aa, Neisseria
ALADIRVL

SEQ ID NO: 8598 - protein, 13 aa, Neisseria
AVDLHAVIKLTDT

SEQ ID NO: 8599 - protein, 6 aa, Neisseria
QGVEQG

SEQ ID NO: 8600 - protein, 17 aa, Neisseria
RRLKHFKEGNAAGMPRF

SEQ ID NO: 8601 - protein, 9 aa, Neisseria
ARTLGNVFH

SEQ ID NO: 8602 - protein, 17 aa, Neisseria
GSGIDGIQTIVAFNQHT

SEQ ID NO: 8603 - protein, 13 aa, Neisseria
MNRRDARIERAVR

SEQ ID NO: 8604 - protein, 24 aa, Neisseria
DAPGSGTLLHQRGKQVGSRNDALA

SEQ ID NO: 8605 - protein, 18 aa, Neisseria
GKKRFVQSRNLVGRKQRN

SEQ ID NO: 8606 - protein, 11 aa, Neisseria
MPQGVEQGCRA

SEQ ID NO: 8607 - protein, 15 aa, Neisseria
TGFDRRLKHFKEGNA

SEQ ID NO: 8608 - protein, 13 aa, Neisseria
TADTSGIDADART

SEQ ID NO: 8609 - protein, 9 aa, Neisseria
NRAGSGIDG

SEQ ID NO: 8610 - protein, 13 aa, Neisseria
MNRRDARIERAVR

SEQ ID NO: 8611 - protein, 14 aa, Neisseria
QRGKQVGSRNDALA

SEQ ID NO: 8612 - protein, 7 aa, Neisseria
GKKRFVQ

SEQ ID NO: 8613 - protein, 9 aa, Neisseria
NLVGRKQRN

SEQ ID NO: 8614 - protein, 9 aa, Neisseria
QGVEQGCRA

SEQ ID NO: 8615 - protein, 15 aa, Neisseria
TGFDRRLKHFKEGNA

SEQ ID NO: 8616 - protein, 12 aa, Neisseria
ADTSGIDADART

SEQ ID NO: 8617 - protein, 11 aa, Neisseria
AILLSAILGLV

SEQ ID NO: 8618 - protein, 10 aa, Neisseria
RDTKHIRKAN

SEQ ID NO: 8619 - protein, 5 aa, Neisseria
SQGNV

SEQ ID NO: 8620 - protein, 6 aa, Neisseria
ELRENK

SEQ ID NO: 8621 - protein, 8 aa, Neisseria
RKAFRSLP

SEQ ID NO: 8622 - protein, 5 aa, Neisseria
MSVKK

SEQ ID NO: 8623 - protein, 18 aa, Neisseria
GTSEPAHRDTKHIRKANK

SEQ ID NO: 8624 - protein, 14 aa, Neisseria
LHPECRKYLERRAA

SEQ ID NO: 8625 - protein, 20 aa, Neisseria
RSQGNVQELRENKKARKAFR

SEQ ID NO: 8626 - protein, 7 aa, Neisseria
AEQKIQC

SEQ ID NO: 8627 - protein, 12 aa, Neisseria
AFDDFDGGSFRR

SEQ ID NO: 8628 - protein, 5 aa, Neisseria
MSVKK

SEQ ID NO: 8629 - protein, 18 aa, Neisseria
GTSEPAHRDTKHIRKANK

SEQ ID NO: 8630 - protein, 12 aa, Neisseria
PECRKYLERRAA

SEQ ID NO: 8631 - protein, 17 aa, Neisseria
GNVQELRENKKARKAFR

SEQ ID NO: 8632 - protein, 7 aa, Neisseria
AEQKIQC

SEQ ID NO: 8633 - protein, 12 aa, Neisseria
AFDDFDGGSFRR

SEQ ID NO: 8634 - protein, 5 aa, Neisseria
SVCPG

SEQ ID NO: 8635 - protein, 7 aa, Neisseria
LWGELRQ

SEQ ID NO: 8636 - protein, 8 aa, Neisseria
PELVRRHE

SEQ ID NO: 8637 - protein, 6 aa, Neisseria
FNRVIN

SEQ ID NO: 8638 - protein, 5 aa, Neisseria
SGLWQ

SEQ ID NO: 8639 - protein, 14 aa, Neisseria
NYLQYLYGLFGDWP

SEQ ID NO: 8640 - protein, 10 aa, Neisseria
NVGRAINRAR

SEQ ID NO: 8641 - protein, 7 aa, Neisseria
LRMPNET

SEQ ID NO: 8642 - protein, 12 aa, Neisseria
EAIARLAGITQS

SEQ ID NO: 8643 - protein, 9 aa, Neisseria
SNYLNAAPD

SEQ ID NO: 8644 - protein, 7 aa, Neisseria
ISTATGM

SEQ ID NO: 8645 - protein, 10 aa, Neisseria
IADIKRLNNL

SEQ ID NO: 8646 - protein, 8 aa, Neisseria
KTLQTASE

SEQ ID NO: 8647 - protein, 6 aa, Neisseria
ADELMQ

SEQ ID NO: 8648 - protein, 6 aa, Neisseria
LRRQAE

SEQ ID NO: 8649 - protein, 14 aa, Neisseria
TISAVIGTPDTVAE

SEQ ID NO: 8650 - protein, 7 aa, Neisseria
ASIHRVV

SEQ ID NO: 8651 - protein, 6 aa, Neisseria
DTFKSI

SEQ ID NO: 8652 - protein, 5 aa, Neisseria
DIRRL

SEQ ID NO: 8653 - protein, 5 aa, Neisseria
MSKLK

SEQ ID NO: 8654 - protein, 6 aa, Neisseria
QNTSSH

SEQ ID NO: 8655 - protein, 15 aa, Neisseria
LNSSILDLPPTKQYF

SEQ ID NO: 8656 - protein, 24 aa, Neisseria
GELRQGFRMGEVNPELVRRHESKF

SEQ ID NO: 8657 - protein, 8 aa, Neisseria
VINRSRPY

SEQ ID NO: 8658 - protein, 10 aa, Neisseria
NEVKKRNMPA

SEQ ID NO: 8659 - protein, 11 aa, Neisseria
TKAKSHVGASG

SEQ ID NO: 8660 - protein, 20 aa, Neisseria
ATGRHYGLEKTPVYDGRHDV

SEQ ID NO: 8661 - protein, 37 aa, Neisseria
YNWGEGNVGRAINRARAQGLEPTYENLRMPNETRNYV

SEQ ID NO: 8662 - protein, 10 aa, Neisseria
NISDIDNKPY

SEQ ID NO: 8663 - protein, 14 aa, Neisseria
AVEPDRPLDNEAIA

SEQ ID NO: 8664 - protein, 7 aa, Neisseria
PKSKRKL

SEQ ID NO: 8665 - protein, 6 aa, Neisseria
NAAPDS

SEQ ID NO: 8666 - protein, 12 aa, Neisseria
PAAKTSLSDIST

SEQ ID NO: 8667 - protein, 11 aa, Neisseria
ADIKRLNNLNG

SEQ ID NO: 8668 - protein, 13 aa, Neisseria
LVAKNGKTLQTAS

SEQ ID NO: 8669 - protein, 16 aa, Neisseria
IDIDNTPDTYRSNMPA

SEQ ID NO: 8670 - protein, 5 aa, Neisseria
ARIRP

SEQ ID NO: 8671 - protein, 18 aa, Neisseria
LPQKTVRTEPDPLVRIAE

SEQ ID NO: 8672 - protein, 15 aa, Neisseria
QPQTEKQTAMPSETQ

SEQ ID NO: 8673 - protein, 11 aa, Neisseria
PQNDMQAADEL

SEQ ID NO: 8674 - protein, 14 aa, Neisseria
VARNNLRRQAEETI

SEQ ID NO: 8675 - protein, 16 aa, Neisseria
GTPDTVAEHKISASPQ

SEQ ID NO: 8676 - protein, 25 aa, Neisseria
AAADGKRRVRLETRVAKAADGEAEI

SEQ ID NO: 8677 - protein, 7 aa, Neisseria
RVVEGDT

SEQ ID NO: 8678 - protein, 17 aa, Neisseria
VANNIKGNTIQKGQVLR

SEQ ID NO: 8679 - protein, 19 aa, Neisseria
AQTRIEKVSYTARKGDTFK

SEQ ID NO: 8680 - protein, 11 aa, Neisseria
IDDIRRLNPNL

SEQ ID NO: 8681 - protein, 9 aa, Neisseria
INPGQRVKL

SEQ ID NO: 8682 - protein, 5 aa, Neisseria
MSKLK

SEQ ID NO: 8683 - protein, 22 aa, Neisseria
LRQGFRMGEVNPELVRRHESKF

SEQ ID NO: 8684 - protein, 7 aa, Neisseria
VINRSRP

SEQ ID NO: 8685 - protein, 10 aa, Neisseria
NEVKKRNMPA

SEQ ID NO: 8686 - protein, 7 aa, Neisseria
TKAKSHV

SEQ ID NO: 8687 - protein, 5 aa, Neisseria
YGLEK

SEQ ID NO: 8688 - protein, 9 aa, Neisseria
PVYDGRHDV

SEQ ID NO: 8689 - protein, 10 aa, Neisseria
AINRARAQGL

SEQ ID NO: 8690 - protein, 16 aa, Neisseria
PTYENLRMPNETRNYV

SEQ ID NO: 8691 - protein, 5 aa, Neisseria
SDIDN

SEQ ID NO: 8692 - protein, 13 aa, Neisseria
VEPDRPLDNEAIA

SEQ ID NO: 8693 - protein, 7 aa, Neisseria
PKSKRKL

SEQ ID NO: 8694 - protein, 5 aa, Neisseria
AKTSL

SEQ ID NO: 8695 - protein, 7 aa, Neisseria
ADIKRLN

SEQ ID NO: 8696 - protein, 10 aa, Neisseria
KNGKTLQTAS

SEQ ID NO: 8697 - protein, 10 aa, Neisseria
DIDNTPDTYR

SEQ ID NO: 8698 - protein, 5 aa, Neisseria
ARIRP

SEQ ID NO: 8699 - protein, 15 aa, Neisseria
KTVRTEPDPLVRIAE

SEQ ID NO: 8700 - protein, 14 aa, Neisseria
PQTEKQTAMPSETQ

SEQ ID NO: 8701 - protein, 9 aa, Neisseria
NDMQAADEL

SEQ ID NO: 8702 - protein, 11 aa, Neisseria
NNLRRQAEETI

SEQ ID NO: 8703 - protein, 10 aa, Neisseria
DTVAEHKISA

SEQ ID NO: 8704 - protein, 25 aa, Neisseria
AAADGKRRVRLETRVAKAADGEAEI

SEQ ID NO: 8705 - protein, 5 aa, Neisseria
RVVEG

SEQ ID NO: 8706 - protein, 17 aa, Neisseria
TRIEKVSYTARKGDTFK

SEQ ID NO: 8707 - protein, 8 aa, Neisseria
IDDIRRLN

SEQ ID NO: 8708 - protein, 7 aa, Neisseria
PGQRVKL

SEQ ID NO: 8709 - protein, 5 aa, Neisseria
DIFAR

SEQ ID NO: 8710 - protein, 5 aa, Neisseria
RDGDK

SEQ ID NO: 8711 - protein, 17 aa, Neisseria
KGVLKAVEHVNNQIAQA

SEQ ID NO: 8712 - protein, 10 aa, Neisseria
LYRYLGGAGP

SEQ ID NO: 8713 - protein, 5 aa, Neisseria
VINGG

SEQ ID NO: 8714 - protein, 9 aa, Neisseria
KSFREALRC

SEQ ID NO: 8715 - protein, 8 aa, Neisseria
EIFHALKK

SEQ ID NO: 8716 - protein, 12 aa, Neisseria
AEFAEYLEGLVN

SEQ ID NO: 8717 - protein, 8 aa, Neisseria
AEGIEKGV

SEQ ID NO: 8718 - protein, 18 aa, Neisseria
VNQIGTLSETLKAVDLAK

SEQ ID NO: 8719 - protein, 5 aa, Neisseria
DLAVA

SEQ ID NO: 8720 - protein, 19 aa, Neisseria
SLSRSDRMAKYNQLLRIEE

SEQ ID NO: 8721 - protein, 7 aa, Neisseria
LAEAADY

SEQ ID NO: 8722 - protein, 12 aa, Neisseria
EILDSRGNPTVE

SEQ ID NO: 8723 - protein, 37 aa, Neisseria
AVPSGASTGQKEALELRDGDKSRYSGKGVLKAVEHVN

SEQ ID NO: 8724 - protein, 7 aa, Neisseria
DANEQSY

SEQ ID NO: 8725 - protein, 11 aa, Neisseria
LDGTENKGNLG

SEQ ID NO: 8726 - protein, 9 aa, Neisseria
AAAEDSGLP

SEQ ID NO: 8727 - protein, 6 aa, Neisseria
GGAGPM

SEQ ID NO: 8728 - protein, 9 aa, Neisseria
NGGEHANNS

SEQ ID NO: 8729 - protein, 11 aa, Neisseria
KSFREALRCGA

SEQ ID NO: 8730 - protein, 19 aa, Neisseria
KKLCDSKGFPTTVGDEGGF

SEQ ID NO: 8731 - protein, 9 aa, Neisseria
NLNSHKEAL

SEQ ID NO: 8732 - protein, 23 aa, Neisseria
CASSEFYKDGKYHLEAEGRSYTN

SEQ ID NO: 8733 - protein, 13 aa, Neisseria
SIEDGMDENDWEG

SEQ ID NO: 8734 - protein, 16 aa, Neisseria
LTEKLGGRVQLVGDDL

SEQ ID NO: 8735 - protein, 13 aa, Neisseria
NPKILAEGIEKGV

SEQ ID NO: 8736 - protein, 9 aa, Neisseria
DLAKRNRYA

SEQ ID NO: 8737 - protein, 13 aa, Neisseria
MSHRSGETEDSTI

SEQ ID NO: 8738 - protein, 13 aa, Neisseria
KTGSLSRSDRMAK

SEQ ID NO: 8739 - protein, 16 aa, Neisseria
LRIEEELAEAADYPSK

SEQ ID NO: 8740 - protein, 12 aa, Neisseria
EILDSRGNPTVE

SEQ ID NO: 8741 - protein, 19 aa, Neisseria
TGQKEALELRDGDKSRYSG

SEQ ID NO: 8742 - protein, 7 aa, Neisseria
GVLKAVE

SEQ ID NO: 8743 - protein, 10 aa, Neisseria
LDGTENKGNL

SEQ ID NO: 8744 - protein, 7 aa, Neisseria
AAAEDSG

SEQ ID NO: 8745 - protein, 5 aa, Neisseria
GEHAN

SEQ ID NO: 8746 - protein, 11 aa, Neisseria
KSFREALRCGA

SEQ ID NO: 8747 - protein, 8 aa, Neisseria
KKLCDSKG

SEQ ID NO: 8748 - protein, 7 aa, Neisseria
VGDEGGF

SEQ ID NO: 8749 - protein, 7 aa, Neisseria
NSHKEAL

SEQ ID NO: 8750 - protein, 18 aa, Neisseria
EFYKDGKYHLEAEGRSYT

SEQ ID NO: 8751 - protein, 13 aa, Neisseria
SIEDGMDENDWEG

SEQ ID NO: 8752 - protein, 7 aa, Neisseria
LTEKLGG

SEQ ID NO: 8753 - protein, 10 aa, Neisseria
ILAEGIEKGV

SEQ ID NO: 8754 - protein, 8 aa, Neisseria
DLAKRNRY

SEQ ID NO: 8755 - protein, 12 aa, Neisseria
SHRSGETEDSTI

SEQ ID NO: 8756 - protein, 10 aa, Neisseria
SLSRSDRMAK

SEQ ID NO: 8757 - protein, 15 aa, Neisseria
LRIEEELAEAADYPS

SEQ ID NO: 8758 - protein, 13 aa, Neisseria
MRMPEVTKGFSGS

SEQ ID NO: 8759 - protein, 8 aa, Neisseria
TMRKPRLT

SEQ ID NO: 8760 - protein, 8 aa, Neisseria
ALIFTCFA

SEQ ID NO: 8761 - protein, 9 aa, Neisseria
TALAAITCI

SEQ ID NO: 8762 - protein, 8 aa, Neisseria
LGKMEEFN

SEQ ID NO: 8763 - protein, 15 aa, Neisseria
EPMRMPEVTKGFSGS

SEQ ID NO: 8764 - protein, 8 aa, Neisseria
GCRSTRKT

SEQ ID NO: 8765 - protein, 16 aa, Neisseria
VRPETMRKPRLTNSSA

SEQ ID NO: 8766 - protein, 6 aa, Neisseria
NSGCNA

SEQ ID NO: 8767 - protein, 14 aa, Neisseria
CISGPPCRLGKMEE

SEQ ID NO: 8768 - protein, 14 aa, Neisseria
SRHKITPPRGPRRV

SEQ ID NO: 8769 - protein, 8 aa, Neisseria
TKSQNGTG

SEQ ID NO: 8770 - protein, 10 aa, Neisseria
GYSPPATRPA

SEQ ID NO: 8771 - protein, 10 aa, Neisseria
EPMRMPEVTK

SEQ ID NO: 8772 - protein, 6 aa, Neisseria
RSTRKT

SEQ ID NO: 8773 - protein, 12 aa, Neisseria
RPETMRKPRLTN

SEQ ID NO: 8774 - protein, 10 aa, Neisseria
PPCRLGKMEE

SEQ ID NO: 8775 - protein, 11 aa, Neisseria
RHKITPPRGPR

SEQ ID NO: 8776 - protein, 6 aa, Neisseria
PATRPA

SEQ ID NO: 8777 - protein, 9 aa, Neisseria
MARTLGAPE

SEQ ID NO: 8778 - protein, 5 aa, Neisseria
RRPST

SEQ ID NO: 8779 - protein, 8 aa, Neisseria
LASLNKSC

SEQ ID NO: 8780 - protein, 6 aa, Neisseria
MGRTIT

SEQ ID NO: 8781 - protein, 5 aa, Neisseria
GSTSS

SEQ ID NO: 8782 - protein, 13 aa, Neisseria
GAPESVPAGKVAA

SEQ ID NO: 8783 - protein, 9 aa, Neisseria
SFRRPSTLE

SEQ ID NO: 8784 - protein, 11 aa, Neisseria
RPTSLRPKSIN

SEQ ID NO: 8785 - protein, 23 aa, Neisseria
SLNKSCSLARSSAGVLPRRRVPA

SEQ ID NO: 8786 - protein, 23 aa, Neisseria
TSLRSRRTRISGEEPTMWKSPKS

SEQ ID NO: 8787 - protein, 7 aa, Neisseria
SFRRPST

SEQ ID NO: 8788 - protein, 8 aa, Neisseria
TSLRPKSI

SEQ ID NO: 8789 - protein, 7 aa, Neisseria
CSLARSS

SEQ ID NO: 8790 - protein, 8 aa, Neisseria
LPRRRVPA

SEQ ID NO: 8791 - protein, 15 aa, Neisseria
LRSRRTRISGEEPTM

SEQ ID NO: 8792 - protein, 5 aa, Neisseria
KSPKS

SEQ ID NO: 8793 - protein, 5 aa, Neisseria
PAMLG

SEQ ID NO: 8794 - protein, 6 aa, Neisseria
LGRMFT

SEQ ID NO: 8795 - protein, 11 aa, Neisseria
AALDELAKCAA

SEQ ID NO: 8796 - protein, 6 aa, Neisseria
MRFLAK

SEQ ID NO: 8797 - protein, 6 aa, Neisseria
DITEAS

SEQ ID NO: 8798 - protein, 9 aa, Neisseria
QFLPGILKT

SEQ ID NO: 8799 - protein, 9 aa, Neisseria
KTLDELKAA

SEQ ID NO: 8800 - protein, 9 aa, Neisseria
CVLEKMVDL

SEQ ID NO: 8801 - protein, 9 aa, Neisseria
QTFDPAENI

SEQ ID NO: 8802 - protein, 20 aa, Neisseria
QQARQMAQRLADELDYVGVL

SEQ ID NO: 8803 - protein, 5 aa, Neisseria
NILGD

SEQ ID NO: 8804 - protein, 6 aa, Neisseria
GGGQLG

SEQ ID NO: 8805 - protein, 10 aa, Neisseria
VLDPDPDAPA

SEQ ID NO: 8806 - protein, 8 aa, Neisseria
AALDELAK

SEQ ID NO: 8807 - protein, 10 aa, Neisseria
TEFENVNADA

SEQ ID NO: 8808 - protein, 9 aa, Neisseria
HTNVSPSGD

SEQ ID NO: 8809 - protein, 9 aa, Neisseria
NRIQEKAWI

SEQ ID NO: 8810 - protein, 9 aa, Neisseria
CKAEDITEA

SEQ ID NO: 8811 - protein, 21 aa, Neisseria
LGYDGKGQIRVKTLDELKAAF

SEQ ID NO: 8812 - protein, 9 aa, Neisseria
KMVDLRSEI

SEQ ID NO: 8813 - protein, 19 aa, Neisseria
LNNDNVQTFDPAENIHENG

SEQ ID NO: 8814 - protein, 9 aa, Neisseria
VQQQARQMA

SEQ ID NO: 8815 - protein, 7 aa, Neisseria
RLADELD

SEQ ID NO: 8816 - protein, 11 aa, Neisseria
IAPRPHNSGHH

SEQ ID NO: 8817 - protein, 5 aa, Neisseria
QFQQQ

SEQ ID NO: 8818 - protein, 9 aa, Neisseria
PPADTKLLS

SEQ ID NO: 8819 - protein, 11 aa, Neisseria
VWQEDGGEPDW

SEQ ID NO: 8820 - protein, 6 aa, Neisseria
QSHPNA

SEQ ID NO: 8821 - protein, 12 aa, Neisseria
GKKTAHKGRKMG

SEQ ID NO: 8822 - protein, 15 aa, Neisseria
TTDSDTAFQEAKKLH

SEQ ID NO: 8823 - protein, 10 aa, Neisseria
VLDPDPDAPA

SEQ ID NO: 8824 - protein, 8 aa, Neisseria
AALDELAK

SEQ ID NO: 8825 - protein, 7 aa, Neisseria
TEFENVN

SEQ ID NO: 8826 - protein, 9 aa, Neisseria
CKAEDITEA

SEQ ID NO: 8827 - protein, 19 aa, Neisseria
YDGKGQIRVKTLDELKAAF

SEQ ID NO: 8828 - protein, 9 aa, Neisseria
KMVDLRSEI

SEQ ID NO: 8829 - protein, 5 aa, Neisseria
LNNDN

SEQ ID NO: 8830 - protein, 7 aa, Neisseria
DPAENIH

SEQ ID NO: 8831 - protein, 9 aa, Neisseria
VQQQARQMA

SEQ ID NO: 8832 - protein, 7 aa, Neisseria
RLADELD

SEQ ID NO: 8833 - protein, 7 aa, Neisseria
IAPRPHN

SEQ ID NO: 8834 - protein, 6 aa, Neisseria
PADTKL

SEQ ID NO: 8835 - protein, 9 aa, Neisseria
WQEDGGEPD

SEQ ID NO: 8836 - protein, 12 aa, Neisseria
GKKTAHKGRKMG

SEQ ID NO: 8837 - protein, 14 aa, Neisseria
TDSDTAFQEAKKLH

SEQ ID NO: 8838 - protein, 22 aa, Neisseria
RQYADIIQFVRQALRHLPRLLL

SEQ ID NO: 8839 - protein, 9 aa, Neisseria
VDVFGRVES

SEQ ID NO: 8840 - protein, 14 aa, Neisseria
TAQIHHFFQNAIHA

SEQ ID NO: 8841 - protein, 12 aa, Neisseria
QKLRACFSDVFS

SEQ ID NO: 8842 - protein, 21 aa, Neisseria
VRARGDFVDDQFMRVTDNKHF

SEQ ID NO: 8843 - protein, 6 aa, Neisseria
ALRHLP

SEQ ID NO: 8844 - protein, 14 aa, Neisseria
TQSRGDDGISQDAV

SEQ ID NO: 8845 - protein, 5 aa, Neisseria
GRVES

SEQ ID NO: 8846 - protein, 8 aa, Neisseria
VFGKRGFE

SEQ ID NO: 8847 - protein, 16 aa, Neisseria
QRSRFQDAGQKLRACF

SEQ ID NO: 8848 - protein, 10 aa, Neisseria
LIRRGLQSRF

SEQ ID NO: 8849 - protein, 11 aa, Neisseria
NRHTIAARGNI

SEQ ID NO: 8850 - protein, 6 aa, Neisseria
KAHRIG

SEQ ID NO: 8851 - protein, 9 aa, Neisseria
FKFSGHRRA

SEQ ID NO: 8852 - protein, 8 aa, Neisseria
LVVKRRAQ

SEQ ID NO: 8853 - protein, 14 aa, Neisseria
GKFCCRRVRIGVEN

SEQ ID NO: 8854 - protein, 10 aa, Neisseria
GFGGNGKHSA

SEQ ID NO: 8855 - protein, 9 aa, Neisseria
VRARGDFVD

SEQ ID NO: 8856 - protein, 11 aa, Neisseria
QFMRVTDNKHF

SEQ ID NO: 8857 - protein, 10 aa, Neisseria
TQSRGDDGIS

SEQ ID NO: 8858 - protein, 5 aa, Neisseria
GRVES

SEQ ID NO: 8859 - protein, 16 aa, Neisseria
QRSRFQDAGQKLRACF

SEQ ID NO: 8860 - protein, 7 aa, Neisseria
LIRRGLQ

SEQ ID NO: 8861 - protein, 6 aa, Neisseria
KAHRIG

SEQ ID NO: 8862 - protein, 6 aa, Neisseria
SGHRRA

SEQ ID NO: 8863 - protein, 7 aa, Neisseria
VVKRRAQ

SEQ ID NO: 8864 - protein, 9 aa, Neisseria
CCRRVRIGV

SEQ ID NO: 8865 - protein, 7 aa, Neisseria
GNGKHSA

SEQ ID NO: 8866 - protein, 17 aa, Neisseria
GITDKPFRRLCRDFGAG

SEQ ID NO: 8867 - protein, 6 aa, Neisseria
AVCEML

SEQ ID NO: 8868 - protein, 9 aa, Neisseria
DPQQMADAA

SEQ ID NO: 8869 - protein, 9 aa, Neisseria
AAILEAVVR

SEQ ID NO: 8870 - protein, 8 aa, Neisseria
PVIAKIAE

SEQ ID NO: 8871 - protein, 16 aa, Neisseria
AAAILNHIRAIHAFYG

SEQ ID NO: 8872 - protein, 9 aa, Neisseria
RREINRLDS

SEQ ID NO: 8873 - protein, 14 aa, Neisseria
YDMLAGYLERLAEK

SEQ ID NO: 8874 - protein, 16 aa, Neisseria
ITDKPFRRLCRDFGAG

SEQ ID NO: 8875 - protein, 24 aa, Neisseria
LTSDPTLRNTRKTLHRSDFADEGG

SEQ ID NO: 8876 - protein, 13 aa, Neisseria
AGSDPQQMADAAR

SEQ ID NO: 8877 - protein, 10 aa, Neisseria
NMGCPAKKVC

SEQ ID NO: 8878 - protein, 9 aa, Neisseria
GWHDDHQNL

SEQ ID NO: 8879 - protein, 6 aa, Neisseria
IAEDCG

SEQ ID NO: 8880 - protein, 15 aa, Neisseria
HGRTRTQMYKGEARY

SEQ ID NO: 8881 - protein, 7 aa, Neisseria
AETKCRL

SEQ ID NO: 8882 - protein, 10 aa, Neisseria
NGDITSPQKA

SEQ ID NO: 8883 - protein, 12 aa, Neisseria
MIGRGAQGRPWF

SEQ ID NO: 8884 - protein, 6 aa, Neisseria
DLKHYA

SEQ ID NO: 8885 - protein, 6 aa, Neisseria
YGDTAG

SEQ ID NO: 8886 - protein, 6 aa, Neisseria
RIARKH

SEQ ID NO: 8887 - protein, 19 aa, Neisseria
DEMPDGEQTRREINRLDSA

SEQ ID NO: 8888 - protein, 9 aa, Neisseria
RLAEKTDSW

SEQ ID NO: 8889 - protein, 6 aa, Neisseria
AYRPNA

SEQ ID NO: 8890 - protein, 13 aa, Neisseria
ITDKPFRRLCRDF

SEQ ID NO: 8891 - protein, 20 aa, Neisseria
PTLRNTRKTLHRSDFADEGG

SEQ ID NO: 8892 - protein, 12 aa, Neisseria
GSDPQQMADAAR

SEQ ID NO: 8893 - protein, 7 aa, Neisseria
CPAKKVC

SEQ ID NO: 8894 - protein, 6 aa, Neisseria
IAEDCG

SEQ ID NO: 8895 - protein, 14 aa, Neisseria
GRTRTQMYKGEARY

SEQ ID NO: 8896 - protein, 7 aa, Neisseria
AETKCRL

SEQ ID NO: 8897 - protein, 7 aa, Neisseria
ITSPQKA

SEQ ID NO: 8898 - protein, 6 aa, Neisseria
DLKHYA

SEQ ID NO: 8899 - protein, 5 aa, Neisseria
RIARK

SEQ ID NO: 8900 - protein, 18 aa, Neisseria
EMPDGEQTRREINRLDSA

SEQ ID NO: 8901 - protein, 8 aa, Neisseria
RLAEKTDS

SEQ ID NO: 8902 - protein, 17 aa, Neisseria
PFALLHKIADLTGLLAY

SEQ ID NO: 8903 - protein, 10 aa, Neisseria
INLAKCFSEW

SEQ ID NO: 8904 - protein, 10 aa, Neisseria
KQHFKHMAKL

SEQ ID NO: 8905 - protein, 9 aa, Neisseria
AGRLKSLVR

SEQ ID NO: 8906 - protein, 12 aa, Neisseria
EGLRALVKQFRK

SEQ ID NO: 8907 - protein, 13 aa, Neisseria
TITGLSRIAALAN

SEQ ID NO: 8908 - protein, 5 aa, Neisseria
PAWKS

SEQ ID NO: 8909 - protein, 14 aa, Neisseria
QRMNRFIEDRVREH

SEQ ID NO: 8910 - protein, 9 aa, Neisseria
VKPRRRIGE

SEQ ID NO: 8911 - protein, 10 aa, Neisseria
WSEEKRKTVL

SEQ ID NO: 8912 - protein, 6 aa, Neisseria
AGRLKS

SEQ ID NO: 8913 - protein, 10 aa, Neisseria
VRYRNKHYLD

SEQ ID NO: 8914 - protein, 7 aa, Neisseria
ALAAGEK

SEQ ID NO: 8915 - protein, 10 aa, Neisseria
YSHQKNKILD

SEQ ID NO: 8916 - protein, 9 aa, Neisseria
QILKGRNRY

SEQ ID NO: 8917 - protein, 8 aa, Neisseria
RTEGLRAL

SEQ ID NO: 8918 - protein, 8 aa, Neisseria
KQFRKSSA

SEQ ID NO: 8919 - protein, 11 aa, Neisseria
PDQDFGRNDSV

SEQ ID NO: 8920 - protein, 8 aa, Neisseria
PVREADNT

SEQ ID NO: 8921 - protein, 31 aa, Neisseria
PAWKSFPGEDAKADAQRMNRFIEDRVREHPE

SEQ ID NO: 8922 - protein, 14 aa, Neisseria
KRFKTRPEGSPDFY

SEQ ID NO: 8923 - protein, 8 aa, Neisseria
KPRRRIGE

SEQ ID NO: 8924 - protein, 10 aa, Neisseria
WSEEKRKTVL

SEQ ID NO: 8925 - protein, 5 aa, Neisseria
GRLKS

SEQ ID NO: 8926 - protein, 5 aa, Neisseria
VRYRN

SEQ ID NO: 8927 - protein, 7 aa, Neisseria
ALAAGEK

SEQ ID NO: 8928 - protein, 7 aa, Neisseria
QKNKILD

SEQ ID NO: 8929 - protein, 9 aa, Neisseria
QILKGRNRY

SEQ ID NO: 8930 - protein, 8 aa, Neisseria
RTEGLRAL

SEQ ID NO: 8931 - protein, 6 aa, Neisseria
QFRKSS

SEQ ID NO: 8932 - protein, 9 aa, Neisseria
QDFGRNDSV

SEQ ID NO: 8933 - protein, 7 aa, Neisseria
PVREADN

SEQ ID NO: 8934 - protein, 26 aa, Neisseria
FPGEDAKADAQRMNRFIEDRVREHPE

SEQ ID NO: 8935 - protein, 11 aa, Neisseria
KRFKTRPEGSP

SEQ ID NO: 8936 - protein, 12 aa, Neisseria
ADVFDAAHGAAG

SEQ ID NO: 8937 - protein, 5 aa, Neisseria
PVVEI

SEQ ID NO: 8938 - protein, 8 aa, Neisseria
FHRVFQRF

SEQ ID NO: 8939 - protein, 14 aa, Neisseria
ARDQSKQIARFGKR

SEQ ID NO: 8940 - protein, 11 aa, Neisseria
GAHRMGGRACV

SEQ ID NO: 8941 - protein, 8 aa, Neisseria
FLQRKLEP

SEQ ID NO: 8942 - protein, 18 aa, Neisseria
IGGGAAVGKDELGVKDVQ

SEQ ID NO: 8943 - protein, 8 aa, Neisseria
AHGDDHEN

SEQ ID NO: 8944 - protein, 8 aa, Neisseria
FHGKADLG

SEQ ID NO: 8945 - protein, 7 aa, Neisseria
GGVKLDF

SEQ ID NO: 8946 - protein, 18 aa, Neisseria
QIARDQSKQIARFGKRVF

SEQ ID NO: 8947 - protein, 6 aa, Neisseria
AHRMGG

SEQ ID NO: 8948 - protein, 7 aa, Neisseria
LQRKLEP

SEQ ID NO: 8949 - protein, 13 aa, Neisseria
AVGKDELGVKDVQ

SEQ ID NO: 8950 - protein, 8 aa, Neisseria
AHGDDHEN

SEQ ID NO: 8951 - protein, 8 aa, Neisseria
FHGKADLG

SEQ ID NO: 8952 - protein, 7 aa, Neisseria
GGVKLDF

SEQ ID NO: 8953 - protein, 15 aa, Neisseria
QIARDQSKQIARFGK

SEQ ID NO: 8954 - protein, 8 aa, Neisseria
KPRRRIGE

SEQ ID NO: 8955 - protein, 10 aa, Neisseria
WSEEKRKTVL

SEQ ID NO: 8956 - protein, 5 aa, Neisseria
GRLKS

SEQ ID NO: 8957 - protein, 5 aa, Neisseria
VRYRN

SEQ ID NO: 8958 - protein, 7 aa, Neisseria
ALAAGEK

SEQ ID NO: 8959 - protein, 7 aa, Neisseria
QKNKILD

SEQ ID NO: 8960 - protein, 9 aa, Neisseria
QILKGRNRY

SEQ ID NO: 8961 - protein, 8 aa, Neisseria
RTEGLRAL

SEQ ID NO: 8962 - protein, 6 aa, Neisseria
QFRKSS

SEQ ID NO: 8963 - protein, 9 aa, Neisseria
QDFGRNDSV

SEQ ID NO: 8964 - protein, 7 aa, Neisseria
PVREADN

SEQ ID NO: 8965 - protein, 26 aa, Neisseria
FPGEDAKADAQRMNRFIEDRVREHPE

SEQ ID NO: 8966 - protein, 11 aa, Neisseria
KRFKTRPEGSP

SEQ ID NO: 8967 - protein, 9 aa, Neisseria
LKDYQTPAY

SEQ ID NO: 8968 - protein, 5 aa, Neisseria
DINEP

SEQ ID NO: 8969 - protein, 16 aa, Neisseria
TVVKSRLTVEPQRVGE

SEQ ID NO: 8970 - protein, 7 aa, Neisseria
LVLDGSA

SEQ ID NO: 8971 - protein, 9 aa, Neisseria
GVPSERFTV

SEQ ID NO: 8972 - protein, 13 aa, Neisseria
VETEILPAENKSL

SEQ ID NO: 8973 - protein, 9 aa, Neisseria
QCEPEGFRK

SEQ ID NO: 8974 - protein, 8 aa, Neisseria
IDRPDVMS

SEQ ID NO: 8975 - protein, 8 aa, Neisseria
VADKKRYP

SEQ ID NO: 8976 - protein, 28 aa, Neisseria
SNGNKIDGGEFSDGRHWVKWEDPFSKPS

SEQ ID NO: 8977 - protein, 6 aa, Neisseria
AVTEDY

SEQ ID NO: 8978 - protein, 8 aa, Neisseria
MSGRNVKI

SEQ ID NO: 8979 - protein, 9 aa, Neisseria
TTEADKPKV

SEQ ID NO: 8980 - protein, 8 aa, Neisseria
MKWDETRF

SEQ ID NO: 8981 - protein, 10 aa, Neisseria
NMGAMENKGL

SEQ ID NO: 8982 - protein, 14 aa, Neisseria
DSRTATDTDFEGIE

SEQ ID NO: 8983 - protein, 15 aa, Neisseria
YFHNWTGNRVTCRDW

SEQ ID NO: 8984 - protein, 5 aa, Neisseria
SLKEG

SEQ ID NO: 8985 - protein, 19 aa, Neisseria
RDQEFSGDRASRAVRRIEN

SEQ ID NO: 8986 - protein, 23 aa, Neisseria
HQFPEDAGPTAHPVRPASYEEMN

SEQ ID NO: 8987 - protein, 8 aa, Neisseria
VYEKGAEV

SEQ ID NO: 8988 - protein, 7 aa, Neisseria
EGFQKGM

SEQ ID NO: 8989 - protein, 18 aa, Neisseria
FQRHDGQAVTCDDFRAAM

SEQ ID NO: 8990 - protein, 6 aa, Neisseria
SQAGTP

SEQ ID NO: 8991 - protein, 11 aa, Neisseria
LEAEGRLKNNI

SEQ ID NO: 8992 - protein, 16 aa, Neisseria
VKQTVPPTPDMTDKQP

SEQ ID NO: 8993 - protein, 9 aa, Neisseria
LLNRNGEAV

SEQ ID NO: 8994 - protein, 9 aa, Neisseria
DYQGKRATE

SEQ ID NO: 8995 - protein, 10 aa, Neisseria
LNYPYSDDDL

SEQ ID NO: 8996 - protein, 5 aa, Neisseria
HDSDA

SEQ ID NO: 8997 - protein, 13 aa, Neisseria
LSDGVELPKHEKL

SEQ ID NO: 8998 - protein, 10 aa, Neisseria
VEKVISDDLL

SEQ ID NO: 8999 - protein, 18 aa, Neisseria
VPSEAELWDGAENIDPLR

SEQ ID NO: 9000 - protein, 7 aa, Neisseria
HQAREAL

SEQ ID NO: 9001 - protein, 23 aa, Neisseria
HELNRQAAKQENQSYEYSPEAAG

SEQ ID NO: 9002 - protein, 6 aa, Neisseria
TLRNVC

SEQ ID NO: 9003 - protein, 5 aa, Neisseria
ADPAH

SEQ ID NO: 9004 - protein, 8 aa, Neisseria
TVAEKYGE

SEQ ID NO: 9005 - protein, 11 aa, Neisseria
NGNESDTRNRL

SEQ ID NO: 9006 - protein, 11 aa, Neisseria
FADKFSDDALV

SEQ ID NO: 9007 - protein, 12 aa, Neisseria
GSSRRSDTLQQV

SEQ ID NO: 9008 - protein, 15 aa, Neisseria
QHPKFSLENPNKARS

SEQ ID NO: 9009 - protein, 8 aa, Neisseria
GSFSRNVP

SEQ ID NO: 9010 - protein, 12 aa, Neisseria
HAEDGSGYRFIA

SEQ ID NO: 9011 - protein, 12 aa, Neisseria
KVIEIDRFNPQV

SEQ ID NO: 9012 - protein, 11 aa, Neisseria
NKLEPHRKNLV

SEQ ID NO: 9013 - protein, 19 aa, Neisseria
ALQRIRAQEGLSKDVGEIV

SEQ ID NO: 9014 - protein, 16 aa, Neisseria
TVVKSRLTVEPQRVGE

SEQ ID NO: 9015 - protein, 7 aa, Neisseria
PSERFTV

SEQ ID NO: 9016 - protein, 12 aa, Neisseria
VETEILPAENKS

SEQ ID NO: 9017 - protein, 7 aa, Neisseria
CEPEGFR

SEQ ID NO: 9018 - protein, 7 aa, Neisseria
DRPDVMS

SEQ ID NO: 9019 - protein, 7 aa, Neisseria
VADKKRY

SEQ ID NO: 9020 - protein, 12 aa, Neisseria
NGNKIDGGEFSD

SEQ ID NO: 9021 - protein, 8 aa, Neisseria
VKWEDPFS

SEQ ID NO: 9022 - protein, 6 aa, Neisseria
SGRNVK

SEQ ID NO: 9023 - protein, 7 aa, Neisseria
EADKPKV

SEQ ID NO: 9024 - protein, 8 aa, Neisseria
MKWDETRF

SEQ ID NO: 9025 - protein, 6 aa, Neisseria
AMENKG

SEQ ID NO: 9026 - protein, 14 aa, Neisseria
DSRTATDTDFEGIE

SEQ ID NO: 9027 - protein, 5 aa, Neisseria
SLKEG

SEQ ID NO: 9028 - protein, 19 aa, Neisseria
RDQEFSGDRASRAVRRIEN

SEQ ID NO: 9029 - protein, 8 aa, Neisseria
QFPEDAGP

SEQ ID NO: 9030 - protein, 7 aa, Neisseria
ASYEEMN

SEQ ID NO: 9031 - protein, 8 aa, Neisseria
VYEKGAEV

SEQ ID NO: 9032 - protein, 7 aa, Neisseria
EGFQKGM

SEQ ID NO: 9033 - protein, 5 aa, Neisseria
RHDGQ

SEQ ID NO: 9034 - protein, 9 aa, Neisseria
TCDDFRAAM

SEQ ID NO: 9035 - protein, 11 aa, Neisseria
LEAEGRLKNNI

SEQ ID NO: 9036 - protein, 8 aa, Neisseria
PDMTDKQP

SEQ ID NO: 9037 - protein, 8 aa, Neisseria
YQGKRATE

SEQ ID NO: 9038 - protein, 6 aa, Neisseria
YSDDDL

SEQ ID NO: 9039 - protein, 5 aa, Neisseria
HDSDA

SEQ ID NO: 9040 - protein, 11 aa, Neisseria
DGVELPKHEKL

SEQ ID NO: 9041 - protein, 6 aa, Neisseria
VEKVIS

SEQ ID NO: 9042 - protein, 5 aa, Neisseria
SEAEL

SEQ ID NO: 9043 - protein, 8 aa, Neisseria
DGAENIDP

SEQ ID NO: 9044 - protein, 7 aa, Neisseria
HQAREAL

SEQ ID NO: 9045 - protein, 14 aa, Neisseria
HELNRQAAKQENQS

SEQ ID NO: 9046 - protein, 5 aa, Neisseria
ADPAH

SEQ ID NO: 9047 - protein, 8 aa, Neisseria
TVAEKYGE

SEQ ID NO: 9048 - protein, 11 aa, Neisseria
NGNESDTRNRL

SEQ ID NO: 9049 - protein, 7 aa, Neisseria
FADKFSD

SEQ ID NO: 9050 - protein, 7 aa, Neisseria
SSRRSDT

SEQ ID NO: 9051 - protein, 7 aa, Neisseria
NPNKARS

SEQ ID NO: 9052 - protein, 7 aa, Neisseria
HAEDGSG

SEQ ID NO: 9053 - protein, 9 aa, Neisseria
KVIEIDRFN

SEQ ID NO: 9054 - protein, 11 aa, Neisseria
NKLEPHRKNLV

SEQ ID NO: 9055 - protein, 19 aa, Neisseria
ALQRIRAQEGLSKDVGEIV

SEQ ID NO: 9056 - protein, 10 aa, Neisseria
GYDILKQGGS

SEQ ID NO: 9057 - protein, 6 aa, Neisseria
LKFMEA

SEQ ID NO: 9058 - protein, 12 aa, Neisseria
PAIPKLMETIHQ

SEQ ID NO: 9059 - protein, 12 aa, Neisseria
LPWGKLFDTPIR

SEQ ID NO: 9060 - protein, 6 aa, Neisseria
LARYPK

SEQ ID NO: 9061 - protein, 14 aa, Neisseria
LLKNLEFADSVQAL

SEQ ID NO: 9062 - protein, 8 aa, Neisseria
QGAKALHT

SEQ ID NO: 9063 - protein, 10 aa, Neisseria
KYAQNIVSVV

SEQ ID NO: 9064 - protein, 8 aa, Neisseria
LQDLSDYQ

SEQ ID NO: 9065 - protein, 10 aa, Neisseria
YRIYEVCGMG

SEQ ID NO: 9066 - protein, 11 aa, Neisseria
GQILGILNEFS

SEQ ID NO: 9067 - protein, 6 aa, Neisseria
LRLLGD

SEQ ID NO: 9068 - protein, 6 aa, Neisseria
DFIHEW

SEQ ID NO: 9069 - protein, 6 aa, Neisseria
LPSTSH

SEQ ID NO: 9070 - protein, 6 aa, Neisseria
VDKAGN

SEQ ID NO: 9071 - protein, 12 aa, Neisseria
SMTTSIENAFGS

SEQ ID NO: 9072 - protein, 12 aa, Neisseria
PGGSRIIGYVAK

SEQ ID NO: 9073 - protein, 12 aa, Neisseria
AISAPNLLNRFG

SEQ ID NO: 9074 - protein, 6 aa, Neisseria
QQALND

SEQ ID NO: 9075 - protein, 5 aa, Neisseria
RLVGG

SEQ ID NO: 9076 - protein, 11 aa, Neisseria
NHQSNSGEGVL

SEQ ID NO: 9077 - protein, 7 aa, Neisseria
NQGKVNT

SEQ ID NO: 9078 - protein, 10 aa, Neisseria
ADAHTPEHAT

SEQ ID NO: 9079 - protein, 6 aa, Neisseria
LTEQKQ

SEQ ID NO: 9080 - protein, 9 aa, Neisseria
ILKQGGSAA

SEQ ID NO: 9081 - protein, 9 aa, Neisseria
EPQSSGLGG

SEQ ID NO: 9082 - protein, 6 aa, Neisseria
DNTAKT

SEQ ID NO: 9083 - protein, 10 aa, Neisseria
TTFDGRETAP

SEQ ID NO: 9084 - protein, 8 aa, Neisseria
FLDKDGQP

SEQ ID NO: 9085 - protein, 7 aa, Neisseria
VGGRSVG

SEQ ID NO: 9086 - protein, 14 aa, Neisseria
KLFDTPIRLAKQGF

SEQ ID NO: 9087 - protein, 5 aa, Neisseria
VSPRL

SEQ ID NO: 9088 - protein, 6 aa, Neisseria
EQNQQH

SEQ ID NO: 9089 - protein, 8 aa, Neisseria
ARYPKTAA

SEQ ID NO: 9090 - protein, 5 aa, Neisseria
HTGKY

SEQ ID NO: 9091 - protein, 9 aa, Neisseria
QNAKDNPGQ

SEQ ID NO: 9092 - protein, 15 aa, Neisseria
QDLSDYQVVERPPVC

SEQ ID NO: 9093 - protein, 9 aa, Neisseria
GMGAPSSGG

SEQ ID NO: 9094 - protein, 22 aa, Neisseria
EFSPNQVGYDAEGLRLLGDASR

SEQ ID NO: 9095 - protein, 15 aa, Neisseria
AFADRDVYLGDPDFV

SEQ ID NO: 9096 - protein, 21 aa, Neisseria
LISKDYLKHRSQLLEQSDKAL

SEQ ID NO: 9097 - protein, 7 aa, Neisseria
SIVDKAG

SEQ ID NO: 9098 - protein, 6 aa, Neisseria
SIENAF

SEQ ID NO: 9099 - protein, 22 aa, Neisseria
PIKQGKQVANRVEPGKRPRSSM

SEQ ID NO: 9100 - protein, 7 aa, Neisseria
KAGKPYM

SEQ ID NO: 9101 - protein, 7 aa, Neisseria
SPGGSRI

SEQ ID NO: 9102 - protein, 9 aa, Neisseria
GSYELETGT

SEQ ID NO: 9103 - protein, 16 aa, Neisseria
NDLGYKTDVRELNSGV

SEQ ID NO: 9104 - protein, 20 aa, Neisseria
EPSRLVGGADPRREGRVMGD

SEQ ID NO: 9105 - protein, 5 aa, Neisseria
SNSGE

SEQ ID NO: 9106 - protein, 7 aa, Neisseria
NQGKVNT

SEQ ID NO: 9107 - protein, 7 aa, Neisseria
DAHTPEH

SEQ ID NO: 9108 - protein, 6 aa, Neisseria
LTEQKQ

SEQ ID NO: 9109 - protein, 5 aa, Neisseria
GGSAA

SEQ ID NO: 9110 - protein, 8 aa, Neisseria
FDGRETAP

SEQ ID NO: 9111 - protein, 8 aa, Neisseria
FLDKDGQP

SEQ ID NO: 9112 - protein, 8 aa, Neisseria
IRLAKQGF

SEQ ID NO: 9113 - protein, 8 aa, Neisseria
QNAKDNPG

SEQ ID NO: 9114 - protein, 7 aa, Neisseria
QVVERPP

SEQ ID NO: 9115 - protein, 14 aa, Neisseria
YDAEGLRLLGDASR

SEQ ID NO: 9116 - protein, 10 aa, Neisseria
AFADRDVYLG

SEQ ID NO: 9117 - protein, 17 aa, Neisseria
DYLKHRSQLLEQSDKAL

SEQ ID NO: 9118 - protein, 6 aa, Neisseria
IVDKAG

SEQ ID NO: 9119 - protein, 22 aa, Neisseria
PIKQGKQVANRVEPGKRPRSSM

SEQ ID NO: 9120 - protein, 8 aa, Neisseria
TDVRELNS

SEQ ID NO: 9121 - protein, 12 aa, Neisseria
ADPRREGRVMGD

SEQ ID NO: 9122 - protein, 8 aa, Neisseria
GLCGQVIP

SEQ ID NO: 9123 - protein, 10 aa, Neisseria
IIADFLQPAR

SEQ ID NO: 9124 - protein, 8 aa, Neisseria
ECLPNLAA

SEQ ID NO: 9125 - protein, 5 aa, Neisseria
KTAQF

SEQ ID NO: 9126 - protein, 7 aa, Neisseria
IAAVAEI

SEQ ID NO: 9127 - protein, 19 aa, Neisseria
TDQLRRMFFNQFEKFSNDH

SEQ ID NO: 9128 - protein, 6 aa, Neisseria
KMMLHK

SEQ ID NO: 9129 - protein, 6 aa, Neisseria
VQCSDT

SEQ ID NO: 9130 - protein, 9 aa, Neisseria
PAADQTETQ

SEQ ID NO: 9131 - protein, 7 aa, Neisseria
ARMECLP

SEQ ID NO: 9132 - protein, 7 aa, Neisseria
LARKTAQ

SEQ ID NO: 9133 - protein, 8 aa, Neisseria
RLVKREQI

SEQ ID NO: 9134 - protein, 6 aa, Neisseria
PTDQLR

SEQ ID NO: 9135 - protein, 5 aa, Neisseria
EKFSN

SEQ ID NO: 9136 - protein, 11 aa, Neisseria
PTHAARNRHNL

SEQ ID NO: 9137 - protein, 8 aa, Neisseria
VGQRGRQL

SEQ ID NO: 9138 - protein, 10 aa, Neisseria
IESQNRGHDS

SEQ ID NO: 9139 - protein, 9 aa, Neisseria
PAADQTETQ

SEQ ID NO: 9140 - protein, 5 aa, Neisseria
ARMEC

SEQ ID NO: 9141 - protein, 7 aa, Neisseria
LARKTAQ

SEQ ID NO: 9142 - protein, 8 aa, Neisseria
RLVKREQI

SEQ ID NO: 9143 - protein, 5 aa, Neisseria
EKFSN

SEQ ID NO: 9144 - protein, 10 aa, Neisseria
  VARIANT (1)...(10): Xaa is any amino acid
HAARXNRHNL

SEQ ID NO: 9145 - protein, 5 aa, Neisseria
QRGRQ

SEQ ID NO: 9146 - protein, 7 aa, Neisseria
SQNRGHD

SEQ ID NO: 9147 - protein, 11 aa, Neisseria
FLGIKRFFRQP

SEQ ID NO: 9148 - protein, 6 aa, Neisseria
KLHRAF

SEQ ID NO: 9149 - protein, 8 aa, Neisseria
QIFRHVQS

SEQ ID NO: 9150 - protein, 5 aa, Neisseria
TRQAF

SEQ ID NO: 9151 - protein, 19 aa, Neisseria
RLQNGRTGRNPPFVQKRLD

SEQ ID NO: 9152 - protein, 21 aa, Neisseria
RFFRQPLEMRRIIKKHQPINA

SEQ ID NO: 9153 - protein, 23 aa, Neisseria
GRKRPHHHDSSLRRQHGIEGMGF

SEQ ID NO: 9154 - protein, 14 aa, Neisseria
HVQSSNRQNGRQPV

SEQ ID NO: 9155 - protein, 10 aa, Neisseria
APNRQTRQAF

SEQ ID NO: 9156 - protein, 7 aa, Neisseria
PTSNGYC

SEQ ID NO: 9157 - protein, 12 aa, Neisseria
STHRTTHKAPPY

SEQ ID NO: 9158 - protein, 8 aa, Neisseria
QNGRTGRN

SEQ ID NO: 9159 - protein, 6 aa, Neisseria
VQKRLD

SEQ ID NO: 9160 - protein, 13 aa, Neisseria
PLEMRRIIKKHQP

SEQ ID NO: 9161 - protein, 17 aa, Neisseria
GRKRPHHHDSSLRRQHG

SEQ ID NO: 9162 - protein, 9 aa, Neisseria
QSSNRQNGR

SEQ ID NO: 9163 - protein, 8 aa, Neisseria
NRQTRQAF

SEQ ID NO: 9164 - protein, 6 aa, Neisseria
HRTTHK

SEQ ID NO: 9165 - protein, 5 aa, Neisseria
RSCFG

SEQ ID NO: 9166 - protein, 8 aa, Neisseria
VKNASGVS

SEQ ID NO: 9167 - protein, 5 aa, Neisseria
ITRSA

SEQ ID NO: 9168 - protein, 7 aa, Neisseria
VGSSNNI

SEQ ID NO: 9169 - protein, 9 aa, Neisseria
CRNCLARSC

SEQ ID NO: 9170 - protein, 14 aa, Neisseria
NASGVSSSRICPLS

SEQ ID NO: 9171 - protein, 13 aa, Neisseria
KITRSATSRANPI

SEQ ID NO: 9172 - protein, 31 aa, Neisseria
NTSPTISGSSAEVGSSNNITRGSIAKPRAIA

SEQ ID NO: 9173 - protein, 12 aa, Neisseria
CCWPPESWEGKA

SEQ ID NO: 9174 - protein, 9 aa, Neisseria
ASPTRSKSS

SEQ ID NO: 9175 - protein, 5 aa, Neisseria
ACSAF

SEQ ID NO: 9176 - protein, 11 aa, Neisseria
KITRSATSRAN

SEQ ID NO: 9177 - protein, 7 aa, Neisseria
SSAEVGS

SEQ ID NO: 9178 - protein, 9 aa, Neisseria
SIAKPRAIA

SEQ ID NO: 9179 - protein, 6 aa, Neisseria
PTRSKS

SEQ ID NO: 9180 - protein, 5 aa, Neisseria
FNAPN

SEQ ID NO: 9181 - protein, 7 aa, Neisseria
KEAAKSL

SEQ ID NO: 9182 - protein, 5 aa, Neisseria
TPRIA

SEQ ID NO: 9183 - protein, 6 aa, Neisseria
RLFIRY

SEQ ID NO: 9184 - protein, 22 aa, Neisseria
TPFNAPNTPPKMRLAKPKPTAE

SEQ ID NO: 9185 - protein, 41 aa, Neisseria
QAMTNREMNDRANANRRGWNEAKARSAKEAAKSLAKKKETT

SEQ ID NO: 9186 - protein, 7 aa, Neisseria
RIADSTM

SEQ ID NO: 9187 - protein, 8 aa, Neisseria
AETRRSAM

SEQ ID NO: 9188 - protein, 5 aa, Neisseria [sequence omitted]

SEQ ID NO: 9189 - protein, 14 aa, Neisseria
TPPKMRLAKPKPTA

SEQ ID NO: 9190 - protein, 39 aa, Neisseria
MTNREMNDRANANRRGWNEAKARSAKEAAKSLAKKKETT

SEQ ID NO: 9191 - protein, 8 aa, Neisseria
AETRRSAM

SEQ ID NO: 9192 - protein, 10 aa, Neisseria
RAVDIARAKK

SEQ ID NO: 9193 - protein, 10 aa, Neisseria
AALPPFVSVV

SEQ ID NO: 9194 - protein, 12 aa, Neisseria
AQNIRRILAEVP

SEQ ID NO: 9195 - protein, 10 aa, Neisseria
AFCRQFHRPY

SEQ ID NO: 9196 - protein, 8 aa, Neisseria
RVQTASDI

SEQ ID NO: 9197 - protein, 7 aa, Neisseria
AATRFPD

SEQ ID NO: 9198 - protein, 8 aa, Neisseria
HPSEYGGT

SEQ ID NO: 9199 - protein, 15 aa, Neisseria
PENVGEAVRITGAES

SEQ ID NO: 9200 - protein, 8 aa, Neisseria
MRKIRTKI

SEQ ID NO: 9201 - protein, 7 aa, Neisseria
TPEDAAA

SEQ ID NO: 9202 - protein, 15 aa, Neisseria
GSSRAVDIARAKKIT

SEQ ID NO: 9203 - protein, 11 aa, Neisseria
ESAQNIRRILA

SEQ ID NO: 9204 - protein, 9 aa, Neisseria
FHGDEDDAF

SEQ ID NO: 9205 - protein, 13 aa, Neisseria
SDIRNAATRFPDA

SEQ ID NO: 9206 - protein, 14 aa, Neisseria
YHPSEYGGTGNRFD

SEQ ID NO: 9207 - protein, 7 aa, Neisseria
AEYSGKP

SEQ ID NO: 9208 - protein, 12 aa, Neisseria
GLTPENVGEAVR

SEQ ID NO: 9209 - protein, 20 aa, Neisseria
ESVDVSGGVEASKGKKDAAK

SEQ ID NO: 9210 - protein, 7 aa, Neisseria
TANRLSR

SEQ ID NO: 9211 - protein, 8 aa, Neisseria
MRKIRTKI

SEQ ID NO: 9212 - protein, 7 aa, Neisseria
TPEDAAA

SEQ ID NO: 9213 - protein, 14 aa, Neisseria
SSRAVDIARAKKIT

SEQ ID NO: 9214 - protein, 10 aa, Neisseria
SAQNIRRILA

SEQ ID NO: 9215 - protein, 8 aa, Neisseria
HGDEDDAF

SEQ ID NO: 9216 - protein, 7 aa, Neisseria
SDIRNAA

SEQ ID NO: 9217 - protein, 7 aa, Neisseria
EYGGTGN

SEQ ID NO: 9218 - protein, 7 aa, Neisseria
NVGEAVR

SEQ ID NO: 9219 - protein, 5 aa, Neisseria
ESVDV

SEQ ID NO: 9220 - protein, 12 aa, Neisseria
VEASKGKKDAAK

SEQ ID NO: 9221 - protein, 5 aa, Neisseria
NRLSR

SEQ ID NO: 9222 - protein, 18 aa, Neisseria
LNDRLNQNVTEALGGVDV

SEQ ID NO: 9223 - protein, 5 aa, Neisseria
RFTDA

SEQ ID NO: 9224 - protein, 8 aa, Neisseria
VVLKQLPK

SEQ ID NO: 9225 - protein, 13 aa, Neisseria
RIANLLELIKPYL

SEQ ID NO: 9226 - protein, 9 aa, Neisseria
KLFRYLGEE

SEQ ID NO: 9227 - protein, 9 aa, Neisseria
GERLKKIST

SEQ ID NO: 9228 - protein, 5 aa, Neisseria
MEKLF

SEQ ID NO: 9229 - protein, 8 aa, Neisseria
LKVWVKVK

SEQ ID NO: 9230 - protein, 11 aa, Neisseria
LAGERAAGGYR

SEQ ID NO: 9231 - protein, 10 aa, Neisseria
VGRPNVGKST

SEQ ID NO: 9232 - protein, 15 aa, Neisseria
SITSKKAQTTRNRVT

SEQ ID NO: 9233 - protein, 6 aa, Neisseria
YTDDTA

SEQ ID NO: 9234 - protein, 22 aa, Neisseria
TPGFQTDHRNALNDRLNQNVTE

SEQ ID NO: 9235 - protein, 9 aa, Neisseria
RFTDADRVV

SEQ ID NO: 9236 - protein, 6 aa, Neisseria
QLPKHT

SEQ ID NO: 9237 - protein, 12 aa, Neisseria
KIDKDKAKDRYA

SEQ ID NO: 9238 - protein, 5 aa, Neisseria
VRAEF

SEQ ID NO: 9239 - protein, 9 aa, Neisseria
IKPYLPESV

SEQ ID NO: 9240 - protein, 13 aa, Neisseria
MYPEDMVTDKSAR

SEQ ID NO: 9241 - protein, 7 aa, Neisseria
IVREKLF

SEQ ID NO: 9242 - protein, 6 aa, Neisseria
LGEELP

SEQ ID NO: 9243 - protein, 13 aa, Neisseria
VEVEQFEEEDGLN

SEQ ID NO: 9244 - protein, 7 aa, Neisseria
VDKESQK

SEQ ID NO: 9245 - protein, 23 aa, Neisseria
GKGGERLKKISTEARLDMEKLFD

SEQ ID NO: 9246 - protein, 13 aa, Neisseria
VKSGWADDIRFLR

SEQ ID NO: 9247 - protein, 8 aa, Neisseria
LAGERAAG

SEQ ID NO: 9248 - protein, 13 aa, Neisseria
ITSKKAQTTRNRV

SEQ ID NO: 9249 - protein, 6 aa, Neisseria
YTDDTA

SEQ ID NO: 9250 - protein, 12 aa, Neisseria
TDHRNALNDRLN

SEQ ID NO: 9251 - protein, 9 aa, Neisseria
RFTDADRVV

SEQ ID NO: 9252 - protein, 12 aa, Neisseria
KIDKDKAKDRYA

SEQ ID NO: 9253 - protein, 5 aa, Neisseria
VRAEF

SEQ ID NO: 9254 - protein, 9 aa, Neisseria
DMVTDKSAR

SEQ ID NO: 9255 - protein, 7 aa, Neisseria
IVREKLF

SEQ ID NO: 9256 - protein, 6 aa, Neisseria
LGEELP

SEQ ID NO: 9257 - protein, 13 aa, Neisseria
VEVEQFEEEDGLN

SEQ ID NO: 9258 - protein, 7 aa, Neisseria
VDKESQK

SEQ ID NO: 9259 - protein, 22 aa, Neisseria
KGGERLKKISTEARLDMEKLFD

SEQ ID NO: 9260 - protein, 11 aa, Neisseria
SGWADDIRFLR

SEQ ID NO: 9261 - protein, 6 aa, Neisseria
VYQSLI

SEQ ID NO: 9262 - protein, 23 aa, Neisseria
TAAPEIAKNIREMSDFAKADEEL

SEQ ID NO: 9263 - protein, 10 aa, Neisseria
AAEYIRQIRP

SEQ ID NO: 9264 - protein, 12 aa, Neisseria
TACHELSAMPET

SEQ ID NO: 9265 - protein, 24 aa, Neisseria
IEVTKTFGGTDGHKFVNGILDKLA

SEQ ID NO: 9266 - protein, 12 aa, Neisseria
MKTARRRSRELA

SEQ ID NO: 9267 - protein, 20 aa, Neisseria
EIAKNIREMSDFAKADEELF

SEQ ID NO: 9268 - protein, 5 aa, Neisseria
TQTNA

SEQ ID NO: 9269 - protein, 19 aa, Neisseria
RQIRPLLDRDEKDLNPIER

SEQ ID NO: 9270 - protein, 7 aa, Neisseria
AMPETPY

SEQ ID NO: 9271 - protein, 17 aa, Neisseria
EAIEVTKTFGGTDGHKF

SEQ ID NO: 9272 - protein, 13 aa, Neisseria
LAAQIRPDEPKRR

SEQ ID NO: 9273 - protein, 12 aa, Neisseria
MKTARRRSRELA

SEQ ID NO: 9274 - protein, 20 aa, Neisseria
EIAKNIREMSDFAKADEELF

SEQ ID NO: 9275 - protein, 19 aa, Neisseria
RQIRPLLDRDEKDLNPIER

SEQ ID NO: 9276 - protein, 5 aa, Neisseria
EAIEV

SEQ ID NO: 9277 - protein, 9 aa, Neisseria
IRPDEPKRR

SEQ ID NO: 9278 - protein, 22 aa, Neisseria
RFTNEIGSEMLKVCCRTLQELG

SEQ ID NO: 9279 - protein, 5 aa, Neisseria
ALIAI

SEQ ID NO: 9280 - protein, 12 aa, Neisseria
QAIERIEEKASD

SEQ ID NO: 9281 - protein, 11 aa, Neisseria
ECANLVNLLLE

SEQ ID NO: 9282 - protein, 9 aa, Neisseria
PNLDGKHLR

SEQ ID NO: 9283 - protein, 6 aa, Neisseria
IGSEML

SEQ ID NO: 9284 - protein, 7 aa, Neisseria
GVADENI

SEQ ID NO: 9285 - protein, 6 aa, Neisseria
SSEKFD

SEQ ID NO: 9286 - protein, 6 aa, Neisseria
IRGETY

SEQ ID NO: 9287 - protein, 9 aa, Neisseria
VSNESGAGV

SEQ ID NO: 9288 - protein, 23 aa, Neisseria
TENDAQAIERIEEKASDAAKVAV

SEQ ID NO: 9289 - protein, 7 aa, Neisseria
EQFEDEE

SEQ ID NO: 9290 - protein, 7 aa, Neisseria
LDGKHLR

SEQ ID NO: 9291 - protein, 6 aa, Neisseria
IGSEML

SEQ ID NO: 9292 - protein, 7 aa, Neisseria
GVADENI

SEQ ID NO: 9293 - protein, 6 aa, Neisseria
SSEKFD

SEQ ID NO: 9294 - protein, 6 aa, Neisseria
IRGETY

SEQ ID NO: 9295 - protein, 8 aa, Neisseria
VSNESGAG

SEQ ID NO: 9296 - protein, 23 aa, Neisseria
TENDAQAIERIEEKASDAAKVAV

SEQ ID NO: 9297 - protein, 7 aa, Neisseria
EQFEDEE

SEQ ID NO: 9298 - protein, 8 aa, Neisseria
ARFCRFRR

SEQ ID NO: 9299 - protein, 19 aa, Neisseria
LTPFRRVQNHFVAFARFNQ

SEQ ID NO: 9300 - protein, 7 aa, Neisseria
IDFIDAD

SEQ ID NO: 9301 - protein, 7 aa, Neisseria
FDGLLAP

SEQ ID NO: 9302 - protein, 7 aa, Neisseria
KHLVGRF

SEQ ID NO: 9303 - protein, 25 aa, Neisseria
CRPVDDLDDFGAFFVDQLIKLVFQC

SEQ ID NO: 9304 - protein, 11 aa, Neisseria
CRFRRHSRSVD

SEQ ID NO: 9305 - protein, 9 aa, Neisseria
DVFDRKDFN

SEQ ID NO: 9306 - protein, 6 aa, Neisseria
PFRRVQ

SEQ ID NO: 9307 - protein, 15 aa, Neisseria
FNQTTSQRRNPRNFV

SEQ ID NO: 9308 - protein, 8 aa, Neisseria
IDADDFDG

SEQ ID NO: 9309 - protein, 11 aa, Neisseria
QQSDRRAEKHL

SEQ ID NO: 9310 - protein, 8 aa, Neisseria
GIDDDGSL

SEQ ID NO: 9311 - protein, 9 aa, Neisseria
FGQETDAAV

SEQ ID NO: 9312 - protein, 10 aa, Neisseria
RPVDDLDDFG

SEQ ID NO: 9313 - protein, 6 aa, Neisseria
PSGGRN

SEQ ID NO: 9314 - protein, 11 aa, Neisseria
CRFRRHSRSVD

SEQ ID NO: 9315 - protein, 8 aa, Neisseria
DVFDRKDF

SEQ ID NO: 9316 - protein, 8 aa, Neisseria
TSQRRNPR

SEQ ID NO: 9317 - protein, 7 aa, Neisseria
IDADDFD

SEQ ID NO: 9318 - protein, 11 aa, Neisseria
QQSDRRAEKHL

SEQ ID NO: 9319 - protein, 7 aa, Neisseria
GIDDDGS

SEQ ID NO: 9320 - protein, 8 aa, Neisseria
GQETDAAV

SEQ ID NO: 9321 - protein, 8 aa, Neisseria
RPVDDLDD

SEQ ID NO: 9322 - protein, 6 aa, Neisseria
LVSAVI

SEQ ID NO: 9323 - protein, 5 aa, Neisseria
MRGVI

SEQ ID NO: 9324 - protein, 12 aa, Neisseria
IQKMLRSLLTSA

SEQ ID NO: 9325 - protein, 10 aa, Neisseria
RILGGVFGAL

SEQ ID NO: 9326 - protein, 5 aa, Neisseria
PDTEE

SEQ ID NO: 9327 - protein, 16 aa, Neisseria
SKTDLPDTEEWRQSYT

SEQ ID NO: 9328 - protein, 12 aa, Neisseria
HSGGTAETPEDD

SEQ ID NO: 9329 - protein, 13 aa, Neisseria
SKTDLPDTEEWRQ

SEQ ID NO: 9330 - protein, 9 aa, Neisseria
GTAETPEDD

SEQ ID NO: 9331 - protein, 11 aa, Neisseria
FSEEAKFISAM

SEQ ID NO: 9332 - protein, 10 aa, Neisseria
CLRVGRAVRR

SEQ ID NO: 9333 - protein, 10 aa, Neisseria
ASNFSEEAKF

SEQ ID NO: 9334 - protein, 11 aa, Neisseria
ATPNSWRVRQQ

SEQ ID NO: 9335 - protein, 6 aa, Neisseria
LVKRAC

SEQ ID NO: 9336 - protein, 10 aa, Neisseria
PMRRCLPSRL

SEQ ID NO: 9337 - protein, 8 aa, Neisseria
GFGMPSEG

SEQ ID NO: 9338 - protein, 30 aa, Neisseria
AASRRRFGMCRLRQAPMRCLRVGRAVRRFQ

SEQ ID NO: 9339 - protein, 7 aa, Neisseria
FWRCRRG

SEQ ID NO: 9340 - protein, 8 aa, Neisseria
NFSEEAKF

SEQ ID NO: 9341 - protein, 5 aa, Neisseria
WRVRQ

SEQ ID NO: 9342 - protein, 6 aa, Neisseria
LVKRAC

SEQ ID NO: 9343 - protein, 7 aa, Neisseria
PMRRCLP

SEQ ID NO: 9344 - protein, 8 aa, Neisseria
AASRRRFG

SEQ ID NO: 9345 - protein, 6 aa, Neisseria
RLRQAP

SEQ ID NO: 9346 - protein, 11 aa, Neisseria
RCLRVGRAVRR

SEQ ID NO: 9347 - protein, 16 aa, Neisseria
RLRKCGRILSGICEPF

SEQ ID NO: 9348 - protein, 7 aa, Neisseria
CRLFCDG

SEQ ID NO: 9349 - protein, 11 aa, Neisseria
SYGKWRKNWDI

SEQ ID NO: 9350 - protein, 10 aa, Neisseria
SSTRLRKCGR

SEQ ID NO: 9351 - protein, 11 aa, Neisseria
RTLRLRGSRTR

SEQ ID NO: 9352 - protein, 14 aa, Neisseria
GPFWFCHRPRQSHG

SEQ ID NO: 9353 - protein, 16 aa, Neisseria
FCDGSMDQTRDRRCRS

SEQ ID NO: 9354 - protein, 12 aa, Neisseria
LHSDRYRHSNLW

SEQ ID NO: 9355 - protein, 7 aa, Neisseria
KWRKNWD

SEQ ID NO: 9356 - protein, 8 aa, Neisseria
TRLRKCGR

SEQ ID NO: 9357 - protein, 10 aa, Neisseria
RTLRLRGSRT

SEQ ID NO: 9358 - protein, 7 aa, Neisseria
RPRQSHG

SEQ ID NO: 9359 - protein, 13 aa, Neisseria
GSMDQTRDRRCRS

SEQ ID NO: 9360 - protein, 7 aa, Neisseria
HSDRYRH

SEQ ID NO: 9361 - protein, 16 aa, Neisseria
TPDKSARWENIGTISN

SEQ ID NO: 9362 - protein, 6 aa, Neisseria
RFANTP

SEQ ID NO: 9363 - protein, 6 aa, Neisseria
SSLQLF

SEQ ID NO: 9364 - protein, 8 aa, Neisseria
RPMSILSG

SEQ ID NO: 9365 - protein, 12 aa, Neisseria
CSTPDKSARWEN

SEQ ID NO: 9366 - protein, 6 aa, Neisseria
GTISNG

SEQ ID NO: 9367 - protein, 11 aa, Neisseria
INKDSVRKNGN

SEQ ID NO: 9368 - protein, 20 aa, Neisseria
QDKKVVTNLKQERFANTPAY

SEQ ID NO: 9369 - protein, 8 aa, Neisseria
CNNKTYRL

SEQ ID NO: 9370 - protein, 20 aa, Neisseria
FDTKNTEISTQNYTASSLRP

SEQ ID NO: 9371 - protein, 9 aa, Neisseria
GTLTEKQYE

SEQ ID NO: 9372 - protein, 6 aa, Neisseria
VCGKKL

SEQ ID NO: 9373 - protein, 11 aa, Neisseria
STPDKSARWEN

SEQ ID NO: 9374 - protein, 10 aa, Neisseria
INKDSVRKNG

SEQ ID NO: 9375 - protein, 7 aa, Neisseria
QDKKVVT

SEQ ID NO: 9376 - protein, 7 aa, Neisseria
LKQERFA

SEQ ID NO: 9377 - protein, 8 aa, Neisseria
DTKNTEIS

SEQ ID NO: 9378 - protein, 7 aa, Neisseria
LTEKQYE

SEQ ID NO: 9379 - protein, 6 aa, Neisseria
VCGKKL

SEQ ID NO: 9380 - protein, 7 aa, Neisseria
AACGTVQ

SEQ ID NO: 9381 - protein, 5 aa, Neisseria
LAEPL

SEQ ID NO: 9382 - protein, 23 aa, Neisseria
WADTLDDMLEAALSNAFNRLDST

SEQ ID NO: 9383 - protein, 12 aa, Neisseria
WTVYIDAFQGSY

SEQ ID NO: 9384 - protein, 18 aa, Neisseria
AMTAALEQGLKQAAQQMV

SEQ ID NO: 9385 - protein, 31 aa, Neisseria
LPDSRYIRPATQGGETAVEVRLAEPLKRGGL

SEQ ID NO: 9386 - protein, 10 aa, Neisseria
TDPYRLNTAQ

SEQ ID NO: 9387 - protein, 7 aa, Neisseria
TLDDMLE

SEQ ID NO: 9388 - protein, 7 aa, Neisseria
NRLDSTR

SEQ ID NO: 9389 - protein, 9 aa, Neisseria
ASRSGSTEK

SEQ ID NO: 9390 - protein, 10 aa, Neisseria
FQGSYTGKTL

SEQ ID NO: 9391 - protein, 21 aa, Neisseria
LPDGTNRPFHIETEQQGDGYA

SEQ ID NO: 9392 - protein, 7 aa, Neisseria
QGLKQAA

SEQ ID NO: 9393 - protein, 7 aa, Neisseria
PDSRYIR

SEQ ID NO: 9394 - protein, 21 aa, Neisseria
ATQGGETAVEVRLAEPLKRGG

SEQ ID NO: 9395 - protein, 7 aa, Neisseria
TLDDMLE

SEQ ID NO: 9396 - protein, 5 aa, Neisseria
NRLDS

SEQ ID NO: 9397 - protein, 8 aa, Neisseria
SRSGSTEK

SEQ ID NO: 9398 - protein, 10 aa, Neisseria
FHIETEQQGD

SEQ ID NO: 9399 - protein, 7 aa, Neisseria
QGLKQAA

SEQ ID NO: 9400 - protein, 8 aa, Neisseria
NFAFCGVV

SEQ ID NO: 9401 - protein, 5 aa, Neisseria
CAVLL

SEQ ID NO: 9402 - protein, 10 aa, Neisseria
WAALDTLTEL

SEQ ID NO: 9403 - protein, 7 aa, Neisseria
YEALHRY

SEQ ID NO: 9404 - protein, 11 aa, Neisseria
GAEAYEQLAKN

SEQ ID NO: 9405 - protein, 14 aa, Neisseria
EKQMETLARIFGKE

SEQ ID NO: 9406 - protein, 5 aa, Neisseria
DALFA

SEQ ID NO: 9407 - protein, 10 aa, Neisseria
AVEVLDNALV

SEQ ID NO: 9408 - protein, 8 aa, Neisseria
AAEQLKAA

SEQ ID NO: 9409 - protein, 20 aa, Neisseria
LNNKHSYSYAKEPHTVKPRF

SEQ ID NO: 9410 - protein, 11 aa, Neisseria
SPEPAAEKTVS

SEQ ID NO: 9411 - protein, 17 aa, Neisseria
PTARGDAVVPKNPERVA

SEQ ID NO: 9412 - protein, 6 aa, Neisseria
AFDKAA

SEQ ID NO: 9413 - protein, 12 aa, Neisseria
FEPDYEALHRYN

SEQ ID NO: 9414 - protein, 16 aa, Neisseria
GGPGAEAYEQLAKNAT

SEQ ID NO: 9415 - protein, 19 aa, Neisseria
LTVDNGNIRTSGEKQMETL

SEQ ID NO: 9416 - protein, 14 aa, Neisseria
FGKEARAAELKAQI

SEQ ID NO: 9417 - protein, 13 aa, Neisseria
QTREAAKGKGRGL

SEQ ID NO: 9418 - protein, 15 aa, Neisseria
VTGNKVSAFGTQSRL

SEQ ID NO: 9419 - protein, 19 aa, Neisseria
GDIGLPPVDESLRNEGHGQ

SEQ ID NO: 9420 - protein, 10 aa, Neisseria
YIKEKNPDWI

SEQ ID NO: 9421 - protein, 11 aa, Neisseria
RTAAIGQEGPA

SEQ ID NO: 9422 - protein, 9 aa, Neisseria
GTNAWKRKQ

SEQ ID NO: 9423 - protein, 12 aa, Neisseria
EQLKAAFKKAEP

SEQ ID NO: 9424 - protein, 5 aa, Neisseria
AAGKK

SEQ ID NO: 9425 - protein, 9 aa, Neisseria
YAKEPHTVK

SEQ ID NO: 9426 - protein, 11 aa, Neisseria
SPEPAAEKTVS

SEQ ID NO: 9427 - protein, 8 aa, Neisseria
TARGDAVV

SEQ ID NO: 9428 - protein, 7 aa, Neisseria
KNPERVA

SEQ ID NO: 9429 - protein, 6 aa, Neisseria
AFDKAA

SEQ ID NO: 9430 - protein, 5 aa, Neisseria
PDYEA

SEQ ID NO: 9431 - protein, 8 aa, Neisseria
EAYEQLAK

SEQ ID NO: 9432 - protein, 14 aa, Neisseria
GNIRTSGEKQMETL

SEQ ID NO: 9433 - protein, 14 aa, Neisseria
FGKEARAAELKAQI

SEQ ID NO: 9434 - protein, 12 aa, Neisseria
QTREAAKGKGRG

SEQ ID NO: 9435 - protein, 12 aa, Neisseria
PVDESLRNEGHG

SEQ ID NO: 9436 - protein, 7 aa, Neisseria
YIKEKNP

SEQ ID NO: 9437 - protein, 6 aa, Neisseria
GQEGPA

SEQ ID NO: 9438 - protein, 7 aa, Neisseria
NAWKRKQ

SEQ ID NO: 9439 - protein, 12 aa, Neisseria
EQLKAAFKKAEP

SEQ ID NO: 9440 - protein, 5 aa, Neisseria
AAGKK

SEQ ID NO: 9441 - protein, 8 aa, Neisseria
VLGGIAAL

SEQ ID NO: 9442 - protein, 9 aa, Neisseria
GSLIERINN

SEQ ID NO: 9443 - protein, 22 aa, Neisseria
SNIKSIADIKGVKTAQSLTSNY

SEQ ID NO: 9444 - protein, 10 aa, Neisseria
VAVDGLAQSL

SEQ ID NO: 9445 - protein, 11 aa, Neisseria
LAVLDYLKKNP

SEQ ID NO: 9446 - protein, 11 aa, Neisseria
DEAVAKFSTAI

SEQ ID NO: 9447 - protein, 13 aa, Neisseria
KADGTLKKLGEQF

SEQ ID NO: 9448 - protein, 18 aa, Neisseria
GGSEGGSGASSAPAQSAV

SEQ ID NO: 9449 - protein, 12 aa, Neisseria
SLIERINNKGTV

SEQ ID NO: 9450 - protein, 5 aa, Neisseria
GTEGT

SEQ ID NO: 9451 - protein, 25 aa, Neisseria
YHDKDGKLTGYDVEVTRAVAEKLGV

SEQ ID NO: 9452 - protein, 8 aa, Neisseria
VEFKETQW

SEQ ID NO: 9453 - protein, 18 aa, Neisseria
LTSPERQATFDKSDPYSW

SEQ ID NO: 9454 - protein, 19 aa, Neisseria
RNDSNIKSIADIKGVKTAQ

SEQ ID NO: 9455 - protein, 13 aa, Neisseria
LTSNYGEKAKAAG

SEQ ID NO: 9456 - protein, 15 aa, Neisseria
IEQKRADATLNDELA

SEQ ID NO: 9457 - protein, 9 aa, Neisseria
YLKKNPNAG

SEQ ID NO: 9458 - protein, 8 aa, Neisseria
PADEKVGS

SEQ ID NO: 9459 - protein, 11 aa, Neisseria
IVNKGNDEAVA

SEQ ID NO: 9460 - protein, 13 aa, Neisseria
NELKADGTLKKLG

SEQ ID NO: 9461 - protein, 9 aa, Neisseria
FFGKDISVQ

SEQ ID NO: 9462 - protein, 8 aa, Neisseria
GGSEGGSG

SEQ ID NO: 9463 - protein, 7 aa, Neisseria
LIERINN

SEQ ID NO: 9464 - protein, 25 aa, Neisseria
YHDKDGKLTGYDVEVTRAVAEKLGV

SEQ ID NO: 9465 - protein, 8 aa, Neisseria
VEFKETQW

SEQ ID NO: 9466 - protein, 13 aa, Neisseria
SPERQATFDKSDP

SEQ ID NO: 9467 - protein, 6 aa, Neisseria
RNDSNI

SEQ ID NO: 9468 - protein, 10 aa, Neisseria
SIADIKGVKT

SEQ ID NO: 9469 - protein, 9 aa, Neisseria
YGEKAKAAG

SEQ ID NO: 9470 - protein, 15 aa, Neisseria
IEQKRADATLNDELA

SEQ ID NO: 9471 - protein, 8 aa, Neisseria
YLKKNPNA

SEQ ID NO: 9472 - protein, 7 aa, Neisseria
PADEKVG

SEQ ID NO: 9473 - protein, 8 aa, Neisseria
KGNDEAVA

SEQ ID NO: 9474 - protein, 13 aa, Neisseria
NELKADGTLKKLG

SEQ ID NO: 9475 - protein, 6 aa, Neisseria
AALFAL

SEQ ID NO: 9476 - protein, 13 aa, Neisseria
KVEVLEFFGYFCP

SEQ ID NO: 9477 - protein, 15 aa, Neisseria
CAHLEPVLSKHAKSF

SEQ ID NO: 9478 - protein, 7 aa, Neisseria
LARLAAA

SEQ ID NO: 9479 - protein, 8 aa, Neisseria
PEVLKKWL

SEQ ID NO: 9480 - protein, 14 aa, Neisseria
QARADKMQELTETF

SEQ ID NO: 9481 - protein, 5 aa, Neisseria
MKSRH

SEQ ID NO: 9482 - protein, 15 aa, Neisseria
CDSKVQTSVPADSAP

SEQ ID NO: 9483 - protein, 8 aa, Neisseria
GLVEGQNY

SEQ ID NO: 9484 - protein, 12 aa, Neisseria
PIPQQQAGKVEV

SEQ ID NO: 9485 - protein, 12 aa, Neisseria
KHAKSFKDDMYL

SEQ ID NO: 9486 - protein, 10 aa, Neisseria
AAADSKDVAN

SEQ ID NO: 9487 - protein, 12 aa, Neisseria
QKIKLQNPEVLK

SEQ ID NO: 9488 - protein, 8 aa, Neisseria
TAFDGKKV

SEQ ID NO: 9489 - protein, 17 aa, Neisseria
ESPESQARADKMQELTE

SEQ ID NO: 9490 - protein, 7 aa, Neisseria
FQIDGTP

SEQ ID NO: 9491 - protein, 11 aa, Neisseria
VGGKYKVEFAD

SEQ ID NO: 9492 - protein, 6 aa, Neisseria
ESGMNT

SEQ ID NO: 9493 - protein, 13 aa, Neisseria
LADKVREEQKAAQ

SEQ ID NO: 9494 - protein, 5 aa, Neisseria
MKSRH

SEQ ID NO: 9495 - protein, 7 aa, Neisseria
CDSKVQT

SEQ ID NO: 9496 - protein, 7 aa, Neisseria
VPADSAP

SEQ ID NO: 9497 - protein, 7 aa, Neisseria
QAGKVEV

SEQ ID NO: 9498 - protein, 12 aa, Neisseria
KHAKSFKDDMYL

SEQ ID NO: 9499 - protein, 9 aa, Neisseria
AAADSKDVA

SEQ ID NO: 9500 - protein, 7 aa, Neisseria
QKIKLQN

SEQ ID NO: 9501 - protein, 8 aa, Neisseria
TAFDGKKV

SEQ ID NO: 9502 - protein, 17 aa, Neisseria
ESPESQARADKMQELTE

SEQ ID NO: 9503 - protein, 9 aa, Neisseria
GKYKVEFAD

SEQ ID NO: 9504 - protein, 13 aa, Neisseria
LADKVREEQKAAQ

SEQ ID NO: 9505 - protein, 7 aa, Neisseria
LSALLGL

SEQ ID NO: 9506 - protein, 12 aa, Neisseria
DVLQNAAEALKD

SEQ ID NO: 9507 - protein, 7 aa, Neisseria
YPSRFAQ

SEQ ID NO: 9508 - protein, 5 aa, Neisseria
ISVNK

SEQ ID NO: 9509 - protein, 6 aa, Neisseria
SAERVS

SEQ ID NO: 9510 - protein, 11 aa, Neisseria
IIQGNELEPRA

SEQ ID NO: 9511 - protein, 8 aa, Neisseria
RPGMTKDQ

SEQ ID NO: 9512 - protein, 9 aa, Neisseria
AFHTDRWDY

SEQ ID NO: 9513 - protein, 15 aa, Neisseria
FNTSRNGIIKERSNL

SEQ ID NO: 9514 - protein, 7 aa, Neisseria
VRTEGDV

SEQ ID NO: 9515 - protein, 14 aa, Neisseria
AAEALKDRQNTDKP

SEQ ID NO: 9516 - protein, 6 aa, Neisseria
SAERVS

SEQ ID NO: 9517 - protein, 7 aa, Neisseria
NELEPRA

SEQ ID NO: 9518 - protein, 6 aa, Neisseria
GMTKDQ

SEQ ID NO: 9519 - protein, 8 aa, Neisseria
GIIKERSN

SEQ ID NO: 9520 - protein, 7 aa, Neisseria
VRTEGDV

SEQ ID NO: 9521 - protein, 14 aa, Neisseria
AAEALKDRQNTDKP

SEQ ID NO: 9522 - protein, 9 aa, Neisseria
YPEMSEKLM

SEQ ID NO: 9523 - protein, 9 aa, Neisseria
VLMAMLVTL

SEQ ID NO: 9524 - protein, 9 aa, Neisseria
LPAIPEMAQ

SEQ ID NO: 9525 - protein, 8 aa, Neisseria
AFGQVVGG

SEQ ID NO: 9526 - protein, 5 aa, Neisseria
IKGRK

SEQ ID NO: 9527 - protein, 12 aa, Neisseria
LNLRVVQAFGAG

SEQ ID NO: 9528 - protein, 8 aa, Neisseria
FALIGIIL

SEQ ID NO: 9529 - protein, 18 aa, Neisseria
PMVGALLQGLGGWQAIFV

SEQ ID NO: 9530 - protein, 7 aa, Neisseria
LGLVQYF

SEQ ID NO: 9531 - protein, 6 aa, Neisseria
KIGRDV

SEQ ID NO: 9532 - protein, 6 aa, Neisseria
RFKRVL

SEQ ID NO: 9533 - protein, 7 aa, Neisseria
SFGSMFA

SEQ ID NO: 9534 - protein, 6 aa, Neisseria
QQLYRV

SEQ ID NO: 9535 - protein, 12 aa, Neisseria
AANLSQLAAVLF

SEQ ID NO: 9536 - protein, 10 aa, Neisseria
VLGVFQSLIG

SEQ ID NO: 9537 - protein, 6 aa, Neisseria
FRRRAV

SEQ ID NO: 9538 - protein, 8 aa, Neisseria
IGREFMPS

SEQ ID NO: 9539 - protein, 6 aa, Neisseria
EMSEKL

SEQ ID NO: 9540 - protein, 7 aa, Neisseria
DVHRIEQ

SEQ ID NO: 9541 - protein, 11 aa, Neisseria
SVSDIKGRKPV

SEQ ID NO: 9542 - protein, 12 aa, Neisseria
MVRDYYSGRKAA

SEQ ID NO: 9543 - protein, 14 aa, Neisseria
PKPAVGGKIGRDVF

SEQ ID NO: 9544 - protein, 10 aa, Neisseria
RFKRVLKTRA

SEQ ID NO: 9545 - protein, 6 aa, Neisseria
LKTGVH

SEQ ID NO: 9546 - protein, 7 aa, Neisseria
FKEEGGS

SEQ ID NO: 9547 - protein, 12 aa, Neisseria
RAWKENGQSEYL

SEQ ID NO: 9548 - protein, 6 aa, Neisseria
FRRRAV

SEQ ID NO: 9549 - protein, 6 aa, Neisseria
IGREFM

SEQ ID NO: 9550 - protein, 6 aa, Neisseria
EMSEKL

SEQ ID NO: 9551 - protein, 7 aa, Neisseria
DVHRIEQ

SEQ ID NO: 9552 - protein, 11 aa, Neisseria
SVSDIKGRKPV

SEQ ID NO: 9553 - protein, 8 aa, Neisseria
YYSGRKAA

SEQ ID NO: 9554 - protein, 6 aa, Neisseria
KIGRDV

SEQ ID NO: 9555 - protein, 10 aa, Neisseria
RFKRVLKTRA

SEQ ID NO: 9556 - protein, 7 aa, Neisseria
FKEEGGS

SEQ ID NO: 9557 - protein, 8 aa, Neisseria
RAWKENGQ

SEQ ID NO: 9558 - protein, 6 aa, Neisseria
SSASSA

SEQ ID NO: 9559 - protein, 9 aa, Neisseria
SAPDNVKQA

SEQ ID NO: 9560 - protein, 23 aa, Neisseria
SNCTSLHPATGIDDLMQQIAEHI

SEQ ID NO: 9561 - protein, 8 aa, Neisseria
GYDNIQRL

SEQ ID NO: 9562 - protein, 10 aa, Neisseria
RTISRQAQNA

SEQ ID NO: 9563 - protein, 7 aa, Neisseria
PKRTRYF

SEQ ID NO: 9564 - protein, 14 aa, Neisseria
GNFQYISQLPGYLK

SEQ ID NO: 9565 - protein, 6 aa, Neisseria
MKNKTS

SEQ ID NO: 9566 - protein, 14 aa, Neisseria
CSPSKDDKTKEVGA

SEQ ID NO: 9567 - protein, 34 aa, Neisseria
SSSASSAPSQTDLQPTASAPDNVKQAESAPPSNC

SEQ ID NO: 9568 - protein, 8 aa, Neisseria
ATGIDDLM

SEQ ID NO: 9569 - protein, 7 aa, Neisseria
EHIDSDC

SEQ ID NO: 9570 - protein, 18 aa, Neisseria
HELETRFGLPDGGYDNIQ

SEQ ID NO: 9571 - protein, 12 aa, Neisseria
PDIRPEDPDYHQ

SEQ ID NO: 9572 - protein, 15 aa, Neisseria
EDLRYGKRTISRQAQ

SEQ ID NO: 9573 - protein, 9 aa, Neisseria
MEQERRLRE

SEQ ID NO: 9574 - protein, 17 aa, Neisseria
GSQETRGQGEEPKRTRY

SEQ ID NO: 9575 - protein, 15 aa, Neisseria
ATPAYSSRHNNGLGG

SEQ ID NO: 9576 - protein, 10 aa, Neisseria
HGEMLENQSL

SEQ ID NO: 9577 - protein, 14 aa, Neisseria
RLSNRERNPDKPFL

SEQ ID NO: 9578 - protein, 9 aa, Neisseria
HFDENGKIT

SEQ ID NO: 9579 - protein, 6 aa, Neisseria
VYEKNI

SEQ ID NO: 9580 - protein, 7 aa, Neisseria
NPNTGRI

SEQ ID NO: 9581 - protein, 5 aa, Neisseria
MKNKT

SEQ ID NO: 9582 - protein, 13 aa, Neisseria
SPSKDDKTKEVGA

SEQ ID NO: 9583 - protein, 13 aa, Neisseria
SASSAPSQTDLQP

SEQ ID NO: 9584 - protein, 13 aa, Neisseria
SAPDNVKQAESAP

SEQ ID NO: 9585 - protein, 6 aa, Neisseria
GIDDLM

SEQ ID NO: 9586 - protein, 5 aa, Neisseria
EHIDS

SEQ ID NO: 9587 - protein, 5 aa, Neisseria
HELET

SEQ ID NO: 9588 - protein, 9 aa, Neisseria
IRPEDPDYH

SEQ ID NO: 9589 - protein, 15 aa, Neisseria
EDLRYGKRTISRQAQ

SEQ ID NO: 9590 - protein, 9 aa, Neisseria
MEQERRLRE

SEQ ID NO: 9591 - protein, 17 aa, Neisseria
GSQETRGQGEEPKRTRY

SEQ ID NO: 9592 - protein, 7 aa, Neisseria
YSSRHNN

SEQ ID NO: 9593 - protein, 6 aa, Neisseria
HGEMLE

SEQ ID NO: 9594 - protein, 12 aa, Neisseria
LSNRERNPDKPF

SEQ ID NO: 9595 - protein, 9 aa, Neisseria
HFDENGKIT

SEQ ID NO: 9596 - protein, 5 aa, Neisseria
NTGRI

SEQ ID NO: 9597 - protein, 5 aa, Neisseria
KPAAS

SEQ ID NO: 9598 - protein, 10 aa, Neisseria
HNELRKIRTA

SEQ ID NO: 9599 - protein, 5 aa, Neisseria
RYLSG

SEQ ID NO: 9600 - protein, 5 aa, Neisseria
CRFAK

SEQ ID NO: 9601 - protein, 29 aa, Neisseria
PPNDFQPNCDIRRLGLTQSQHNELRKIRT

SEQ ID NO: 9602 - protein, 12 aa, Neisseria
MAGDRARLKVMH

SEQ ID NO: 9603 - protein, 8 aa, Neisseria
EHSRRRSV

SEQ ID NO: 9604 - protein, 32 aa, Neisseria
ISSDVFNRNEARDYVESRYLSGMDFAVDELEI

SEQ ID NO: 9605 - protein, 6 aa, Neisseria
TPQQQQ

SEQ ID NO: 9606 - protein, 5 aa, Neisseria
SSCLK

SEQ ID NO: 9607 - protein, 7 aa, Neisseria
CDIRRLG

SEQ ID NO: 9608 - protein, 10 aa, Neisseria
QHNELRKIRT

SEQ ID NO: 9609 - protein, 12 aa, Neisseria
MAGDRARLKVMH

SEQ ID NO: 9610 - protein, 8 aa, Neisseria
EHSRRRSV

SEQ ID NO: 9611 - protein, 12 aa, Neisseria
VFNRNEARDYVE

SEQ ID NO: 9612 - protein, 8 aa, Neisseria
FAVDELEI

SEQ ID NO: 9613 - protein, 13 aa, Neisseria
CRCSESIRRIRRN

SEQ ID NO: 9614 - protein, 12 aa, Neisseria
LGYVFKPLAVFV

SEQ ID NO: 9615 - protein, 7 aa, Neisseria
QGFGQLH

SEQ ID NO: 9616 - protein, 8 aa, Neisseria
TRQLRGFK

SEQ ID NO: 9617 - protein, 8 aa, Neisseria
FDVFQVLG

SEQ ID NO: 9618 - protein, 6 aa, Neisseria
QFVEHH

SEQ ID NO: 9619 - protein, 26 aa, Neisseria
DAGEVGRVVGRGYGAAVFDFFQRFQL

SEQ ID NO: 9620 - protein, 15 aa, Neisseria
VQSQRRGRHLEDFGD

SEQ ID NO: 9621 - protein, 11 aa, Neisseria
IVGKLDQFDGV

SEQ ID NO: 9622 - protein, 9 aa, Neisseria
FDHIAEVAD

SEQ ID NO: 9623 - protein, 32 aa, Neisseria
CRCSESIRRIRRNGREWRIKGQKCRLNTDTVQ

SEQ ID NO: 9624 - protein, 16 aa, Neisseria
GGFDGRPVDIGKARFL

SEQ ID NO: 9625 - protein, 7 aa, Neisseria
AVDDGKI

SEQ ID NO: 9626 - protein, 14 aa, Neisseria
ATRQLRGFKLDDFD

SEQ ID NO: 9627 - protein, 13 aa, Neisseria
GDVRFGCGQRIDA

SEQ ID NO: 9628 - protein, 16 aa, Neisseria
HHQDAGEVGRVVGRGY

SEQ ID NO: 9629 - protein, 16 aa, Neisseria
RVQSQRRGRHLEDFGD

SEQ ID NO: 9630 - protein, 5 aa, Neisseria
EDVDV

SEQ ID NO: 9631 - protein, 8 aa, Neisseria
GKLDQFDG

SEQ ID NO: 9632 - protein, 14 aa, Neisseria
AEVADGRAEDDFFF

SEQ ID NO: 9633 - protein, 13 aa, Neisseria
AVVGGGRSGCGGR

SEQ ID NO: 9634 - protein, 18 aa, Neisseria
AAGGEDERECGGGKGFEE

SEQ ID NO: 9635 - protein, 27 aa, Neisseria
RCSESIRRIRRNGREWRIKGQKCRLNT

SEQ ID NO: 9636 - protein, 10 aa, Neisseria
FDGRPVDIGK

SEQ ID NO: 9637 - protein, 7 aa, Neisseria
AVDDGKI

SEQ ID NO: 9638 - protein, 14 aa, Neisseria
ATRQLRGFKLDDFD

SEQ ID NO: 9639 - protein, 13 aa, Neisseria
HHQDAGEVGRVVG

SEQ ID NO: 9640 - protein, 14 aa, Neisseria
QSQRRGRHLEDFGD

SEQ ID NO: 9641 - protein, 5 aa, Neisseria
EDVDV

SEQ ID NO: 9642 - protein, 6 aa, Neisseria
KLDQFD

SEQ ID NO: 9643 - protein, 14 aa, Neisseria
AEVADGRAEDDFFF

SEQ ID NO: 9644 - protein, 8 aa, Neisseria
GGRSGCGG

SEQ ID NO: 9645 - protein, 10 aa, Neisseria
GGEDERECGG

SEQ ID NO: 9646 - protein, 5 aa, Neisseria
KGFEE

SEQ ID NO: 9647 - protein, 6 aa, Neisseria
RGRACR

SEQ ID NO: 9648 - protein, 6 aa, Neisseria
CRHFAQ

SEQ ID NO: 9649 - protein, 7 aa, Neisseria
VAVGRIG

SEQ ID NO: 9650 - protein, 6 aa, Neisseria
FCQLFD

SEQ ID NO: 9651 - protein, 5 aa, Neisseria
DIFLV

SEQ ID NO: 9652 - protein, 6 aa, Neisseria
IADIGE

SEQ ID NO: 9653 - protein, 14 aa, Neisseria
RGLADIGEFVGVSD

SEQ ID NO: 9654 - protein, 8 aa, Neisseria
HQRASRIK

SEQ ID NO: 9655 - protein, 11 aa, Neisseria
RARRHFRQVFN

SEQ ID NO: 9656 - protein, 6 aa, Neisseria
DFVAHI

SEQ ID NO: 9657 - protein, 5 aa, Neisseria
AARIG

SEQ ID NO: 9658 - protein, 14 aa, Neisseria
SASGTRQKCRLKPV

SEQ ID NO: 9659 - protein, 8 aa, Neisseria
PKHSTPAS

SEQ ID NO: 9660 - protein, 7 aa, Neisseria
GQDEHNA

SEQ ID NO: 9661 - protein, 6 aa, Neisseria
PPSAYG

SEQ ID NO: 9662 - protein, 10 aa, Neisseria
HFGRGRACRY

SEQ ID NO: 9663 - protein, 9 aa, Neisseria
RIDSARCRH

SEQ ID NO: 9664 - protein, 10 aa, Neisseria
RIGRTDHNHD

SEQ ID NO: 9665 - protein, 12 aa, Neisseria
FDGGLPVGRRIA

SEQ ID NO: 9666 - protein, 15 aa, Neisseria
ADIGETRVQRGDDVF

SEQ ID NO: 9667 - protein, 9 aa, Neisseria
IDRERGLAD

SEQ ID NO: 9668 - protein, 23 aa, Neisseria
HISDRFDQKHFARRKLPHRSFDL

SEQ ID NO: 9669 - protein, 9 aa, Neisseria
LMPDHDDFT

SEQ ID NO: 9670 - protein, 15 aa, Neisseria
RHQRASRIKHAETAL

SEQ ID NO: 9671 - protein, 8 aa, Neisseria
LPHRLRYA

SEQ ID NO: 9672 - protein, 9 aa, Neisseria
NQCRARRHF

SEQ ID NO: 9673 - protein, 7 aa, Neisseria
VFNKHRT

SEQ ID NO: 9674 - protein, 7 aa, Neisseria
INRRAEL

SEQ ID NO: 9675 - protein, 8 aa, Neisseria
TFDNTDCP

SEQ ID NO: 9676 - protein, 14 aa, Neisseria
TSAEAARIGKDDGF

SEQ ID NO: 9677 - protein, 16 aa, Neisseria
YGGRCCPTPPTPHRRR

SEQ ID NO: 9678 - protein, 11 aa, Neisseria
SGTRQKCRLKP

SEQ ID NO: 9679 - protein, 7 aa, Neisseria
GQDEHNA

SEQ ID NO: 9680 - protein, 7 aa, Neisseria
GRGRACR

SEQ ID NO: 9681 - protein, 9 aa, Neisseria
RIDSARCRH

SEQ ID NO: 9682 - protein, 9 aa, Neisseria
RIGRTDHNH

SEQ ID NO: 9683 - protein, 6 aa, Neisseria
VGRRIA

SEQ ID NO: 9684 - protein, 13 aa, Neisseria
ADIGETRVQRGDD

SEQ ID NO: 9685 - protein, 9 aa, Neisseria
IDRERGLAD

SEQ ID NO: 9686 - protein, 23 aa, Neisseria
HISDRFDQKHFARRKLPHRSFDL

SEQ ID NO: 9687 - protein, 5 aa, Neisseria
PDHDD

SEQ ID NO: 9688 - protein, 15 aa, Neisseria
RHQRASRIKHAETAL

SEQ ID NO: 9689 - protein, 9 aa, Neisseria
NQCRARRHF

SEQ ID NO: 9690 - protein, 5 aa, Neisseria
FNKHR

SEQ ID NO: 9691 - protein, 7 aa, Neisseria
INRRAEL

SEQ ID NO: 9692 - protein, 5 aa, Neisseria
FDNTD

SEQ ID NO: 9693 - protein, 11 aa, Neisseria
AEAARIGKDDG

SEQ ID NO: 9694 - protein, 6 aa, Neisseria
TPHRRR

SEQ ID NO: 9695 - protein, 17 aa, Neisseria
HPQRFQSKPAERPAHRP

SEQ ID NO: 9696 - protein, 8 aa, Neisseria
VRLSNEVE

SEQ ID NO: 9697 - protein, 9 aa, Neisseria
ALEHAKTHS

SEQ ID NO: 9698 - protein, 7 aa, Neisseria
AYVQKLD

SEQ ID NO: 9699 - protein, 18 aa, Neisseria
VETAQNLYNQALKHYKSG

SEQ ID NO: 9700 - protein, 8 aa, Neisseria
AASLLKGA

SEQ ID NO: 9701 - protein, 7 aa, Neisseria
CESVIEI

SEQ ID NO: 9702 - protein, 8 aa, Neisseria
YANRFKDS

SEQ ID NO: 9703 - protein, 14 aa, Neisseria
ARATWRSLIQTYPG

SEQ ID NO: 9704 - protein, 28 aa, Neisseria
LPQTRPSRRHHRHRQYFAERKGDARSGF

SEQ ID NO: 9705 - protein, 40 aa, Neisseria
AAQRRHPQRFQSKPAERPAHRPHHPARRRRLDPASEKIMK

SEQ ID NO: 9706 - protein, 6 aa, Neisseria
SASCAS

SEQ ID NO: 9707 - protein, 20 aa, Neisseria
PAGSQTEMSTRENASDGIPY

SEQ ID NO: 9708 - protein, 9 aa, Neisseria
LQDRLDYLE

SEQ ID NO: 9709 - protein, 42 aa, Neisseria
KIVRLSNEVETLNGKVKALEHAKTHSSGRAYVQKLDDRKLKE

SEQ ID NO: 9710 - protein, 9 aa, Neisseria
YLNTEGGSA

SEQ ID NO: 9711 - protein, 10 aa, Neisseria
ALKHYKSGKF

SEQ ID NO: 9712 - protein, 14 aa, Neisseria
LKGADGGDGGSIAQ

SEQ ID NO: 9713 - protein, 9 aa, Neisseria
QSRARMGNC

SEQ ID NO: 9714 - protein, 16 aa, Neisseria
IGGRYANRFKDSPTAP

SEQ ID NO: 9715 - protein, 5 aa, Neisseria
GECQY

SEQ ID NO: 9716 - protein, 7 aa, Neisseria
LQQKDIA

SEQ ID NO: 9717 - protein, 17 aa, Neisseria
YPGSPAAKRAAAAVRKR

SEQ ID NO: 9718 - protein, 27 aa, Neisseria
PQTRPSRRHHRHRQYFAERKGDARSGF

SEQ ID NO: 9719 - protein, 40 aa, Neisseria; identical to SEQ ID NO: 9705

SEQ ID NO: 9720 - protein, 13 aa, Neisseria
SQTEMSTRENASD

SEQ ID NO: 9721 - protein, 9 aa, Neisseria
LQDRLDYLE

SEQ ID NO: 9722 - protein, 28 aa, Neisseria
KIVRLSNEVETLNGKVKALEHAKTHSSG

SEQ ID NO: 9723 - protein, 12 aa, Neisseria
YVQKLDDRKLKE

SEQ ID NO: 9724 - protein, 8 aa, Neisseria
KHYKSGKF

SEQ ID NO: 9725 - protein, 13 aa, Neisseria
KGADGGDGGSIAQ

SEQ ID NO: 9726 - protein, 7 aa, Neisseria
SRARMGN

SEQ ID NO: 9727 - protein, 12 aa, Neisseria
YANRFKDSPTAP

SEQ ID NO: 9728 - protein, 5 aa, Neisseria
GECQY

SEQ ID NO: 9729 - protein, 7 aa, Neisseria
LQQKDIA

SEQ ID NO: 9730 - protein, 13 aa, Neisseria
PAAKRAAAAVRKR

SEQ ID NO: 9731 - protein, 27 aa, Neisseria
FGGIFHFVCRFLSRVGSFVQSIFSCFS

SEQ ID NO: 9732 - protein, 6 aa, Neisseria
IFDLVF

SEQ ID NO: 9733 - protein, 14 aa, Neisseria
GLNRFLNLLFGFLR

SEQ ID NO: 9734 - protein, 6 aa, Neisseria
CQGNKL

SEQ ID NO: 9735 - protein, 14 aa, Neisseria
FDGRSGRLGGRSRS

SEQ ID NO: 9736 - protein, 13 aa, Neisseria
TSCQGSRHHCGNQ

SEQ ID NO: 9737 - protein, 14 aa, Neisseria
FDGRSGRLGGRSRS

SEQ ID NO: 9738 - protein, 9 aa, Neisseria
SCQGSRHHC

SEQ ID NO: 9739 - protein, 19 aa, Neisseria
TLLSVLIPMFAGFFIRVPK

SEQ ID NO: 9740 - protein, 11 aa, Neisseria
LPALDKVLSVL

SEQ ID NO: 9741 - protein, 8 aa, Neisseria
RVEDLGSR

SEQ ID NO: 9742 - protein, 8 aa, Neisseria
ALAVLGKL

SEQ ID NO: 9743 - protein, 7 aa, Neisseria
FGKLMRD

SEQ ID NO: 9744 - protein, 6 aa, Neisseria
SWTKGL

SEQ ID NO: 9745 - protein, 8 aa, Neisseria
WYSLSGLV

SEQ ID NO: 9746 - protein, 5 aa, Neisseria
YGAVW

SEQ ID NO: 9747 - protein, 6 aa, Neisseria
DLAREL

SEQ ID NO: 9748 - protein, 5 aa, Neisseria
GAGGL

SEQ ID NO: 9749 - protein, 7 aa, Neisseria
RVPKPYL

SEQ ID NO: 9750 - protein, 14 aa, Neisseria
SRVEDLGSRLDDMA

SEQ ID NO: 9751 - protein, 10 aa, Neisseria
WRIKGKGKGV

SEQ ID NO: 9752 - protein, 9 aa, Neisseria
MPSESAGMY

SEQ ID NO: 9753 - protein, 8 aa, Neisseria
LKSSGVSL

SEQ ID NO: 9754 - protein, 9 aa, Neisseria
LVNRRGIRL

SEQ ID NO: 9755 - protein, 7 aa, Neisseria
ASTDGVS

SEQ ID NO: 9756 - protein, 5 aa, Neisseria
RFPDA

SEQ ID NO: 9757 - protein, 5 aa, Neisseria
GAGGL

SEQ ID NO: 9758 - protein, 14 aa, Neisseria
SRVEDLGSRLDDMA

SEQ ID NO: 9759 - protein, 8 aa, Neisseria
IKGKGKGV

SEQ ID NO: 9760 - protein, 7 aa, Neisseria
LKSSGVS

SEQ ID NO: 9761 - protein, 8 aa, Neisseria
LVNRRGIR

SEQ ID NO: 9762 - protein, 5 aa, Neisseria
FHVAG

SEQ ID NO: 9763 - protein, 5 aa, Neisseria
CLDTS

SEQ ID NO: 9764 - protein, 13 aa, Neisseria
PNSFASFKRFSSI

SEQ ID NO: 9765 - protein, 6 aa, Neisseria
GPAPAM

SEQ ID NO: 9766 - protein, 10 aa, Neisseria
AQSTPSSPTM

SEQ ID NO: 9767 - protein, 10 aa, Neisseria
TCLDTSPEAG

SEQ ID NO: 9768 - protein, 7 aa, Neisseria
KRFSSIS

SEQ ID NO: 9769 - protein, 10 aa, Neisseria
NRADIPTGPA

SEQ ID NO: 9770 - protein, 9 aa, Neisseria
GKASLNNRA

SEQ ID NO: 9771 - protein, 7 aa, Neisseria
SGSGTRL

SEQ ID NO: 9772 - protein, 7 aa, Neisseria
NRADIPT

SEQ ID NO: 9773 - protein, 7 aa, Neisseria
CSGLVTV

SEQ ID NO: 9774 - protein, 5 aa, Neisseria
KISRG

SEQ ID NO: 9775 - protein, 7 aa, Neisseria
MPCSKAS

SEQ ID NO: 9776 - protein, 10 aa, Neisseria
LARDSCSPGL

SEQ ID NO: 9777 - protein, 6 aa, Neisseria
TAPASS

SEQ ID NO: 9778 - protein, 18 aa, Neisseria
LAIRRMASRPTGVRRVIS

SEQ ID NO: 9779 - protein, 14 aa, Neisseria
GMPPSTRAWDKSMA

SEQ ID NO: 9780 - protein, 7 aa, Neisseria
KISRGVS

SEQ ID NO: 9781 - protein, 5 aa, Neisseria
RWDRL

SEQ ID NO: 9782 - protein, 6 aa, Neisseria
ARDSCS

SEQ ID NO: 9783 - protein, 17 aa, Neisseria
AIRRMASRPTGVRRVIS

SEQ ID NO: 9784 - protein, 5 aa, Neisseria
RAWDK

SEQ ID NO: 9785 - protein, 5 aa, Neisseria
RWDRL

SEQ ID NO: 9786 - protein, 8 aa, Neisseria
QTLATVNG

SEQ ID NO: 9787 - protein, 10 aa, Neisseria
EVVNTVVAQE

SEQ ID NO: 9788 - protein, 6 aa, Neisseria
LDRSAE

SEQ ID NO: 9789 - protein, 12 aa, Neisseria
AAYDNISGFYKG

SEQ ID NO: 9790 - protein, 5 aa, Neisseria
FDAVL

SEQ ID NO: 9791 - protein, 22 aa, Neisseria
VPLKDLEQGVPPLYQAIKDLKK

SEQ ID NO: 9792 - protein, 5 aa, Neisseria
VPSFD

SEQ ID NO: 9793 - protein, 9 aa, Neisseria
RIDRAVGAL

SEQ ID NO: 9794 - protein, 5 aa, Neisseria
MKAKI

SEQ ID NO: 9795 - protein, 10 aa, Neisseria
VNGQKIDSSV

SEQ ID NO: 9796 - protein, 15 aa, Neisseria
FRAENSRAEDTPQLR

SEQ ID NO: 9797 - protein, 38 aa, Neisseria
QEVKRLKLDRSAEFKNALAKLRAEAKKSGDDKKPSFKT

SEQ ID NO: 9798 - protein, 14 aa, Neisseria
KTQPVSEQEVKAAY

SEQ ID NO: 9799 - protein, 14 aa, Neisseria
NISGFYKGTQEVQL

SEQ ID NO: 9800 - protein, 22 aa, Neisseria
ILTDKEENAKKAVADLKAKKGF

SEQ ID NO: 9801 - protein, 15 aa, Neisseria
YSLNDRTKQTGAPVG

SEQ ID NO: 9802 - protein, 9 aa, Neisseria
KDLEQGVPP

SEQ ID NO: 9803 - protein, 18 aa, Neisseria
KDLKKGEFTATPLKNGDF

SEQ ID NO: 9804 - protein, 18 aa, Neisseria
YVNDSREVKVPSFDEMKG

SEQ ID NO: 9805 - protein, 10 aa, Neisseria
LQAERIDRAV

SEQ ID NO: 9806 - protein, 7 aa, Neisseria
ANIKPAK

SEQ ID NO: 9807 - protein, 5 aa, Neisseria
MKAKI

SEQ ID NO: 9808 - protein, 7 aa, Neisseria
QKIDSSV

SEQ ID NO: 9809 - protein, 15 aa, Neisseria
FRAENSRAEDTPQLR

SEQ ID NO: 9810 - protein, 36 aa, Neisseria
QEVKRLKLDRSAEFKNALAKLRAEAKKSGDDKKPSF

SEQ ID NO: 9811 - protein, 12 aa, Neisseria
QPVSEQEVKAAY

SEQ ID NO: 9812 - protein, 22 aa, Neisseria
ILTDKEENAKKAVADLKAKKGF

SEQ ID NO: 9813 - protein, 10 aa, Neisseria
SLNDRTKQTG

SEQ ID NO: 9814 - protein, 5 aa, Neisseria
KDLEQ

SEQ ID NO: 9815 - protein, 8 aa, Neisseria
KDLKKGEF

SEQ ID NO: 9816 - protein, 16 aa, Neisseria
NDSREVKVPSFDEMKG

SEQ ID NO: 9817 - protein, 10 aa, Neisseria
LQAERIDRAV

SEQ ID NO: 9818 - protein, 7 aa, Neisseria
ANIKPAK

SEQ ID NO: 9819 - protein, 15 aa, Neisseria
GCQAVAQSIIDAGLG

SEQ ID NO: 9820 - protein, 23 aa, Neisseria
QEILDQIRLYDLPEVQSDFVETH

SEQ ID NO: 9821 - protein, 5 aa, Neisseria
LGMMQ

SEQ ID NO: 9822 - protein, 14 aa, Neisseria
LQILHWGGFLMVLP

SEQ ID NO: 9823 - protein, 8 aa, Neisseria
QGALRDLK

SEQ ID NO: 9824 - protein, 12 aa, Neisseria
AIIMTFIAGVYS

SEQ ID NO: 9825 - protein, 7 aa, Neisseria
FMEHIAR

SEQ ID NO: 9826 - protein, 28 aa, Neisseria
AGDAAERLVKLIPAFCHHMPDYPDTQET

SEQ ID NO: 9827 - protein, 17 aa, Neisseria
GGTRLSHIVRLLDRALA

SEQ ID NO: 9828 - protein, 6 aa, Neisseria
ELAEQY

SEQ ID NO: 9829 - protein, 7 aa, Neisseria
AIETLAQ

SEQ ID NO: 9830 - protein, 5 aa, Neisseria
ISLLR

SEQ ID NO: 9831 - protein, 9 aa, Neisseria
LNRIGEGVG

SEQ ID NO: 9832 - protein, 13 aa, Neisseria
LKDSAAEAVRQLA

SEQ ID NO: 9833 - protein, 8 aa, Neisseria
ETARALGV

SEQ ID NO: 9834 - protein, 9 aa, Neisseria
EYVKALQKE

SEQ ID NO: 9835 - protein, 10 aa, Neisseria
DLRTVAHLLD

SEQ ID NO: 9836 - protein, 12 aa, Neisseria
AVLGYVQPWIAA

SEQ ID NO: 9837 - protein, 5 aa, Neisseria
LAVLG

SEQ ID NO: 9838 - protein, 7 aa, Neisseria
ALRLHKR

SEQ ID NO: 9839 - protein, 5 aa, Neisseria
MKKTC

SEQ ID NO: 9840 - protein, 7 aa, Neisseria
CGLDVPE

SEQ ID NO: 9841 - protein, 11 aa, Neisseria
RYENEDRETCC

SEQ ID NO: 9842 - protein, 24 aa, Neisseria
LGSYYKQRTADAQKTELPPQEILD

SEQ ID NO: 9843 - protein, 17 aa, Neisseria
PEVQSDFVETHGGTREA

SEQ ID NO: 9844 - protein, 9 aa, Neisseria
QLLRTDGIV

SEQ ID NO: 9845 - protein, 8 aa, Neisseria
LNYSTHRC

SEQ ID NO: 9846 - protein, 10 aa, Neisseria
VVWDDGKIRL

SEQ ID NO: 9847 - protein, 18 aa, Neisseria
PYDAQKIEAANQKERKQY

SEQ ID NO: 9848 - protein, 9 aa, Neisseria
YGGDIEPDF

SEQ ID NO: 9849 - protein, 16 aa, Neisseria
ALRDLKNRRVGMDTPI

SEQ ID NO: 9850 - protein, 14 aa, Neisseria
IARRKAGDAAERLV

SEQ ID NO: 9851 - protein, 12 aa, Neisseria
MPDYPDTQETCE

SEQ ID NO: 9852 - protein, 9 aa, Neisseria
AVVKLKAGD

SEQ ID NO: 9853 - protein, 12 aa, Neisseria
KPGETIPVDGTV

SEQ ID NO: 9854 - protein, 14 aa, Neisseria
GSSAVNESMLTGES

SEQ ID NO: 9855 - protein, 9 aa, Neisseria
KMPSEKVTA

SEQ ID NO: 9856 - protein, 11 aa, Neisseria
IRTDRTGGGTR

SEQ ID NO: 9857 - protein, 13 aa, Neisseria
ALAQKPRTAELAE

SEQ ID NO: 9858 - protein, 7 aa, Neisseria
TLAREGI

SEQ ID NO: 9859 - protein, 6 aa, Neisseria
GGKQAI

SEQ ID NO: 9860 - protein, 17 aa, Neisseria
IFDKTGTLTQGKPAVRR

SEQ ID NO: 9861 - protein, 10 aa, Neisseria
SLLRGTDEAF

SEQ ID NO: 9862 - protein, 9 aa, Neisseria
LEQQSEHPL

SEQ ID NO: 9863 - protein, 9 aa, Neisseria
CRISDGSVP

SEQ ID NO: 9864 - protein, 14 aa, Neisseria
IAIKQRLNRIGEGV

SEQ ID NO: 9865 - protein, 6 aa, Neisseria
VNGETQ

SEQ ID NO: 9866 - protein, 15 aa, Neisseria
AEISGKEPQTEGGGS

SEQ ID NO: 9867 - protein, 12 aa, Neisseria
DPLKDSAAEAVR

SEQ ID NO: 9868 - protein, 6 aa, Neisseria
LAGKNL

SEQ ID NO: 9869 - protein, 10 aa, Neisseria
ILSGDRETAV

SEQ ID NO: 9870 - protein, 9 aa, Neisseria
AMPEDKLEY

SEQ ID NO: 9871 - protein, 9 aa, Neisseria
KALQKEGKK

SEQ ID NO: 9872 - protein, 7 aa, Neisseria
GDGINDA

SEQ ID NO: 9873 - protein, 13 aa, Neisseria
AAGGTDIARDGAD

SEQ ID NO: 9874 - protein, 5 aa, Neisseria
EDLRT

SEQ ID NO: 9875 - protein, 10 aa, Neisseria
DQARRTRHII

SEQ ID NO: 9876 - protein, 17 aa, Neisseria
RLHKRGKMQSEKMPSEQ

SEQ ID NO: 9877 - protein, 5 aa, Neisseria
MKKTC

SEQ ID NO: 9878 - protein, 10 aa, Neisseria
RYENEDRETC

SEQ ID NO: 9879 - protein, 15 aa, Neisseria
YKQRTADAQKTELPP

SEQ ID NO: 9880 - protein, 9 aa, Neisseria
PEVQSDFVE

SEQ ID NO: 9881 - protein, 7 aa, Neisseria
HGGTREA

SEQ ID NO: 9882 - protein, 9 aa, Neisseria
QLLRTDGIV

SEQ ID NO: 9883 - protein, 10 aa, Neisseria
VVWDDGKIRL

SEQ ID NO: 9884 - protein, 16 aa, Neisseria
DAQKIEAANQKERKQY

SEQ ID NO: 9885 - protein, 7 aa, Neisseria
GDIEPDF

SEQ ID NO: 9886 - protein, 12 aa, Neisseria
ALRDLKNRRVGM

SEQ ID NO: 9887 - protein, 14 aa, Neisseria
IARRKAGDAAERLV

SEQ ID NO: 9888 - protein, 10 aa, Neisseria
DYPDTQETCE

SEQ ID NO: 9889 - protein, 9 aa, Neisseria
AVVKLKAGD

SEQ ID NO: 9890 - protein, 8 aa, Neisseria
KMPSEKVT

SEQ ID NO: 9891 - protein, 11 aa, Neisseria
IRTDRTGGGTR

SEQ ID NO: 9892 - protein, 13 aa, Neisseria
ALAQKPRTAELAE

SEQ ID NO: 9893 - protein, 7 aa, Neisseria
TLAREGI

SEQ ID NO: 9894 - protein, 9 aa, Neisseria
TQGKPAVRR

SEQ ID NO: 9895 - protein, 5 aa, Neisseria
RGTDE

SEQ ID NO: 9896 - protein, 9 aa, Neisseria
LEQQSEHPL

SEQ ID NO: 9897 - protein, 7 aa, Neisseria
RISDGSV

SEQ ID NO: 9898 - protein, 12 aa, Neisseria
IAIKQRLNRIGE

SEQ ID NO: 9899 - protein, 12 aa, Neisseria
ISGKEPQTEGGG

SEQ ID NO: 9900 - protein, 11 aa, Neisseria
PLKDSAAEAVR

SEQ ID NO: 9901 - protein, 8 aa, Neisseria
SGDRETAV

SEQ ID NO: 9902 - protein, 9 aa, Neisseria
AMPEDKLEY

SEQ ID NO: 9903 - protein, 9 aa, Neisseria
KALQKEGKK

SEQ ID NO: 9904 - protein, 8 aa, Neisseria
DIARDGAD

SEQ ID NO: 9905 - protein, 5 aa, Neisseria
EDLRT

SEQ ID NO: 9906 - protein, 10 aa, Neisseria
DQARRTRHII

SEQ ID NO: 9907 - protein, 17 aa, Neisseria
RLHKRGKMQSEKMPSEQ

SEQ ID NO: 9908 - protein, 6 aa, Neisseria
KILLKL

SEQ ID NO: 9909 - protein, 5 aa, Neisseria
DPIPA

SEQ ID NO: 9910 - protein, 12 aa, Neisseria
YMQTFRRIVAPQ

SEQ ID NO: 9911 - protein, 9 aa, Neisseria
NEFIGLFKN

SEQ ID NO: 9912 - protein, 12 aa, Neisseria
VVTVTELFRVAQ

SEQ ID NO: 9913 - protein, 5 aa, Neisseria
TANRT

SEQ ID NO: 9914 - protein, 7 aa, Neisseria
TETRADM

SEQ ID NO: 9915 - protein, 7 aa, Neisseria
VPKGQWE

SEQ ID NO: 9916 - protein, 6 aa, Neisseria
PPLSNE

SEQ ID NO: 9917 - protein, 10 aa, Neisseria
AQETANRTYD

SEQ ID NO: 9918 - protein, 12 aa, Neisseria
ARLEKRFDRYVA

SEQ ID NO: 9919 - protein, 7 aa, Neisseria
TETRADM

SEQ ID NO: 9920 - protein, 8 aa, Neisseria
AQETANRT

SEQ ID NO: 9921 - protein, 12 aa, Neisseria
ARLEKRFDRYVA

SEQ ID NO: 9922 - protein, 9 aa, Neisseria
LVSRWLNSY

SEQ ID NO: 9923 - protein, 7 aa, Neisseria
RLIHAVR

SEQ ID NO: 9924 - protein, 15 aa, Neisseria
IYSKAVERMLGTVIG

SEQ ID NO: 9925 - protein, 10 aa, Neisseria
TASALAGWAA

SEQ ID NO: 9926 - protein, 6 aa, Neisseria
RAMNVL

SEQ ID NO: 9927 - protein, 19 aa, Neisseria
LADNLADCSKMIAEISNGR

SEQ ID NO: 9928 - protein, 8 aa, Neisseria
TRERLEEN

SEQ ID NO: 9929 - protein, 12 aa, Neisseria
MEAMQHAHRKIV

SEQ ID NO: 9930 - protein, 7 aa, Neisseria
ALAEHLH

SEQ ID NO: 9931 - protein, 9 aa, Neisseria
MNTSQRNRL

SEQ ID NO: 9932 - protein, 14 aa, Neisseria
SRWLNSYERYRYRR

SEQ ID NO: 9933 - protein, 7 aa, Neisseria
KAVERML

SEQ ID NO: 9934 - protein, 7 aa, Neisseria
HYFHGNL

SEQ ID NO: 9935 - protein, 6 aa, Neisseria
GKNGYV

SEQ ID NO: 9936 - protein, 9 aa, Neisseria
GDNGSEWLD

SEQ ID NO: 9937 - protein, 34 aa, Neisseria
NLADCSKMIAEISNGRRMTRERLEENMAKMRQIN

SEQ ID NO: 9938 - protein, 19 aa, Neisseria
RMVKSRSHLAATSGESRIS

SEQ ID NO: 9939 - protein, 7 aa, Neisseria
AHRKIVN

SEQ ID NO: 9940 - protein, 16 aa, Neisseria
KLQSPKLNGSEIRLLD

SEQ ID NO: 9941 - protein, 21 aa, Neisseria
GRHARRIRIDTAINPELEALA

SEQ ID NO: 9942 - protein, 8 aa, Neisseria
STNMRQEI

SEQ ID NO: 9943 - protein, 16 aa, Neisseria
QRTRRKWLDAHERQHL

SEQ ID NO: 9944 - protein, 9 aa, Neisseria
SLLETREHG

SEQ ID NO: 9945 - protein, 7 aa, Neisseria
TSQRNRL

SEQ ID NO: 9946 - protein, 8 aa, Neisseria
YERYRYRR

SEQ ID NO: 9947 - protein, 7 aa, Neisseria
KAVERML

SEQ ID NO: 9948 - protein, 6 aa, Neisseria
NGSEWL

SEQ ID NO: 9949 - protein, 10 aa, Neisseria
NLADCSKMIA

SEQ ID NO: 9950 - protein, 22 aa, Neisseria
SNGRRMTRERLEENMAKMRQIN

SEQ ID NO: 9951 - protein, 8 aa, Neisseria
RMVKSRSH

SEQ ID NO: 9952 - protein, 7 aa, Neisseria
TSGESRI

SEQ ID NO: 9953 - protein, 7 aa, Neisseria
AHRKIVN

SEQ ID NO: 9954 - protein, 16 aa, Neisseria
KLQSPKLNGSEIRLLD

SEQ ID NO: 9955 - protein, 8 aa, Neisseria
RHARRIRI

SEQ ID NO: 9956 - protein, 7 aa, Neisseria
PELEALA

SEQ ID NO: 9957 - protein, 6 aa, Neisseria
NMRQEI

SEQ ID NO: 9958 - protein, 16 aa, Neisseria
QRTRRKWLDAHERQHL

SEQ ID NO: 9959 - protein, 9 aa, Neisseria
SLLETREHG

SEQ ID NO: 9960 - protein, 8 aa, Neisseria
LIRSMQRQ

SEQ ID NO: 9961 - protein, 8 aa, Neisseria
NLSRLQKA

SEQ ID NO: 9962 - protein, 13 aa, Neisseria
EQGLENLRRLPSV

SEQ ID NO: 9963 - protein, 8 aa, Neisseria
GGKTTGKY

SEQ ID NO: 9964 - protein, 5 aa, Neisseria
SDLFY

SEQ ID NO: 9965 - protein, 7 aa, Neisseria
RYHEATE

SEQ ID NO: 9966 - protein, 10 aa, Neisseria
TRQTYKYIDD

SEQ ID NO: 9967 - protein, 11 aa, Neisseria
HKPKGFQTTNT

SEQ ID NO: 9968 - protein, 18 aa, Neisseria
IINDAELIRSMQRQQHID

SEQ ID NO: 9969 - protein, 25 aa, Neisseria
ANVRFEQPLEKNNYVLSEDETPCTR

SEQ ID NO: 9970 - protein, 8 aa, Neisseria
SLDDKTVR

SEQ ID NO: 9971 - protein, 12 aa, Neisseria
GSNNLSRLQKAA

SEQ ID NO: 9972 - protein, 9 aa, Neisseria
PQNMDSGIL

SEQ ID NO: 9973 - protein, 25 aa, Neisseria
RVSAGEIGDIRYEEKRDGKSAEGSI

SEQ ID NO: 9974 - protein, 9 aa, Neisseria
PLYRNKILN

SEQ ID NO: 9975 - protein, 20 aa, Neisseria
RDVEQGLENLRRLPSVKTDI

SEQ ID NO: 9976 - protein, 11 aa, Neisseria
IPSEEEGKSDL

SEQ ID NO: 9977 - protein, 9 aa, Neisseria
KWQQNKPIR

SEQ ID NO: 9978 - protein, 16 aa, Neisseria
IGIDDAGGKTTGKYQG

SEQ ID NO: 9979 - protein, 5 aa, Neisseria
DNPLG

SEQ ID NO: 9980 - protein, 26 aa, Neisseria
YGRGLAHKTDLTDATGTETESGSRSY

SEQ ID NO: 9981 - protein, 27 aa, Neisseria
FNHNGHRYHEATEGYSVNYDYNGKQYQ

SEQ ID NO: 9982 - protein, 12 aa, Neisseria
MLWRNRLHKTSV

SEQ ID NO: 9983 - protein, 27 aa, Neisseria
QTYKYIDDAEIEVQRRRSAGWEAELRH

SEQ ID NO: 9984 - protein, 38 aa, Neisseria
WQLDGKLSYKRGTGMRQSMPAPEENGGDILPGTSRMKI

SEQ ID NO: 9985 - protein, 6 aa, Neisseria
QWNKTP

SEQ ID NO: 9986 - protein, 33 aa, Neisseria
AQDKLSIGSRYTVRGFDGEQSLFGERGFYWQNT

SEQ ID NO: 9987 - protein, 11 aa, Neisseria
ADYGRVSGESA

SEQ ID NO: 9988 - protein, 5 aa, Neisseria
VSGKQ

SEQ ID NO: 9989 - protein, 8 aa, Neisseria
FRGGHKVG

SEQ ID NO: 9990 - protein, 10 aa, Neisseria
KPLHKPKGFQ

SEQ ID NO: 9991 - protein, 18 aa, Neisseria
IINDAELIRSMQRQQHID

SEQ ID NO: 9992 - protein, 13 aa, Neisseria
ANVRFEQPLEKNN

SEQ ID NO: 9993 - protein, 8 aa, Neisseria
LSEDETPC

SEQ ID NO: 9994 - protein, 8 aa, Neisseria
SLDDKTVR

SEQ ID NO: 9995 - protein, 9 aa, Neisseria
NLSRLQKAA

SEQ ID NO: 9996 - protein, 19 aa, Neisseria
EIGDIRYEEKRDGKSAEGS

SEQ ID NO: 9997 - protein, 20 aa, Neisseria
RDVEQGLENLRRLPSVKTDI

SEQ ID NO: 9998 - protein, 10 aa, Neisseria
PSEEEGKSDL

SEQ ID NO: 9999 - protein, 14 aa, Neisseria
IGIDDAGGKTTGKY

SEQ ID NO: 10000 - protein, 9 aa, Neisseria
LAHKTDLTD

SEQ ID NO: 10001 - protein, 11 aa, Neisseria
TGTETESGSRS

SEQ ID NO: 10002 - protein, 7 aa, Neisseria
RYHEATE

SEQ ID NO: 10003 - protein, 17 aa, Neisseria
YIDDAEIEVQRRRSAGW

SEQ ID NO: 10004 - protein, 5 aa, Neisseria
AELRH

SEQ ID NO: 10005 - protein, 23 aa, Neisseria
GKLSYKRGTGMRQSMPAPEENGG

SEQ ID NO: 10006 - protein, 5 aa, Neisseria
SRMKI

SEQ ID NO: 10007 - protein, 7 aa, Neisseria
AQDKLSI

SEQ ID NO: 10008 - protein, 6 aa, Neisseria
GFDGEQ

SEQ ID NO: 10009 - protein, 9 aa, Neisseria
DYGRVSGES

SEQ ID NO: 10010 - protein, 7 aa, Neisseria
PLHKPKG

SEQ ID NO: 10011 - protein, 13 aa, Neisseria
PSRAEKANQVSNI

SEQ ID NO: 10012 - protein, 12 aa, Neisseria
TASIEDALKSDP

SEQ ID NO: 10013 - protein, 6 aa, Neisseria
IYQYLK

SEQ ID NO: 10014 - protein, 5 aa, Neisseria
AQESF

SEQ ID NO: 10015 - protein, 8 aa, Neisseria
NRPAESMA

SEQ ID NO: 10016 - protein, 5 aa, Neisseria
FDKAL

SEQ ID NO: 10017 - protein, 6 aa, Neisseria
IANLNK

SEQ ID NO: 10018 - protein, 8 aa, Neisseria
PAFKELAR

SEQ ID NO: 10019 - protein, 7 aa, Neisseria
KALGNAQ

SEQ ID NO: 10020 - protein, 9 aa, Neisseria
PFKPSKRIS

SEQ ID NO: 10021 - protein, 16 aa, Neisseria
ACSTSYRPSRAEKANQ

SEQ ID NO: 10022 - protein, 25 aa, Neisseria
YMRGQDYRQATASIEDALKSDPKNE

SEQ ID NO: 10023 - protein, 11 aa, Neisseria
KVNDKAQESFR

SEQ ID NO: 10024 - protein, 16 aa, Neisseria
LSIKPDSAEINNNYGW

SEQ ID NO: 10025 - protein, 9 aa, Neisseria
CGRLNRPAE

SEQ ID NO: 10026 - protein, 9 aa, Neisseria
ALADPTYPT

SEQ ID NO: 10027 - protein, 12 aa, Neisseria
LNKGICSAKQGQ

SEQ ID NO: 10028 - protein, 11 aa, Neisseria
PAFKELARTKM

SEQ ID NO: 10029 - protein, 23 aa, Neisseria
LGDADYYFKKYQSRVEVLQADDL

SEQ ID NO: 10030 - protein, 8 aa, Neisseria
FPYSEELQ

SEQ ID NO: 10031 - protein, 6 aa, Neisseria
KPSKRI

SEQ ID NO: 10032 - protein, 11 aa, Neisseria
YRPSRAEKANQ

SEQ ID NO: 10033 - protein, 9 aa, Neisseria
YMRGQDYRQ

SEQ ID NO: 10034 - protein, 15 aa, Neisseria
TASIEDALKSDPKNE

SEQ ID NO: 10035 - protein, 11 aa, Neisseria
KVNDKAQESFR

SEQ ID NO: 10036 - protein, 8 aa, Neisseria
IKPDSAEI

SEQ ID NO: 10037 - protein, 7 aa, Neisseria
RLNRPAE

SEQ ID NO: 10038 - protein, 7 aa, Neisseria
ICSAKQG

SEQ ID NO: 10039 - protein, 10 aa, Neisseria
AFKELARTKM

SEQ ID NO: 10040 - protein, 13 aa, Neisseria
YQSRVEVLQADDL

SEQ ID NO: 10041 - protein, 9 aa, Neisseria
SLLDMPRGE

SEQ ID NO: 10042 - protein, 10 aa, Neisseria
VVVALIAAMG

SEQ ID NO: 10043 - protein, 12 aa, Neisseria
PHMSIIAAIVVL

SEQ ID NO: 10044 - protein, 7 aa, Neisseria
ARGLKYN

SEQ ID NO: 10045 - protein, 10 aa, Neisseria
QGMIGALNQG

SEQ ID NO: 10046 - protein, 8 aa, Neisseria
SSFALCSV

SEQ ID NO: 10047 - protein, 6 aa, Neisseria
SLTTCA

SEQ ID NO: 10048 - protein, 5 aa, Neisseria
PLSDT

SEQ ID NO: 10049 - protein, 14 aa, Neisseria
IDLFEHIKNMMYTT

SEQ ID NO: 10050 - protein, 8 aa, Neisseria
LNSVESFR

SEQ ID NO: 10051 - protein, 6 aa, Neisseria
LMRINA

SEQ ID NO: 10052 - protein, 5 aa, Neisseria
AMLFT

SEQ ID NO: 10053 - protein, 11 aa, Neisseria
TPDLRQLGAWF

SEQ ID NO: 10054 - protein, 13 aa, Neisseria
AFKDVVKLISRGG

SEQ ID NO: 10055 - protein, 16 aa, Neisseria
LGVIPSLLEAIRTFLT

SEQ ID NO: 10056 - protein, 5 aa, Neisseria
TFKPV

SEQ ID NO: 10057 - protein, 29 aa, Neisseria
RNLSRTLEDAGTVINPLVPWSVCGVFISH

SEQ ID NO: 10058 - protein, 8 aa, Neisseria
LDMPRGEA

SEQ ID NO: 10059 - protein, 9 aa, Neisseria
RGLKYNDMQ

SEQ ID NO: 10060 - protein, 13 aa, Neisseria
FGDKMSPLSDTTG

SEQ ID NO: 10061 - protein, 11 aa, Neisseria
NSVESFRSQLE

SEQ ID NO: 10062 - protein, 7 aa, Neisseria
STPDLRQ

SEQ ID NO: 10063 - protein, 14 aa, Neisseria
GGYKLEGEAFKDVV

SEQ ID NO: 10064 - protein, 7 aa, Neisseria
ISRGGLE

SEQ ID NO: 10065 - protein, 29 aa, Neisseria
LSGETFKPVYDKLGLHSRNLSRTLEDAGT

SEQ ID NO: 10066 - protein, 8 aa, Neisseria
LDMPRGEA

SEQ ID NO: 10067 - protein, 7 aa, Neisseria
LKYNDMQ

SEQ ID NO: 10068 - protein, 7 aa, Neisseria
KMSPLSD

SEQ ID NO: 10069 - protein, 8 aa, Neisseria
ESFRSQLE

SEQ ID NO: 10070 - protein, 5 aa, Neisseria
PDLRQ

SEQ ID NO: 10071 - protein, 11 aa, Neisseria
KLEGEAFKDVV

SEQ ID NO: 10072 - protein, 10 aa, Neisseria
NLSRTLEDAG

SEQ ID NO: 10073 - protein, 13 aa, Neisseria
KIRLMRELNKWSQ

SEQ ID NO: 10074 - protein, 6 aa, Neisseria
GYAKIE

SEQ ID NO: 10075 - protein, 19 aa, Neisseria
PRLEQLAQIFKIDMWDLLK

SEQ ID NO: 10076 - protein, 6 aa, Neisseria
CKEMLE

SEQ ID NO: 10077 - protein, 26 aa, Neisseria
METHEKIRLMRELNKWSQEDMAEKLA

SEQ ID NO: 10078 - protein, 17 aa, Neisseria
AKIERGETQLNIPRLEQ

SEQ ID NO: 10079 - protein, 7 aa, Neisseria
LKSGGGG

SEQ ID NO: 10080 - protein, 9 aa, Neisseria
INEGDSGGD

SEQ ID NO: 10081 - protein, 7 aa, Neisseria
ASGDVSM

SEQ ID NO: 10082 - protein, 29 aa, Neisseria
EFLKMELKHCKEMLEQKDKEIELLRKLTE

SEQ ID NO: 10083 - protein, 26 aa, Neisseria
METHEKIRLMRELNKWSQEDMAEKLA

SEQ ID NO: 10084 - protein, 8 aa, Neisseria
AKIERGET

SEQ ID NO: 10085 - protein, 5 aa, Neisseria
PRLEQ

SEQ ID NO: 10086 - protein, 7 aa, Neisseria
NEGDSGG

SEQ ID NO: 10087 - protein, 29 aa, Neisseria
EFLKMELKHCKEMLEQKDKEIELLRKLTE

SEQ ID NO: 10088 - protein, 31 aa, Neisseria
AESYRNLTASEIAKVYTIARMTDLDMLNDIK

SEQ ID NO: 10089 - protein, 13 aa, Neisseria
SGQSFDDWRKGIL

SEQ ID NO: 10090 - protein, 27 aa, Neisseria
GKDIIDPATGEVFGSPRRLETIYRTNM

SEQ ID NO: 10091 - protein, 7 aa, Neisseria
GQYQGYM

SEQ ID NO: 10092 - protein, 5 aa, Neisseria
SAIDG

SEQ ID NO: 10093 - protein, 5 aa, Neisseria
VERQG

SEQ ID NO: 10094 - protein, 12 aa, Neisseria
GQSTADNLVETH

SEQ ID NO: 10095 - protein, 11 aa, Neisseria
KYDRALAHQFA

SEQ ID NO: 10096 - protein, 9 aa, Neisseria
FKQLEKEFY

SEQ ID NO: 10097 - protein, 7 aa, Neisseria
QELAGMT

SEQ ID NO: 10098 - protein, 7 aa, Neisseria
SREGQNF

SEQ ID NO: 10099 - protein, 15 aa, Neisseria
DSYYAFLPDMLQNPE

SEQ ID NO: 10100 - protein, 13 aa, Neisseria
WAVLKYIKEVDEI

SEQ ID NO: 10101 - protein, 10 aa, Neisseria
RISNDKEIAK

SEQ ID NO: 10102 - protein, 9 aa, Neisseria
SLPPKKAIE

SEQ ID NO: 10103 - protein, 15 aa, Neisseria
LESKKVTAESYRNLT

SEQ ID NO: 10104 - protein, 7 aa, Neisseria
NDIKTSM

SEQ ID NO: 10105 - protein, 16 aa, Neisseria
ESAKSGQSFDDWRKGI

SEQ ID NO: 10106 - protein, 40 aa, Neisseria
LSNKGWLHPNGHNGKDIIDPATGEVFGSPRRLETIYRTNM

SEQ ID NO: 10107 - protein, 7 aa, Neisseria
NAGQYQG

SEQ ID NO: 10108 - protein, 9 aa, Neisseria
ANIDARPYW

SEQ ID NO: 10109 - protein, 13 aa, Neisseria
AVGDSRTRPAHSA

SEQ ID NO: 10110 - protein, 8 aa, Neisseria
YRYDDPFW

SEQ ID NO: 10111 - protein, 10 aa, Neisseria
PPNGYNCRCS

SEQ ID NO: 10112 - protein, 23 aa, Neisseria
LSERDVERQGRIVGQSTADNLVE

SEQ ID NO: 10113 - protein, 9 aa, Neisseria
KIYNKKGDT

SEQ ID NO: 10114 - protein, 35 aa, Neisseria
YKAPDGSLYTTDRGFDYNAGRMNYRPDLDKYDRAL

SEQ ID NO: 10115 - protein, 46 aa, Neisseria
AKAEMGGADFKTSFKQLEKEFYEVKQRLDIDGKPDKEQKIKIRNAL

SEQ ID NO: 10116 - protein, 7 aa, Neisseria
LSKETQE

SEQ ID NO: 10117 - protein, 22 aa, Neisseria
SDDTLVKQVDSREGQNFDDSYY

SEQ ID NO: 10118 - protein, 13 aa, Neisseria
LQNPEHVIRDNRE

SEQ ID NO: 10119 - protein, 6 aa, Neisseria
ARYKGS

SEQ ID NO: 10120 - protein, 7 aa, Neisseria
YIKEVDE

SEQ ID NO: 10121 - protein, 11 aa, Neisseria
SYRISNDKEIA

SEQ ID NO: 10122 - protein, 8 aa, Neisseria
MAKKKVLK

SEQ ID NO: 10123 - protein, 7 aa, Neisseria
PPKKAIE

SEQ ID NO: 10124 - protein, 12 aa, Neisseria
LESKKVTAESYR

SEQ ID NO: 10125 - protein, 7 aa, Neisseria
NDIKTSM

SEQ ID NO: 10126 - protein, 14 aa, Neisseria
ESAKSGQSFDDWRK

SEQ ID NO: 10127 - protein, 8 aa, Neisseria
HNGKDIID

SEQ ID NO: 10128 - protein, 8 aa, Neisseria
GSPRRLET

SEQ ID NO: 10129 - protein, 13 aa, Neisseria
AVGDSRTRPAHSA

SEQ ID NO: 10130 - protein, 13 aa, Neisseria
LSERDVERQGRIV

SEQ ID NO: 10131 - protein, 9 aa, Neisseria
KIYNKKGDT

SEQ ID NO: 10132 - protein, 7 aa, Neisseria
TTDRGFD

SEQ ID NO: 10133 - protein, 14 aa, Neisseria
MNYRPDLDKYDRAL

SEQ ID NO: 10134 - protein, 46 aa, Neisseria; identical to SEQ ID NO: 10115

SEQ ID NO: 10135 - protein, 7 aa, Neisseria
LSKETQE

SEQ ID NO: 10136 - protein, 16 aa, Neisseria
DTLVKQVDSREGQNFD

SEQ ID NO: 10137 - protein, 8 aa, Neisseria
HVIRDNRE

SEQ ID NO: 10138 - protein, 7 aa, Neisseria
YIKEVDE

SEQ ID NO: 10139 - protein, 8 aa, Neisseria
ISNDKEIA

SEQ ID NO: 10140 - protein, 8 aa, Neisseria
MAKKKVLK

SEQ ID NO: 10141 - protein, 5 aa, Neisseria
GSIRV

SEQ ID NO: 10142 - protein, 8 aa, Neisseria
VQGLPQNP

SEQ ID NO: 10143 - protein, 6 aa, Neisseria
EPVQLF

SEQ ID NO: 10144 - protein, 7 aa, Neisseria
GSLAHLM

SEQ ID NO: 10145 - protein, 5 aa, Neisseria
STAVN

SEQ ID NO: 10146 - protein, 7 aa, Neisseria
TVADRLK

SEQ ID NO: 10147 - protein, 7 aa, Neisseria
TALSKVA

SEQ ID NO: 10148 - protein, 17 aa, Neisseria
ANAKALSNHITNVSNAI

SEQ ID NO: 10149 - protein, 9 aa, Neisseria
PAKPLNTLE

SEQ ID NO: 10150 - protein, 15 aa, Neisseria
FAECNNALYNGLTPL

SEQ ID NO: 10151 - protein, 14 aa, Neisseria
IMRAVSTYTKSANN

SEQ ID NO: 10152 - protein, 14 aa, Neisseria
ITTIRTLDYVRRSV

SEQ ID NO: 10153 - protein, 7 aa, Neisseria
EILDVLI

SEQ ID NO: 10154 - protein, 7 aa, Neisseria
QAEIIEN

SEQ ID NO: 10155 - protein, 5 aa, Neisseria
QNDPN

SEQ ID NO: 10156 - protein, 6 aa, Neisseria
DVVNGL

SEQ ID NO: 10157 - protein, 14 aa, Neisseria
DFDTIPGSIRVPGQ

SEQ ID NO: 10158 - protein, 7 aa, Neisseria
FNTRNAV

SEQ ID NO: 10159 - protein, 7 aa, Neisseria
LPQNPQK

SEQ ID NO: 10160 - protein, 7 aa, Neisseria
SDAEAAD

SEQ ID NO: 10161 - protein, 6 aa, Neisseria
IGGKQV

SEQ ID NO: 10162 - protein, 7 aa, Neisseria
VNTGETA

SEQ ID NO: 10163 - protein, 7 aa, Neisseria
VADRLKT

SEQ ID NO: 10164 - protein, 13 aa, Neisseria
AKHKGEIGNESGL

SEQ ID NO: 10165 - protein, 7 aa, Neisseria
GGAKNAD

SEQ ID NO: 10166 - protein, 5 aa, Neisseria
VAGKH

SEQ ID NO: 10167 - protein, 13 aa, Neisseria
SPFSDDANAKALS

SEQ ID NO: 10168 - protein, 10 aa, Neisseria
VSNAIEQRGC

SEQ ID NO: 10169 - protein, 10 aa, Neisseria
ATGEINDGRM

SEQ ID NO: 10170 - protein, 7 aa, Neisseria
GAVEPNG

SEQ ID NO: 10171 - protein, 10 aa, Neisseria
FEEDPAKPLN

SEQ ID NO: 10172 - protein, 5 aa, Neisseria
LEIKG

SEQ ID NO: 10173 - protein, 6 aa, Neisseria
VTPDAQ

SEQ ID NO: 10174 - protein, 8 aa, Neisseria
CNNALYNG

SEQ ID NO: 10175 - protein, 14 aa, Neisseria
TYTKSANNTDDPAL

SEQ ID NO: 10176 - protein, 32 aa, Neisseria
DYVRRSVKERIALRFPRDKLSDRLLPKVKSEI

SEQ ID NO: 10177 - protein, 19 aa, Neisseria
LDQAEIIENAEANKGKLVV

SEQ ID NO: 10178 - protein, 10 aa, Neisseria
AQNDPNRVNA

SEQ ID NO: 10179 - protein, 7 aa, Neisseria
SDAEAAD

SEQ ID NO: 10180 - protein, 5 aa, Neisseria
NTGET

SEQ ID NO: 10181 - protein, 7 aa, Neisseria
VADRLKT

SEQ ID NO: 10182 - protein, 9 aa, Neisseria
AKHKGEIGN

SEQ ID NO: 10183 - protein, 5 aa, Neisseria
AKNAD

SEQ ID NO: 10184 - protein, 10 aa, Neisseria
FSDDANAKAL

SEQ ID NO: 10185 - protein, 5 aa, Neisseria
IEQRG

SEQ ID NO: 10186 - protein, 8 aa, Neisseria
GEINDGRM

SEQ ID NO: 10187 - protein, 8 aa, Neisseria
FEEDPAKP

SEQ ID NO: 10188 - protein, 5 aa, Neisseria
LEIKG

SEQ ID NO: 10189 - protein, 10 aa, Neisseria
SANNTDDPAL

SEQ ID NO: 10190 - protein, 12 aa, Neisseria
DYVRRSVKERIA

SEQ ID NO: 10191 - protein, 18 aa, Neisseria
FPRDKLSDRLLPKVKSEI

SEQ ID NO: 10192 - protein, 19 aa, Neisseria
LDQAEIIENAEANKGKLVV

SEQ ID NO: 10193 - protein, 7 aa, Neisseria
AQNDPNR

SEQ ID NO: 10194 - protein, 6 aa, Neisseria
EHRHWE

SEQ ID NO: 10195 - protein, 13 aa, Neisseria
DAAKKLAAPWPQI

SEQ ID NO: 10196 - protein, 13 aa, Neisseria
TVWQALTHIANSV

SEQ ID NO: 10197 - protein, 7 aa, Neisseria
DNLAALQ

SEQ ID NO: 10198 - protein, 5 aa, Neisseria
QAKKQ

SEQ ID NO: 10199 - protein, 7 aa, Neisseria
MQNNSYG

SEQ ID NO: 10200 - protein, 19 aa, Neisseria
RVGGKEHRHWERYDIDSDF

SEQ ID NO: 10201 - protein, 20 aa, Neisseria
RLGPEAAIPDLSGESCEVVI

SEQ ID NO: 10202 - protein, 21 aa, Neisseria
GSQRHGKSKGSRELSLSGRDL

SEQ ID NO: 10203 - protein, 5 aa, Neisseria
LNVKG

SEQ ID NO: 10204 - protein, 6 aa, Neisseria
DAAKKL

SEQ ID NO: 10205 - protein, 19 aa, Neisseria
VLKAENNPALGKIDIEPGE

SEQ ID NO: 10206 - protein, 8 aa, Neisseria
WLEPDGTL

SEQ ID NO: 10207 - protein, 9 aa, Neisseria
GGADYSSPP

SEQ ID NO: 10208 - protein, 24 aa, Neisseria
SRTDSRCNIERMDIEWDTDNRFSE

SEQ ID NO: 10209 - protein, 13 aa, Neisseria
SHGRSGDSAKHDL

SEQ ID NO: 10210 - protein, 16 aa, Neisseria
VYKDPTMTLHRPKTVV

SEQ ID NO: 10211 - protein, 5 aa, Neisseria
SDADN

SEQ ID NO: 10212 - protein, 9 aa, Neisseria
QKQAKKQLA

SEQ ID NO: 10213 - protein, 9 aa, Neisseria
VGGHKTRDG

SEQ ID NO: 10214 - protein, 8 aa, Neisseria
VIDDEHGI

SEQ ID NO: 10215 - protein, 56 aa, Neisseria
FMLSRMDGTQTELRLKEDGIWTPDAYPKKAEAARKRKGKRKGVSHKGKKGGKKQAE

SEQ ID NO: 10216 - protein, 16 aa, Neisseria
VGGKEHRHWERYDIDS

SEQ ID NO: 10217 - protein, 10 aa, Neisseria
LSGESCEVVI

SEQ ID NO: 10218 - protein, 19 aa, Neisseria
QRHGKSKGSRELSLSGRDL

SEQ ID NO: 10219 - protein, 6 aa, Neisseria
DAAKKL

SEQ ID NO: 10220 - protein, 9 aa, Neisseria
VLKAENNPA

SEQ ID NO: 10221 - protein, 9 aa, Neisseria
GKIDIEPGE

SEQ ID NO: 10222 - protein, 5 aa, Neisseria
LEPDG

SEQ ID NO: 10223 - protein, 22 aa, Neisseria
RTDSRCNIERMDIEWDTDNRFS

SEQ ID NO: 10224 - protein, 13 aa, Neisseria
SHGRSGDSAKHDL

SEQ ID NO: 10225 - protein, 5 aa, Neisseria
HRPKT

SEQ ID NO: 10226 - protein, 5 aa, Neisseria
SDADN

SEQ ID NO: 10227 - protein, 9 aa, Neisseria
QKQAKKQLA

SEQ ID NO: 10228 - protein, 6 aa, Neisseria
GHKTRD

SEQ ID NO: 10229 - protein, 8 aa, Neisseria
VIDDEHGI

SEQ ID NO: 10230 - protein, 17 aa, Neisseria
RMDGTQTELRLKEDGIW

SEQ ID NO: 10231 - protein, 32 aa, Neisseria
AYPKKAEAARKRKGKRKGVSHKGKKGGKKQAE

SEQ ID NO: 10232 - protein, 7 aa, Neisseria
ILRGLLP

SEQ ID NO: 10233 - protein, 12 aa, Neisseria
LDAVAESAQSVA

SEQ ID NO: 10234 - protein, 13 aa, Neisseria
GQMLADWERVLGL

SEQ ID NO: 10235 - protein, 10 aa, Neisseria
AVMAKLNETG

SEQ ID NO: 10236 - protein, 5 aa, Neisseria
LAEAA

SEQ ID NO: 10237 - protein, 5 aa, Neisseria
EPQPF

SEQ ID NO: 10238 - protein, 10 aa, Neisseria
AGVNRAGDRL

SEQ ID NO: 10239 - protein, 21 aa, Neisseria
AGDRLTDYSDAVIESLFNRLK

SEQ ID NO: 10240 - protein, 19 aa, Neisseria
SYARNAPRVRAQAEIDGAA

SEQ ID NO: 10241 - protein, 9 aa, Neisseria
AVAESAQSV

SEQ ID NO: 10242 - protein, 8 aa, Neisseria
DAVDPRSA

SEQ ID NO: 10243 - protein, 13 aa, Neisseria
LGLDGTGKNRQHR

SEQ ID NO: 10244 - protein, 8 aa, Neisseria
KLNETGGL

SEQ ID NO: 10245 - protein, 21 aa, Neisseria
QIDEPQPFRAGVNRAGDRLAP

SEQ ID NO: 10246 - protein, 15 aa, Neisseria
VRGGNNRITRFRAGI

SEQ ID NO: 10247 - protein, 14 aa, Neisseria
AAGDRLTDYSDAVI

SEQ ID NO: 10248 - protein, 7 aa, Neisseria
LFNRLKP

SEQ ID NO: 10249 - protein, 16 aa, Neisseria
RNAPRVRAQAEIDGAA

SEQ ID NO: 10250 - protein, 9 aa, Neisseria
AVAESAQSV

SEQ ID NO: 10251 - protein, 8 aa, Neisseria
DAVDPRSA

SEQ ID NO: 10252 - protein, 9 aa, Neisseria
GTGKNRQHR

SEQ ID NO: 10253 - protein, 8 aa, Neisseria
QIDEPQPF

SEQ ID NO: 10254 - protein, 11 aa, Neisseria
GVNRAGDRLAP

SEQ ID NO: 10255 - protein, 12 aa, Neisseria
RGGNNRITRFRA

SEQ ID NO: 10256 - protein, 14 aa, Neisseria
AAGDRLTDYSDAVI

SEQ ID NO: 10257 - protein, 7 aa, Neisseria
LFNRLKP

SEQ ID NO: 10258 - protein, 9 aa, Neisseria
QIERLGNGI

SEQ ID NO: 10259 - protein, 8 aa, Neisseria
RRLSETMH

SEQ ID NO: 10260 - protein, 12 aa, Neisseria
LSDSGRLKDSFS

SEQ ID NO: 10261 - protein, 6 aa, Neisseria
IHNFGG

SEQ ID NO: 10262 - protein, 15 aa, Neisseria
QIERLGNGIENRYLL

SEQ ID NO: 10263 - protein, 37 aa, Neisseria
YAGRPKWVGLKYRDGKPLSDSGRLKDSFSTLSDNDTA

SEQ ID NO: 10264 - protein, 17 aa, Neisseria
GGMAGRNRKVRIPQREF

SEQ ID NO: 10265 - protein, 14 aa, Neisseria
TDDDKQALMDDVQD

SEQ ID NO: 10266 - protein, 7 aa, Neisseria
QIERLGN

SEQ ID NO: 10267 - protein, 18 aa, Neisseria
KYRDGKPLSDSGRLKDSF

SEQ ID NO: 10268 - protein, 5 aa, Neisseria
SDNDT

SEQ ID NO: 10269 - protein, 13 aa, Neisseria
AGRNRKVRIPQRE

SEQ ID NO: 10270 - protein, 14 aa, Neisseria
TDDDKQALMDDVQD

SEQ ID NO: 10271 - protein, 8 aa, Neisseria
GVHKSAHG

SEQ ID NO: 10272 - protein, 12 aa, Neisseria
ATVKKTHKHTKA

SEQ ID NO: 10273 - protein, 5 aa, Neisseria
MNKNI

SEQ ID NO: 10274 - protein, 80 aa, Neisseria
AANKPASNATGVHKSAHGSCGASKSAEGSCGAAGSKAGEGKCGEGKCGATVKKTHKHTKASKAKAKSAEGKCGEGKCGSK

SEQ ID NO: 10275 - protein, 7 aa, Neisseria
AANKPAS

SEQ ID NO: 10276 - protein, 7 aa, Neisseria
GVHKSAH

SEQ ID NO: 10277 - protein, 10 aa, Neisseria
GASKSAEGSC

SEQ ID NO: 10278 - protein, 15 aa, Neisseria
AGSKAGEGKCGEGKC

SEQ ID NO: 10279 - protein, 32 aa, Neisseria
ATVKKTHKHTKASKAKAKSAEGKCGEGKCGSK

SEQ ID NO: 10280 - protein, 7 aa, Neisseria
AVYALAN

SEQ ID NO: 10281 - protein, 5 aa, Neisseria
LHRGL

SEQ ID NO: 10282 - protein, 5 aa, Neisseria
SIAYW

SEQ ID NO: 10283 - protein, 7 aa, Neisseria
AGLEQLG

SEQ ID NO: 10284 - protein, 18 aa, Neisseria
QSIFSTVWTPYIFRAIEE

SEQ ID NO: 10285 - protein, 9 aa, Neisseria
TGIFSPLAS

SEQ ID NO: 10286 - protein, 7 aa, Neisseria
LNVVRKT

SEQ ID NO: 10287 - protein, 8 aa, Neisseria
LATLGALA

SEQ ID NO: 10288 - protein, 12 aa, Neisseria
SSCRLWQPLKRL

SEQ ID NO: 10289 - protein, 5 aa, Neisseria
CFGTP

SEQ ID NO: 10290 - protein, 9 aa, Neisseria
GVWAAYLAG

SEQ ID NO: 10291 - protein, 9 aa, Neisseria
KDLHKLFHY

SEQ ID NO: 10292 - protein, 5 aa, Neisseria
MDTKE

SEQ ID NO: 10293 - protein, 7 aa, Neisseria
PADDIGR

SEQ ID NO: 10294 - protein, 9 aa, Neisseria
YATADKDTL

SEQ ID NO: 10295 - protein, 9 aa, Neisseria
SRPSLPSEI

SEQ ID NO: 10296 - protein, 5 aa, Neisseria
MEGRA

SEQ ID NO: 10297 - protein, 9 aa, Neisseria
NRCRLKAVR

SEQ ID NO: 10298 - protein, 7 aa, Neisseria
SADRLFL

SEQ ID NO: 10299 - protein, 11 aa, Neisseria
AIEENAPPARL

SEQ ID NO: 10300 - protein, 5 aa, Neisseria
ATAES

SEQ ID NO: 10301 - protein, 5 aa, Neisseria
PENYA

SEQ ID NO: 10302 - protein, 9 aa, Neisseria
VVRKTRPIA

SEQ ID NO: 10303 - protein, 7 aa, Neisseria
PSGGARG

SEQ ID NO: 10304 - protein, 9 aa, Neisseria
FKTESSCRL

SEQ ID NO: 10305 - protein, 8 aa, Neisseria
LRHRKDLH

SEQ ID NO: 10306 - protein, 5 aa, Neisseria
MDTKE

SEQ ID NO: 10307 - protein, 9 aa, Neisseria
YATADKDTL

SEQ ID NO: 10308 - protein, 5 aa, Neisseria
MEGRA

SEQ ID NO: 10309 - protein, 9 aa, Neisseria
NRCRLKAVR

SEQ ID NO: 10310 - protein, 11 aa, Neisseria
AIEENAPPARL

SEQ ID NO: 10311 - protein, 5 aa, Neisseria
ATAES

SEQ ID NO: 10312 - protein, 7 aa, Neisseria
VVRKTRP

SEQ ID NO: 10313 - protein, 5 aa, Neisseria
GGARG

SEQ ID NO: 10314 - protein, 6 aa, Neisseria
KTESSC

SEQ ID NO: 10315 - protein, 8 aa, Neisseria
LRHRKDLH

SEQ ID NO: 10316 - protein, 19 aa, Neisseria
ITATGRVIAEHPSNFITPQ

SEQ ID NO: 10317 - protein, 5 aa, Neisseria
RALFE

SEQ ID NO: 10318 - protein, 12 aa, Neisseria
DQAYEMMDSLPT

SEQ ID NO: 10319 - protein, 13 aa, Neisseria
DLIMDLMDAVGHG

SEQ ID NO: 10320 - protein, 6 aa, Neisseria
PQSWFK

SEQ ID NO: 10321 - protein, 5 aa, Neisseria
RSVQQ

SEQ ID NO: 10322 - protein, 8 aa, Neisseria
TLSWLYMF

SEQ ID NO: 10323 - protein, 13 aa, Neisseria
HYAVHDFAEFLEL

SEQ ID NO: 10324 - protein, 6 aa, Neisseria
RAVAEI

SEQ ID NO: 10325 - protein, 5 aa, Neisseria
ANGTT

SEQ ID NO: 10326 - protein, 12 aa, Neisseria
TNALGNIHNEVR

SEQ ID NO: 10327 - protein, 14 aa, Neisseria
QVAQTITSQIIGPF

SEQ ID NO: 10328 - protein, 5 aa, Neisseria
DPNRV

SEQ ID NO: 10329 - protein, 17 aa, Neisseria
EPKDIAVFADAIPKLVD

SEQ ID NO: 10330 - protein, 5 aa, Neisseria
VQIPE

SEQ ID NO: 10331 - protein, 7 aa, Neisseria
RQVPDNP

SEQ ID NO: 10332 - protein, 11 aa, Neisseria
HQEILDGALDD

SEQ ID NO: 10333 - protein, 19 aa, Neisseria
LNPMVRQAVAALNACNSYE

SEQ ID NO: 10334 - protein, 18 aa, Neisseria
IMAKKNNKTKIQKPEAAL

SEQ ID NO: 10335 - protein, 7 aa, Neisseria
ATGRVIA

SEQ ID NO: 10336 - protein, 5 aa, Neisseria
HPSNF

SEQ ID NO: 10337 - protein, 21 aa, Neisseria
TPQKMRALFEDAESGDIRAQH

SEQ ID NO: 10338 - protein, 10 aa, Neisseria
ADIEERDSDI

SEQ ID NO: 10339 - protein, 7 aa, Neisseria
MGTRKRA

SEQ ID NO: 10340 - protein, 21 aa, Neisseria
VAPPRNATPEEEKLSDQAYEM

SEQ ID NO: 10341 - protein, 5 aa, Neisseria
LPTLE

SEQ ID NO: 10342 - protein, 25 aa, Neisseria
DGLYLPRNFIHRPQSWFKWDKDNGL

SEQ ID NO: 10343 - protein, 11 aa, Neisseria
LRTRENPEGEA

SEQ ID NO: 10344 - protein, 16 aa, Neisseria
HTQKSRSVQQARNGLF

SEQ ID NO: 10345 - protein, 17 aa, Neisseria
RIGKYGAGATKEEKNTL

SEQ ID NO: 10346 - protein, 9 aa, Neisseria
MPEGMEIEL

SEQ ID NO: 10347 - protein, 7 aa, Neisseria
ANGTTAT

SEQ ID NO: 10348 - protein, 8 aa, Neisseria
DWCEKSAA

SEQ ID NO: 10349 - protein, 15 aa, Neisseria
LTSGADGKSSTNALG

SEQ ID NO: 10350 - protein, 15 aa, Neisseria
NEVRRDLLVSDAKQV

SEQ ID NO: 10351 - protein, 22 aa, Neisseria
YPHADPNRVPKFEFDTREPKDI

SEQ ID NO: 10352 - protein, 11 aa, Neisseria
IPESWVRDKLV

SEQ ID NO: 10353 - protein, 9 aa, Neisseria
DVQEGEAVL

SEQ ID NO: 10354 - protein, 10 aa, Neisseria
RQVPDNPVNR

SEQ ID NO: 10355 - protein, 18 aa, Neisseria
VPSKATGRHQEILDGALD

SEQ ID NO: 10356 - protein, 11 aa, Neisseria
ALVEPDFNSQL

SEQ ID NO: 10357 - protein, 8 aa, Neisseria
NSYEEADA

SEQ ID NO: 10358 - protein, 9 aa, Neisseria
NLDNAKLRT

SEQ ID NO: 10359 - protein, 8 aa, Neisseria
LGQDHARA

SEQ ID NO: 10360 - protein, 18 aa, Neisseria
IMAKKNNKTKIQKPEAAL

SEQ ID NO: 10361 - protein, 19 aa, Neisseria
QKMRALFEDAESGDIRAQH

SEQ ID NO: 10362 - protein, 10 aa, Neisseria
ADIEERDSDI

SEQ ID NO: 10363 - protein, 7 aa, Neisseria
MGTRKRA

SEQ ID NO: 10364 - protein, 20 aa, Neisseria
APPRNATPEEEKLSDQAYEM

SEQ ID NO: 10365 - protein, 8 aa, Neisseria
KWDKDNGL

SEQ ID NO: 10366 - protein, 11 aa, Neisseria
LRTRENPEGEA

SEQ ID NO: 10367 - protein, 10 aa, Neisseria
QKSRSVQQAR

SEQ ID NO: 10368 - protein, 9 aa, Neisseria
ATKEEKNTL

SEQ ID NO: 10369 - protein, 7 aa, Neisseria
EGMEIEL

SEQ ID NO: 10370 - protein, 8 aa, Neisseria
DWCEKSAA

SEQ ID NO: 10371 - protein, 9 aa, Neisseria
SGADGKSST

SEQ ID NO: 10372 - protein, 15 aa, Neisseria
NEVRRDLLVSDAKQV

SEQ ID NO: 10373 - protein, 17 aa, Neisseria
DPNRVPKFEFDTREPKD

SEQ ID NO: 10374 - protein, 7 aa, Neisseria
WVRDKLV

SEQ ID NO: 10375 - protein, 9 aa, Neisseria
DVQEGEAVL

SEQ ID NO: 10376 - protein, 8 aa, Neisseria
QVPDNPVN

SEQ ID NO: 10377 - protein, 18 aa, Neisseria
VPSKATGRHQEILDGALD

SEQ ID NO: 10378 - protein, 7 aa, Neisseria
SYEEADA

SEQ ID NO: 10379 - protein, 5 aa, Neisseria
DNAKL

SEQ ID NO: 10380 - protein, 5 aa, Neisseria
DHARA

SEQ ID NO: 10381 - protein, 14 aa, Neisseria
RLLADTQRQLDRTA

SEQ ID NO: 10382 - protein, 10 aa, Neisseria
AFNRLARSGK

SEQ ID NO: 10383 - protein, 5 aa, Neisseria
SQNDL

SEQ ID NO: 10384 - protein, 16 aa, Neisseria
GTGFADKMGKIGRFGA

SEQ ID NO: 10385 - protein, 9 aa, Neisseria
DENINRVSR

SEQ ID NO: 10386 - protein, 9 aa, Neisseria
ALDLISGMM

SEQ ID NO: 10387 - protein, 10 aa, Neisseria
TAKLIKTLKD

SEQ ID NO: 10388 - protein, 5 aa, Neisseria
LQSGL

SEQ ID NO: 10389 - protein, 11 aa, Neisseria
DMVRELPSLLS

SEQ ID NO: 10390 - protein, 17 aa, Neisseria
QAGMNGVGGLDYLLSLL

SEQ ID NO: 10391 - protein, 12 aa, Neisseria
EAATNVQNLLSK

SEQ ID NO: 10392 - protein, 24 aa, Neisseria
DTIGRLKKMANPNDPKKGVDWIGS

SEQ ID NO: 10393 - protein, 8 aa, Neisseria
QVLSRLAD

SEQ ID NO: 10394 - protein, 6 aa, Neisseria
QLLPDL

SEQ ID NO: 10395 - protein, 14 aa, Neisseria
ATDMTQIREYMASL

SEQ ID NO: 10396 - protein, 6 aa, Neisseria
ESLTGT

SEQ ID NO: 10397 - protein, 10 aa, Neisseria
ETSFKKLAAE

SEQ ID NO: 10398 - protein, 5 aa, Neisseria
LTTAA

SEQ ID NO: 10399 - protein, 7 aa, Neisseria
GFLKDVG

SEQ ID NO: 10400 - protein, 5 aa, Neisseria
AGSGL

SEQ ID NO: 10401 - protein, 8 aa, Neisseria
LPKGLRGT

SEQ ID NO: 10402 - protein, 10 aa, Neisseria
TTPEMINRLK

SEQ ID NO: 10403 - protein, 7 aa, Neisseria
PQYLAAP

SEQ ID NO: 10404 - protein, 11 aa, Neisseria
QPTDKMLSPLF

SEQ ID NO: 10405 - protein, 11 aa, Neisseria
TGLAQVQSAMA

SEQ ID NO: 10406 - protein, 5 aa, Neisseria
NEVSR

SEQ ID NO: 10407 - protein, 6 aa, Neisseria
MANGNM

SEQ ID NO: 10408 - protein, 34 aa, Neisseria
ARDDGARRLLADTQRQLDRTAKSRAQLERQSHTY

SEQ ID NO: 10409 - protein, 10 aa, Neisseria
GIRSEKQIQR

SEQ ID NO: 10410 - protein, 15 aa, Neisseria
RLARSGKASQNDLAR

SEQ ID NO: 10411 - protein, 29 aa, Neisseria
TRNRIRELNAELKQGTGFADKMGKIGRFG

SEQ ID NO: 10412 - protein, 18 aa, Neisseria
PAMDNRKQLDENINRVSR

SEQ ID NO: 10413 - protein, 10 aa, Neisseria
AFIEDNSKSA

SEQ ID NO: 10414 - protein, 10 aa, Neisseria
EGAQQIKDLA

SEQ ID NO: 10415 - protein, 14 aa, Neisseria
LVEKNGGTHDKALD

SEQ ID NO: 10416 - protein, 6 aa, Neisseria
QTKNEA

SEQ ID NO: 10417 - protein, 11 aa, Neisseria
SEGSGEDTAKL

SEQ ID NO: 10418 - protein, 15 aa, Neisseria
KTLKDGGMSGKDLQL

SEQ ID NO: 10419 - protein, 18 aa, Neisseria
SGLDGTFEVRDMVRELPS

SEQ ID NO: 10420 - protein, 11 aa, Neisseria
AANKSGSPAEA

SEQ ID NO: 10421 - protein, 27 aa, Neisseria
SKTLSPDTIGRLKKMANPNDPKKGVDW

SEQ ID NO: 10422 - protein, 9 aa, Neisseria
VQGKQNGEN

SEQ ID NO: 10423 - protein, 25 aa, Neisseria
MLVKDKQYQDYKKRAAAGDKTAAEQ

SEQ ID NO: 10424 - protein, 7 aa, Neisseria
TQIREYM

SEQ ID NO: 10425 - protein, 13 aa, Neisseria
DNGKIAKNNEARM

SEQ ID NO: 10426 - protein, 8 aa, Neisseria
AQQEQQES

SEQ ID NO: 10427 - protein, 7 aa, Neisseria
AMLRESL

SEQ ID NO: 10428 - protein, 12 aa, Neisseria
VDMETSFKKLAA

SEQ ID NO: 10429 - protein, 10 aa, Neisseria
TAGGGKGAGF

SEQ ID NO: 10430 - protein, 7 aa, Neisseria
KDVGSKA

SEQ ID NO: 10431 - protein, 7 aa, Neisseria
GKASAGG

SEQ ID NO: 10432 - protein, 5 aa, Neisseria
AAGGK

SEQ ID NO: 10433 - protein, 19 aa, Neisseria
GKSAGSGLMNNPALVKRAG

SEQ ID NO: 10434 - protein, 20 aa, Neisseria
SESLGDGTLPKGLRGTKTTP

SEQ ID NO: 10435 - protein, 26 aa, Neisseria
MINRLKNNGIRFEPAPKREQARGGVP

SEQ ID NO: 10436 - protein, 13 aa, Neisseria
APSAQPTDKMLSP

SEQ ID NO: 10437 - protein, 20 aa, Neisseria
SASQTINTNVSLNIDGRVIA

SEQ ID NO: 10438 - protein, 6 aa, Neisseria
EVSRYQ

SEQ ID NO: 10439 - protein, 6 aa, Neisseria
GRGAGQ

SEQ ID NO: 10440 - protein, 31 aa, Neisseria
ARDDGARRLLADTQRQLDRTAKSRAQLERQS

SEQ ID NO: 10441 - protein, 9 aa, Neisseria
IRSEKQIQR

SEQ ID NO: 10442 - protein, 15 aa, Neisseria
RLARSGKASQNDLAR

SEQ ID NO: 10443 - protein, 14 aa, Neisseria
TRNRIRELNAELKQ

SEQ ID NO: 10444 - protein, 10 aa, Neisseria
FADKMGKIGR

SEQ ID NO: 10445 - protein, 18 aa, Neisseria
PAMDNRKQLDENINRVSR

SEQ ID NO: 10446 - protein, 8 aa, Neisseria
AFIEDNSK

SEQ ID NO: 10447 - protein, 10 aa, Neisseria
EGAQQIKDLA

SEQ ID NO: 10448 - protein, 14 aa, Neisseria
LVEKNGGTHDKALD

SEQ ID NO: 10449 - protein, 6 aa, Neisseria
QTKNEA

SEQ ID NO: 10450 - protein, 11 aa, Neisseria
SEGSGEDTAKL

SEQ ID NO: 10451 - protein, 15 aa, Neisseria
KTLKDGGMSGKDLQL

SEQ ID NO: 10452 - protein, 11 aa, Neisseria
FEVRDMVRELP

SEQ ID NO: 10453 - protein, 11 aa, Neisseria
AANKSGSPAEA

SEQ ID NO: 10454 - protein, 18 aa, Neisseria
TIGRLKKMANPNDPKKGV

SEQ ID NO: 10455 - protein, 9 aa, Neisseria
VQGKQNGEN

SEQ ID NO: 10456 - protein, 25 aa, Neisseria
MLVKDKQYQDYKKRAAAGDKTAAEQ

SEQ ID NO: 10457 - protein, 7 aa, Neisseria
TQIREYM

SEQ ID NO: 10458 - protein, 13 aa, Neisseria
DNGKIAKNNEARM

SEQ ID NO: 10459 - protein, 8 aa, Neisseria
AQQEQQES

SEQ ID NO: 10460 - protein, 7 aa, Neisseria
AMLRESL

SEQ ID NO: 10461 - protein, 12 aa, Neisseria
VDMETSFKKLAA

SEQ ID NO: 10462 - protein, 5 aa, Neisseria
KDVGS

SEQ ID NO: 10463 - protein, 6 aa, Neisseria
LVKRAG

SEQ ID NO: 10464 - protein, 10 aa, Neisseria
KGLRGTKTTP

SEQ ID NO: 10465 - protein, 24 aa, Neisseria
MINRLKNNGIRFEPAPKREQARGG

SEQ ID NO: 10466 - protein, 7 aa, Neisseria
QPTDKML

SEQ ID NO: 10467 - protein, 7 aa, Neisseria
IDGRVIA

SEQ ID NO: 10468 - protein, 7 aa, Neisseria
TLLQDAS

SEQ ID NO: 10469 - protein, 15 aa, Neisseria
DESNGKALAEHARPF

SEQ ID NO: 10470 - protein, 15 aa, Neisseria
YAGRLKKLLDALEQP

SEQ ID NO: 10471 - protein, 12 aa, Neisseria
PVWGRMHNMIAA

SEQ ID NO: 10472 - protein, 8 aa, Neisseria
IANIDTYR

SEQ ID NO: 10473 - protein, 10 aa, Neisseria
VSALWGSALG

SEQ ID NO: 10474 - protein, 14 aa, Neisseria
FGAVRRLFDLDKIA

SEQ ID NO: 10475 - protein, 11 aa, Neisseria
GSAKLFADISV

SEQ ID NO: 10476 - protein, 16 aa, Neisseria
LTGRFSDGLQNRLNRL

SEQ ID NO: 10477 - protein, 9 aa, Neisseria
QAVRLLSTS

SEQ ID NO: 10478 - protein, 8 aa, Neisseria
APDLIEVN

SEQ ID NO: 10479 - protein, 8 aa, Neisseria
ALRAVQTA

SEQ ID NO: 10480 - protein, 6 aa, Neisseria
QTAESL

SEQ ID NO: 10481 - protein, 7 aa, Neisseria
RLNALVA

SEQ ID NO: 10482 - protein, 21 aa, Neisseria
GTIHQIAHEFYGDIARAAELV

SEQ ID NO: 10483 - protein, 11 aa, Neisseria
LQDASYKGVGF

SEQ ID NO: 10484 - protein, 16 aa, Neisseria
EVVDESNGKALAEHAR

SEQ ID NO: 10485 - protein, 11 aa, Neisseria
IDLEDMGMTGR

SEQ ID NO: 10486 - protein, 21 aa, Neisseria
GKGYAGRLKKLLDALEQPGGG

SEQ ID NO: 10487 - protein, 8 aa, Neisseria
SYRHEADY

SEQ ID NO: 10488 - protein, 9 aa, Neisseria
TFREAAEAQ

SEQ ID NO: 10489 - protein, 7 aa, Neisseria
DTYREAA

SEQ ID NO: 10490 - protein, 7 aa, Neisseria
RLFDLDK

SEQ ID NO: 10491 - protein, 9 aa, Neisseria
AFPDRGGYS

SEQ ID NO: 10492 - protein, 5 aa, Neisseria
FKNGS

SEQ ID NO: 10493 - protein, 9 aa, Neisseria
TGIRREAGL

SEQ ID NO: 10494 - protein, 9 aa, Neisseria
WSPRQRFDG

SEQ ID NO: 10495 - protein, 11 aa, Neisseria
VADRAAAIPDN

SEQ ID NO: 10496 - protein, 19 aa, Neisseria
GRFSDGLQNRLNRLTAKQV

SEQ ID NO: 10497 - protein, 8 aa, Neisseria
AHGEEMTA

SEQ ID NO: 10498 - protein, 15 aa, Neisseria
DLIEVNRAMRRRMQA

SEQ ID NO: 10499 - protein, 9 aa, Neisseria
AAESGGLTA

SEQ ID NO: 10500 - protein, 10 aa, Neisseria
QTAESLRAAA

SEQ ID NO: 10501 - protein, 6 aa, Neisseria
NQKPPL

SEQ ID NO: 10502 - protein, 7 aa, Neisseria
QAPIDGT

SEQ ID NO: 10503 - protein, 6 aa, Neisseria
IARAAE

SEQ ID NO: 10504 - protein, 13 aa, Neisseria
FIKRGTLVNSYAK

SEQ ID NO: 10505 - protein, 16 aa, Neisseria
EVVDESNGKALAEHAR

SEQ ID NO: 10506 - protein, 9 aa, Neisseria
IDLEDMGMT

SEQ ID NO: 10507 - protein, 16 aa, Neisseria
YAGRLKKLLDALEQPG

SEQ ID NO: 10508 - protein, 5 aa, Neisseria
HEADY

SEQ ID NO: 10509 - protein, 9 aa, Neisseria
TFREAAEAQ

SEQ ID NO: 10510 - protein, 7 aa, Neisseria
DTYREAA

SEQ ID NO: 10511 - protein, 7 aa, Neisseria
RLFDLDK

SEQ ID NO: 10512 - protein, 7 aa, Neisseria
AFPDRGG

SEQ ID NO: 10513 - protein, 9 aa, Neisseria
TGIRREAGL

SEQ ID NO: 10514 - protein, 7 aa, Neisseria
PRQRFDG

SEQ ID NO: 10515 - protein, 7 aa, Neisseria
VADRAAA

SEQ ID NO: 10516 - protein, 10 aa, Neisseria
LQNRLNRLTA

SEQ ID NO: 10517 - protein, 8 aa, Neisseria
AHGEEMTA

SEQ ID NO: 10518 - protein, 15 aa, Neisseria
DLIEVNRAMRRRMQA

SEQ ID NO: 10519 - protein, 6 aa, Neisseria
AAESGG

SEQ ID NO: 10520 - protein, 7 aa, Neisseria
ESLRAAA

SEQ ID NO: 10521 - protein, 6 aa, Neisseria
IARAAE

SEQ ID NO: 10522 - protein, 8 aa, Neisseria
AGWMRWLE

SEQ ID NO: 10523 - protein, 6 aa, Neisseria
RYISAV

SEQ ID NO: 10524 - protein, 22 aa, Neisseria
SKIFHAALTNFPALDGMDEVLA

SEQ ID NO: 10525 - protein, 14 aa, Neisseria
NPMKELLQQLFDLP

SEQ ID NO: 10526 - protein, 5 aa, Neisseria
DVFAQ

SEQ ID NO: 10527 - protein, 12 aa, Neisseria
KYAPISVVQELQ

SEQ ID NO: 10528 - protein, 11 aa, Neisseria
WAKGVLKQPGG

SEQ ID NO: 10529 - protein, 8 aa, Neisseria
AFLTGFIE

SEQ ID NO: 10530 - protein, 6 aa, Neisseria
MSKNAQ

SEQ ID NO: 10531 - protein, 9 aa, Neisseria
EVQPKDGRI

SEQ ID NO: 10532 - protein, 5 aa, Neisseria
LPYGE

SEQ ID NO: 10533 - protein, 12 aa, Neisseria
RAVDGRPTDVPA

SEQ ID NO: 10534 - protein, 7 aa, Neisseria
TEENGHD

SEQ ID NO: 10535 - protein, 9 aa, Neisseria
LANSSRNQL

SEQ ID NO: 10536 - protein, 12 aa, Neisseria
TLYKEKNGQPAP

SEQ ID NO: 10537 - protein, 9 aa, Neisseria
EFTPKGMFA

SEQ ID NO: 10538 - protein, 7 aa, Neisseria
EWTDKAA

SEQ ID NO: 10539 - protein, 6 aa, Neisseria
AAKEYR

SEQ ID NO: 10540 - protein, 9 aa, Neisseria
FSYDTKGYV

SEQ ID NO: 10541 - protein, 7 aa, Neisseria
DGMDEVL

SEQ ID NO: 10542 - protein, 16 aa, Neisseria
QILKPETEQNPMKELL

SEQ ID NO: 10543 - protein, 10 aa, Neisseria
PDAGEEELKA

SEQ ID NO: 10544 - protein, 10 aa, Neisseria
VEAKPKDVAL

SEQ ID NO: 10545 - protein, 8 aa, Neisseria
LAEKDSRI

SEQ ID NO: 10546 - protein, 11 aa, Neisseria
QTAKPDLTKYA

SEQ ID NO: 10547 - protein, 10 aa, Neisseria
AKQEADKGNE

SEQ ID NO: 10548 - protein, 7 aa, Neisseria
PAQKEWA

SEQ ID NO: 10549 - protein, 7 aa, Neisseria
VLKQPGG

SEQ ID NO: 10550 - protein, 14 aa, Neisseria
GSQTGGKAPDERVA

SEQ ID NO: 10551 - protein, 7 aa, Neisseria
TAEEAAA

SEQ ID NO: 10552 - protein, 16 aa, Neisseria
GMSGEEFVKIKESEGK

SEQ ID NO: 10553 - protein, 6 aa, Neisseria
MSKNAQ

SEQ ID NO: 10554 - protein, 8 aa, Neisseria
VQPKDGRI

SEQ ID NO: 10555 - protein, 9 aa, Neisseria
RAVDGRPTD

SEQ ID NO: 10556 - protein, 5 aa, Neisseria
EENGH

SEQ ID NO: 10557 - protein, 9 aa, Neisseria
TLYKEKNGQ

SEQ ID NO: 10558 - protein, 7 aa, Neisseria
EWTDKAA

SEQ ID NO: 10559 - protein, 6 aa, Neisseria
AAKEYR

SEQ ID NO: 10560 - protein, 7 aa, Neisseria
DGMDEVL

SEQ ID NO: 10561 - protein, 14 aa, Neisseria
LKPETEQNPMKELL

SEQ ID NO: 10562 - protein, 10 aa, Neisseria
PDAGEEELKA

SEQ ID NO: 10563 - protein, 10 aa, Neisseria
VEAKPKDVAL

SEQ ID NO: 10564 - protein, 8 aa, Neisseria
LAEKDSRI

SEQ ID NO: 10565 - protein, 8 aa, Neisseria
TAKPDLTK

SEQ ID NO: 10566 - protein, 10 aa, Neisseria
AKQEADKGNE

SEQ ID NO: 10567 - protein, 7 aa, Neisseria
PAQKEWA

SEQ ID NO: 10568 - protein, 11 aa, Neisseria
TGGKAPDERVA

SEQ ID NO: 10569 - protein, 7 aa, Neisseria
TAEEAAA

SEQ ID NO: 10570 - protein, 14 aa, Neisseria
SGEEFVKIKESEGK

SEQ ID NO: 10571 - protein, 13 aa, Neisseria
TQQVEHVDFVAVA

SEQ ID NO: 10572 - protein, 5 aa, Neisseria
NVAAK

SEQ ID NO: 10573 - protein, 5 aa, Neisseria
CDLAV

SEQ ID NO: 10574 - protein, 7 aa, Neisseria
VGELQDF

SEQ ID NO: 10575 - protein, 5 aa, Neisseria
SITSR

SEQ ID NO: 10576 - protein, 6 aa, Neisseria
KAVVSI

SEQ ID NO: 10577 - protein, 11 aa, Neisseria
MRPKPRFRRSV

SEQ ID NO: 10578 - protein, 5 aa, Neisseria
HSTQQ

SEQ ID NO: 10579 - protein, 9 aa, Neisseria
HALSRRQTV

SEQ ID NO: 10580 - protein, 32 aa, Neisseria
AHQDGRQILKRSSEPPQIRVDFGSGVHQRGLC

SEQ ID NO: 10581 - protein, 16 aa, Neisseria
QLTETRNHILNRRVCH

SEQ ID NO: 10582 - protein, 5 aa, Neisseria
CSIGS

SEQ ID NO: 10583 - protein, 25 aa, Neisseria
SPTSARFTSRQPPSNSRPPRQNSLP

SEQ ID NO: 10584 - protein, 7 aa, Neisseria
LSAKASA

SEQ ID NO: 10585 - protein, 7 aa, Neisseria
SASSADS

SEQ ID NO: 10586 - protein, 7 aa, Neisseria
SACTASN

SEQ ID NO: 10587 - protein, 9 aa, Neisseria
LMSSNDGAA

SEQ ID NO: 10588 - protein, 9 aa, Neisseria
CFRRRRIRI

SEQ ID NO: 10589 - protein, 11 aa, Neisseria
MRPKPRFRRSV

SEQ ID NO: 10590 - protein, 8 aa, Neisseria
ALSRRQTV

SEQ ID NO: 10591 - protein, 22 aa, Neisseria
AHQDGRQILKRSSEPPQIRVDF

SEQ ID NO: 10592 - protein, 7 aa, Neisseria
QLTETRN

SEQ ID NO: 10593 - protein, 7 aa, Neisseria
ILNRRVC

SEQ ID NO: 10594 - protein, 17 aa, Neisseria
FTSRQPPSNSRPPRQNS

SEQ ID NO: 10595 - protein, 7 aa, Neisseria
LSAKASA

SEQ ID NO: 10596 - protein, 7 aa, Neisseria
SSNDGAA

SEQ ID NO: 10597 - protein, 9 aa, Neisseria
CFRRRRIRI

SEQ ID NO: 10598 - protein, 5 aa, Neisseria
LAKKT

SEQ ID NO: 10599 - protein, 11 aa, Neisseria
QTAKNIGETLR

SEQ ID NO: 10600 - protein, 5 aa, Neisseria
RVQLS

SEQ ID NO: 10601 - protein, 13 aa, Neisseria
ADETLQDLEHLQE

SEQ ID NO: 10602 - protein, 25 aa, Neisseria
KLAKKTAQTAKNIGETLRAAFRGKI

SEQ ID NO: 10603 - protein, 23 aa, Neisseria
SSEPIQRVQLSGLADETLQDLEH

SEQ ID NO: 10604 - protein, 13 aa, Neisseria
YGFASHPPDGSEA

SEQ ID NO: 10605 - protein, 6 aa, Neisseria
LGGNTS

SEQ ID NO: 10606 - protein, 15 aa, Neisseria
QHGSYRIKNLKPGET

SEQ ID NO: 10607 - protein, 21 aa, Neisseria
NHEGAKIVIKQGKIIEADCDV

SEQ ID NO: 10608 - protein, 8 aa, Neisseria
RVNCKQYE

SEQ ID NO: 10609 - protein, 5 aa, Neisseria
TDAKF

SEQ ID NO: 10610 - protein, 6 aa, Neisseria
QINGNG

SEQ ID NO: 10611 - protein, 29 aa, Neisseria
AVEGGDGATFSGDVNQTGGSFNTDGDVVA

SEQ ID NO: 10612 - protein, 18 aa, Neisseria
QHPHTDSIGGKTLPAEPA

SEQ ID NO: 10613 - protein, 23 aa, Neisseria
KLAKKTAQTAKNIGETLRAAFRG

SEQ ID NO: 10614 - protein, 11 aa, Neisseria
LADETLQDLEH

SEQ ID NO: 10615 - protein, 6 aa, Neisseria
PPDGSE

SEQ ID NO: 10616 - protein, 10 aa, Neisseria
YRIKNLKPGE

SEQ ID NO: 10617 - protein, 19 aa, Neisseria
EGAKIVIKQGKIIEADCDV

SEQ ID NO: 10618 - protein, 6 aa, Neisseria
NCKQYE

SEQ ID NO: 10619 - protein, 5 aa, Neisseria
TDAKF

SEQ ID NO: 10620 - protein, 7 aa, Neisseria
FNTDGDV

SEQ ID NO: 10621 - protein, 9 aa, Neisseria
QHPHTDSIG

SEQ ID NO: 10622 - protein, 16 aa, Neisseria
EADDLAGQIHTLPAVW

SEQ ID NO: 10623 - protein, 8 aa, Neisseria
GVCGRYQD

SEQ ID NO: 10624 - protein, 11 aa, Neisseria
DLIRAVRRLLD

SEQ ID NO: 10625 - protein, 8 aa, Neisseria
VPKAVRAI

SEQ ID NO: 10626 - protein, 8 aa, Neisseria
PERTDNPD

SEQ ID NO: 10627 - protein, 18 aa, Neisseria
HIFTKYQGTLSEPWPDFE

SEQ ID NO: 10628 - protein, 5 aa, Neisseria
DPQSA

SEQ ID NO: 10629 - protein, 14 aa, Neisseria
RTVKSYNGEADDLA

SEQ ID NO: 10630 - protein, 22 aa, Neisseria
YGGSKVEPASTGGVCGRYQDTA

SEQ ID NO: 10631 - protein, 51 aa, Neisseria
RNLRNEQAQRQGGIDSREIGSNDLIRAVRRLLDGQRLGFADSRGLVPKAVR

SEQ ID NO: 10632 - protein, 21 aa, Neisseria
NTCGLENDRYPERTDNPDDPN

SEQ ID NO: 10633 - protein, 29 aa, Neisseria
YQGTLSEPWPDFEGLDGKIYDPQSADEIP

SEQ ID NO: 10634 - protein, 6 aa, Neisseria
TLKDKQ

SEQ ID NO: 10635 - protein, 9 aa, Neisseria
YNGEADDLA

SEQ ID NO: 10636 - protein, 7 aa, Neisseria
SKVEPAS

SEQ ID NO: 10637 - protein, 6 aa, Neisseria
RYQDTA

SEQ ID NO: 10638 - protein, 21 aa, Neisseria
RNLRNEQAQRQGGIDSREIGS

SEQ ID NO: 10639 - protein, 14 aa, Neisseria
DLIRAVRRLLDGQR

SEQ ID NO: 10640 - protein, 9 aa, Neisseria
GFADSRGLV

SEQ ID NO: 10641 - protein, 18 aa, Neisseria
GLENDRYPERTDNPDDPN

SEQ ID NO: 10642 - protein, 9 aa, Neisseria
EGLDGKIYD

SEQ ID NO: 10643 - protein, 7 aa, Neisseria
QSADEIP

SEQ ID NO: 10644 - protein, 6 aa, Neisseria
TLKDKQ

SEQ ID NO: 10645 - protein, 8 aa, Neisseria
DTLGGIPE

SEQ ID NO: 10646 - protein, 8 aa, Neisseria
PRPSDYHE

SEQ ID NO: 10647 - protein, 5 aa, Neisseria
AAAAR

SEQ ID NO: 10648 - protein, 6 aa, Neisseria
IDSFYR

SEQ ID NO: 10649 - protein, 5 aa, Neisseria
ARQAD

SEQ ID NO: 10650 - protein, 5 aa, Neisseria
IAAAR

SEQ ID NO: 10651 - protein, 15 aa, Neisseria
IETAPGLDALEKEIE

SEQ ID NO: 10652 - protein, 16 aa, Neisseria
FKNGFYDDTLGGIPEG

SEQ ID NO: 10653 - protein, 6 aa, Neisseria
VRAEEY

SEQ ID NO: 10654 - protein, 36 aa, Neisseria
AQGGQIAADSDGRPVLTPPRPSDYHEWDGKKWKISK

SEQ ID NO: 10655 - protein, 7 aa, Neisseria
RFAKQKT

SEQ ID NO: 10656 - protein, 11 aa, Neisseria
LAEKADELKNS

SEQ ID NO: 10657 - protein, 26 aa, Neisseria
PQVEIDSFYRQEKEALARQADNNAPT

SEQ ID NO: 10658 - protein, 8 aa, Neisseria
KVIEKSAR

SEQ ID NO: 10659 - protein, 13 aa, Neisseria
IGKRQQLEDKLNT

SEQ ID NO: 10660 - protein, 15 aa, Neisseria
ETAPGLDALEKEIEE

SEQ ID NO: 10661 - protein, 6 aa, Neisseria
VRAEEY

SEQ ID NO: 10662 - protein, 9 aa, Neisseria
IAADSDGRP

SEQ ID NO: 10663 - protein, 18 aa, Neisseria
PRPSDYHEWDGKKWKISK

SEQ ID NO: 10664 - protein, 7 aa, Neisseria
RFAKQKT

SEQ ID NO: 10665 - protein, 10 aa, Neisseria
LAEKADELKN

SEQ ID NO: 10666 - protein, 16 aa, Neisseria
YRQEKEALARQADNNA

SEQ ID NO: 10667 - protein, 8 aa, Neisseria
KVIEKSAR

SEQ ID NO: 10668 - protein, 13 aa, Neisseria
IGKRQQLEDKLNT

SEQ ID NO: 10669 - protein, 9 aa, Neisseria
DALEKEIEE

SEQ ID NO: 10670 - protein, 5 aa, Neisseria
LLANN

SEQ ID NO: 10671 - protein, 7 aa, Neisseria
QPIAIIA

SEQ ID NO: 10672 - protein, 12 aa, Neisseria
HHQGYKSAFAKQ

SEQ ID NO: 10673 - protein, 12 aa, Neisseria
AVIDKMERDKAQ

SEQ ID NO: 10674 - protein, 20 aa, Neisseria
NYARELELARAEAKKYEVKA

SEQ ID NO: 10675 - protein, 19 aa, Neisseria
LAKKQAEVSRLKTERDLCK

SEQ ID NO: 10676 - protein, 13 aa, Neisseria
PFPPDSRNPNTGF

SEQ ID NO: 10677 - protein, 8 aa, Neisseria
SPQIPPNF

SEQ ID NO: 10678 - protein, 12 aa, Neisseria
AVIDKMERDKAQ

SEQ ID NO: 10679 - protein, 20 aa, Neisseria
NYARELELARAEAKKYEVKA

SEQ ID NO: 10680 - protein, 18 aa, Neisseria
LAKKQAEVSRLKTERDLC

SEQ ID NO: 10681 - protein, 8 aa, Neisseria
PDSRNPNT

SEQ ID NO: 10682 - protein, 8 aa, Neisseria
SFFALVFA

SEQ ID NO: 10683 - protein, 8 aa, Neisseria
ATEVPKNP

SEQ ID NO: 10684 - protein, 13 aa, Neisseria
AFVAKLARLFRNA

SEQ ID NO: 10685 - protein, 8 aa, Neisseria
NLAGTVDD

SEQ ID NO: 10686 - protein, 13 aa, Neisseria
EDVYEHCLGCYQM

SEQ ID NO: 10687 - protein, 8 aa, Neisseria
YRDVANDE

SEQ ID NO: 10688 - protein, 6 aa, Neisseria
SNRIAS

SEQ ID NO: 10689 - protein, 9 aa, Neisseria
QNMRELMPR

SEQ ID NO: 10690 - protein, 13 aa, Neisseria
EKEVRRYAEAAAR

SEQ ID NO: 10691 - protein, 5 aa, Neisseria
INPRW

SEQ ID NO: 10692 - protein, 13 aa, Neisseria
LSDTATEVPKNPN

SEQ ID NO: 10693 - protein, 7 aa, Neisseria
FRNADRA

SEQ ID NO: 10694 - protein, 24 aa, Neisseria
ESIRTEENLAGTVDDGPLQSEKDY

SEQ ID NO: 10695 - protein, 10 aa, Neisseria
RLSRLKEKAK

SEQ ID NO: 10696 - protein, 7 aa, Neisseria
TEQEHGK

SEQ ID NO: 10697 - protein, 6 aa, Neisseria
HIGEGG

SEQ ID NO: 10698 - protein, 10 aa, Neisseria
LSQRSPEAFV

SEQ ID NO: 10699 - protein, 10 aa, Neisseria
YLYRNDRPFS

SEQ ID NO: 10700 - protein, 14 aa, Neisseria
VHGENYETTGEYRV

SEQ ID NO: 10701 - protein, 6 aa, Neisseria
QPDGSV

SEQ ID NO: 10702 - protein, 12 aa, Neisseria
AAGRGKIGEDVY

SEQ ID NO: 10703 - protein, 47 aa, Neisseria
KYRDVANDEQKVWDFRKESNRIASDSRNSVFYQNMRELMPRGMKANS

SEQ ID NO: 10704 - protein, 10 aa, Neisseria
GYDADGLPQK

SEQ ID NO: 10705 - protein, 19 aa, Neisseria
SFDNGKKRQSFEYYLKNGN

SEQ ID NO: 10706 - protein, 7 aa, Neisseria
LKADGVT

SEQ ID NO: 10707 - protein, 19 aa, Neisseria
LDGGRIVREEKQGDRLPDF

SEQ ID NO: 10708 - protein, 26 aa, Neisseria
ENLEKEVRRYAEAAARRSGGRRDLSH

SEQ ID NO: 10709 - protein, 9 aa, Neisseria
TATEVPKNP

SEQ ID NO: 10710 - protein, 7 aa, Neisseria
FRNADRA

SEQ ID NO: 10711 - protein, 9 aa, Neisseria
ESIRTEENL

SEQ ID NO: 10712 - protein, 13 aa, Neisseria
TVDDGPLQSEKDY

SEQ ID NO: 10713 - protein, 10 aa, Neisseria
RLSRLKEKAK

SEQ ID NO: 10714 - protein, 7 aa, Neisseria
TEQEHGK

SEQ ID NO: 10715 - protein, 7 aa, Neisseria
LSQRSPE

SEQ ID NO: 10716 - protein, 7 aa, Neisseria
YRNDRPF

SEQ ID NO: 10717 - protein, 9 aa, Neisseria
ENYETTGEY

SEQ ID NO: 10718 - protein, 12 aa, Neisseria
AAGRGKIGEDVY

SEQ ID NO: 10719 - protein, 28 aa, Neisseria
KYRDVANDEQKVWDFRKESNRIASDSRN

SEQ ID NO: 10720 - protein, 11 aa, Neisseria
NMRELMPRGMK

SEQ ID NO: 10721 - protein, 7 aa, Neisseria
YDADGLP

SEQ ID NO: 10722 - protein, 8 aa, Neisseria
DNGKKRQS

SEQ ID NO: 10723 - protein, 7 aa, Neisseria
LKADGVT

SEQ ID NO: 10724 - protein, 15 aa, Neisseria
GGRIVREEKQGDRLP

SEQ ID NO: 10725 - protein, 26 aa, Neisseria
ENLEKEVRRYAEAAARRSGGRRDLSH

SEQ ID NO: 10726 - protein, 7 aa, Neisseria
CTMIPQY

SEQ ID NO: 10727 - protein, 10 aa, Neisseria
EVAETFKNDT

SEQ ID NO: 10728 - protein, 5 aa, Neisseria
HDYFA

SEQ ID NO: 10729 - protein, 9 aa, Neisseria
PRLQKLIDI

SEQ ID NO: 10730 - protein, 5 aa, Neisseria
QGYFA

SEQ ID NO: 10731 - protein, 8 aa, Neisseria
SLIATVAK

SEQ ID NO: 10732 - protein, 6 aa, Neisseria
LATLIN

SEQ ID NO: 10733 - protein, 6 aa, Neisseria
KLPAGL

SEQ ID NO: 10734 - protein, 8 aa, Neisseria
LGGLFKSG

SEQ ID NO: 10735 - protein, 11 aa, Neisseria
VQSAFQDVANA

SEQ ID NO: 10736 - protein, 13 aa, Neisseria
LDKAYDALSKQSR

SEQ ID NO: 10737 - protein, 8 aa, Neisseria
GALDLLDA

SEQ ID NO: 10738 - protein, 19 aa, Neisseria
LTRAENLADLYKALGGGLK

SEQ ID NO: 10739 - protein, 10 aa, Neisseria
PQYEQPKVEV

SEQ ID NO: 10740 - protein, 16 aa, Neisseria
ETFKNDTADSGIRAVD

SEQ ID NO: 10741 - protein, 13 aa, Neisseria
GWHDYFADPRLQK

SEQ ID NO: 10742 - protein, 10 aa, Neisseria
ALERNTSLRT

SEQ ID NO: 10743 - protein, 16 aa, Neisseria
EIYRKQYMIERNNLLP

SEQ ID NO: 10744 - protein, 21 aa, Neisseria
NANDSRQGSLSGGNVSSSYKV

SEQ ID NO: 10745 - protein, 10 aa, Neisseria
GRVRSSSEAA

SEQ ID NO: 10746 - protein, 7 aa, Neisseria
TANRDAA

SEQ ID NO: 10747 - protein, 11 aa, Neisseria
YFNERYAEEAM

SEQ ID NO: 10748 - protein, 17 aa, Neisseria
RVLKTREETYKLSELRY

SEQ ID NO: 10749 - protein, 14 aa, Neisseria
RQQEALIESAKADY

SEQ ID NO: 10750 - protein, 9 aa, Neisseria
ARSREQARN

SEQ ID NO: 10751 - protein, 9 aa, Neisseria
QPIPEDLPA

SEQ ID NO: 10752 - protein, 20 aa, Neisseria
VLLDRPDIRAAEHALKQANA

SEQ ID NO: 10753 - protein, 8 aa, Neisseria
VGTGSAEL

SEQ ID NO: 10754 - protein, 6 aa, Neisseria
LFKSGT

SEQ ID NO: 10755 - protein, 15 aa, Neisseria
GTNKANLDVAKLRQQ

SEQ ID NO: 10756 - protein, 25 aa, Neisseria
AAREQLDKAYDALSKQSRASKEALR

SEQ ID NO: 10757 - protein, 8 aa, Neisseria
LRYKHGVS

SEQ ID NO: 10758 - protein, 9 aa, Neisseria
LDAERSSYA

SEQ ID NO: 10759 - protein, 7 aa, Neisseria
LTRAENL

SEQ ID NO: 10760 - protein, 13 aa, Neisseria
LGGGLKRDTQTDK

SEQ ID NO: 10761 - protein, 7 aa, Neisseria
EQPKVEV

SEQ ID NO: 10762 - protein, 15 aa, Neisseria
ETFKNDTADSGIRAV

SEQ ID NO: 10763 - protein, 5 aa, Neisseria
PRLQK

SEQ ID NO: 10764 - protein, 8 aa, Neisseria
ALERNTSL

SEQ ID NO: 10765 - protein, 7 aa, Neisseria
YMIERNN

SEQ ID NO: 10766 - protein, 9 aa, Neisseria
NANDSRQGS

SEQ ID NO: 10767 - protein, 10 aa, Neisseria
GRVRSSSEAA

SEQ ID NO: 10768 - protein, 6 aa, Neisseria
ANRDAA

SEQ ID NO: 10769 - protein, 7 aa, Neisseria
RYAEEAM

SEQ ID NO: 10770 - protein, 17 aa, Neisseria
RVLKTREETYKLSELRY

SEQ ID NO: 10771 - protein, 14 aa, Neisseria
RQQEALIESAKADY

SEQ ID NO: 10772 - protein, 9 aa, Neisseria
ARSREQARN

SEQ ID NO: 10773 - protein, 6 aa, Neisseria
IPEDLP

SEQ ID NO: 10774 - protein, 19 aa, Neisseria
VLLDRPDIRAAEHALKQAN

SEQ ID NO: 10775 - protein, 11 aa, Neisseria
KANLDVAKLRQ

SEQ ID NO: 10776 - protein, 25 aa, Neisseria
AAREQLDKAYDALSKQSRASKEALR

SEQ ID NO: 10777 - protein, 9 aa, Neisseria
LDAERSSYA

SEQ ID NO: 10778 - protein, 7 aa, Neisseria
LTRAENL

SEQ ID NO: 10779 - protein, 10 aa, Neisseria
GLKRDTQTDK

SEQ ID NO: 10780 - protein, 9 aa, Neisseria
RLTNLLAAC

SEQ ID NO: 10781 - protein, 5 aa, Neisseria
LAADL

SEQ ID NO: 10782 - protein, 11 aa, Neisseria
KINVIQDYTHQ

SEQ ID NO: 10783 - protein, 5 aa, Neisseria
NHAAD

SEQ ID NO: 10784 - protein, 18 aa, Neisseria
HPADAYDGPKGGNYPKPT

SEQ ID NO: 10785 - protein, 20 aa, Neisseria
QRISDNYSNLGSNFSDRADE

SEQ ID NO: 10786 - protein, 5 aa, Neisseria
HNAKL

SEQ ID NO: 10787 - protein, 13 aa, Neisseria
RWGNSMEFINGVA

SEQ ID NO: 10788 - protein, 8 aa, Neisseria
GALNPFIS

SEQ ID NO: 10789 - protein, 7 aa, Neisseria
AAMRNIA

SEQ ID NO: 10790 - protein, 26 aa, Neisseria
AVIGGLGSVAGFEKNTREAVDRWIQE

SEQ ID NO: 10791 - protein, 27 aa, Neisseria
NAAETVEAVFNVAAAAKVAKLAKAAKP

SEQ ID NO: 10792 - protein, 7 aa, Neisseria
GDFADSY

SEQ ID NO: 10793 - protein, 8 aa, Neisseria
NGREIDAV

SEQ ID NO: 10794 - protein, 9 aa, Neisseria
TISAIDKPK

SEQ ID NO: 10795 - protein, 7 aa, Neisseria
KPLRRLT

SEQ ID NO: 10796 - protein, 16 aa, Neisseria
FITDNAQRQHYEPGGK

SEQ ID NO: 10797 - protein, 16 aa, Neisseria
GDPRGSVSDRTGKINV

SEQ ID NO: 10798 - protein, 14 aa, Neisseria
RFSGHGHEEHAPFD

SEQ ID NO: 10799 - protein, 17 aa, Neisseria
HAADSASEEKGNVDEGF

SEQ ID NO: 10800 - protein, 32 aa, Neisseria
NWEGHEHHPADAYDGPKGGNYPKPTGARDEYT

SEQ ID NO: 10801 - protein, 29 aa, Neisseria
HVNGTARSIKLNPTDTRSIRQRISDNYSN

SEQ ID NO: 10802 - protein, 28 aa, Neisseria
GSNFSDRADEANRKMFEHNAKLDRWGNS

SEQ ID NO: 10803 - protein, 8 aa, Neisseria
YAIDKAAM

SEQ ID NO: 10804 - protein, 5 aa, Neisseria
PAEGK

SEQ ID NO: 10805 - protein, 11 aa, Neisseria
GFEKNTREAVD

SEQ ID NO: 10806 - protein, 12 aa, Neisseria
WIQENPNAAETV

SEQ ID NO: 10807 - protein, 36 aa, Neisseria
KVAKLAKAAKPGKAAVSGDFADSYKKKLALSDSARQ

SEQ ID NO: 10808 - protein, 9 aa, Neisseria
QNAKYREAL

SEQ ID NO: 10809 - protein, 25 aa, Neisseria
DLIRRKTDGSSKFINGREIDAVTND

SEQ ID NO: 10810 - protein, 29 aa, Neisseria
IQAKRTISAIDKPKNFLNQKNRKQIKATI

SEQ ID NO: 10811 - protein, 11 aa, Neisseria
AANQQGKRAEF

SEQ ID NO: 10812 - protein, 16 aa, Neisseria
SYIESKGGIVKTGLGD

SEQ ID NO: 10813 - protein, 7 aa, Neisseria
KPLRRLT

SEQ ID NO: 10814 - protein, 11 aa, Neisseria
NAQRQHYEPGG

SEQ ID NO: 10815 - protein, 13 aa, Neisseria
GDPRGSVSDRTGK

SEQ ID NO: 10816 - protein, 7 aa, Neisseria
GHEEHAP

SEQ ID NO: 10817 - protein, 16 aa, Neisseria
HAADSASEEKGNVDEG

SEQ ID NO: 10818 - protein, 8 aa, Neisseria
WEGHEHHP

SEQ ID NO: 10819 - protein, 13 aa, Neisseria
DAYDGPKGGNYPK

SEQ ID NO: 10820 - protein, 7 aa, Neisseria
TGARDEY

SEQ ID NO: 10821 - protein, 7 aa, Neisseria
GTARSIK

SEQ ID NO: 10822 - protein, 14 aa, Neisseria
NPTDTRSIRQRISD

SEQ ID NO: 10823 - protein, 24 aa, Neisseria
FSDRADEANRKMFEHNAKLDRWGN

SEQ ID NO: 10824 - protein, 8 aa, Neisseria
YAIDKAAM

SEQ ID NO: 10825 - protein, 5 aa, Neisseria
PAEGK

SEQ ID NO: 10826 - protein, 11 aa, Neisseria
GFEKNTREAVD

SEQ ID NO: 10827 - protein, 8 aa, Neisseria
NPNAAETV

SEQ ID NO: 10828 - protein, 16 aa, Neisseria
KVAKLAKAAKPGKAAV

SEQ ID NO: 10829 - protein, 12 aa, Neisseria
DFADSYKKKLAL

SEQ ID NO: 10830 - protein, 7 aa, Neisseria
AKYREAL

SEQ ID NO: 10831 - protein, 11 aa, Neisseria
DLIRRKTDGSS

SEQ ID NO: 10832 - protein, 10 aa, Neisseria
INGREIDAVT

SEQ ID NO: 10833 - protein, 15 aa, Neisseria
IQAKRTISAIDKPKN

SEQ ID NO: 10834 - protein, 11 aa, Neisseria
QKNRKQIKATI

SEQ ID NO: 10835 - protein, 11 aa, Neisseria
AANQQGKRAEF

SEQ ID NO: 10836 - protein, 9 aa, Neisseria
SYIESKGGI

SEQ ID NO: 10837 - protein, 5 aa, Neisseria
ACAVP

SEQ ID NO: 10838 - protein, 10 aa, Neisseria
EAYDDGGRGH

SEQ ID NO: 10839 - protein, 12 aa, Neisseria
PVQNQAGTDDFR

SEQ ID NO: 10840 - protein, 6 aa, Neisseria
SCENGL

SEQ ID NO: 10841 - protein, 35 aa, Neisseria
VRVRHLDSGKVALRLDGRRAVLSSDVAASGERYTA

SEQ ID NO: 10842 - protein, 10 aa, Neisseria
TEWHQKGGEA

SEQ ID NO: 10843 - protein, 14 aa, Neisseria
DAYGNSVETSCRAR

SEQ ID NO: 10844 - protein, 10 aa, Neisseria
EAYDDGGRGH

SEQ ID NO: 10845 - protein, 7 aa, Neisseria
AGTDDFR

SEQ ID NO: 10846 - protein, 22 aa, Neisseria
VRVRHLDSGKVALRLDGRRAVL

SEQ ID NO: 10847 - protein, 10 aa, Neisseria
VAASGERYTA

SEQ ID NO: 10848 - protein, 7 aa, Neisseria
WHQKGGE

SEQ ID NO: 10849 - protein, 8 aa, Neisseria
VETSCRAR

SEQ ID NO: 10850 - protein, 5 aa, Neisseria
LGAIS

SEQ ID NO: 10851 - protein, 12 aa, Neisseria
VQSIRTMAEVYG

SEQ ID NO: 10852 - protein, 13 aa, Neisseria
DADLFEGAMKGMV

SEQ ID NO: 10853 - protein, 8 aa, Neisseria
EIKESTSG

SEQ ID NO: 10854 - protein, 12 aa, Neisseria
DGFVKVVSPIED

SEQ ID NO: 10855 - protein, 6 aa, Neisseria
EAVKKM

SEQ ID NO: 10856 - protein, 5 aa, Neisseria
VNLTR

SEQ ID NO: 10857 - protein, 12 aa, Neisseria
ERTVESVNTAAK

SEQ ID NO: 10858 - protein, 6 aa, Neisseria
KAIPED

SEQ ID NO: 10859 - protein, 9 aa, Neisseria
SLAGIPAEL

SEQ ID NO: 10860 - protein, 6 aa, Neisseria
SEIVAG

SEQ ID NO: 10861 - protein, 7 aa, Neisseria
LVGHIGN

SEQ ID NO: 10862 - protein, 9 aa, Neisseria
RRIPNPAKD

SEQ ID NO: 10863 - protein, 16 aa, Neisseria
KALDLVKSPEQWQKSL

SEQ ID NO: 10864 - protein, 11 aa, Neisseria
AAEKDRRDNEV

SEQ ID NO: 10865 - protein, 12 aa, Neisseria
NYYQDKPDADLF

SEQ ID NO: 10866 - protein, 25 aa, Neisseria
DPHSEYMDKKGYAEIKESTSGEFGG

SEQ ID NO: 10867 - protein, 7 aa, Neisseria
IGQEDGF

SEQ ID NO: 10868 - protein, 18 aa, Neisseria
SPIEDTPAERAGVKSGDF

SEQ ID NO: 10869 - protein, 9 aa, Neisseria
DNVSTRGMT

SEQ ID NO: 10870 - protein, 14 aa, Neisseria
EAVKKMRGKPGTKI

SEQ ID NO: 10871 - protein, 10 aa, Neisseria
LSRKNADKPI

SEQ ID NO: 10872 - protein, 8 aa, Neisseria
LIEPDYGY

SEQ ID NO: 10873 - protein, 8 aa, Neisseria
QFQERTVE

SEQ ID NO: 10874 - protein, 17 aa, Neisseria
NTAAKELVKENKGKPLK

SEQ ID NO: 10875 - protein, 9 aa, Neisseria
DLRDDPGGL

SEQ ID NO: 10876 - protein, 13 aa, Neisseria
VSTKGRDGKDRMV

SEQ ID NO: 10877 - protein, 6 aa, Neisseria
AIPEDY

SEQ ID NO: 10878 - protein, 6 aa, Neisseria
GMGGDS

SEQ ID NO: 10879 - protein, 5 aa, Neisseria
AELKT

SEQ ID NO: 10880 - protein, 6 aa, Neisseria
SGSASA

SEQ ID NO: 10881 - protein, 7 aa, Neisseria
QDHKRAV

SEQ ID NO: 10882 - protein, 9 aa, Neisseria
TQSFGKGSV

SEQ ID NO: 10883 - protein, 5 aa, Neisseria
LSNGS

SEQ ID NO: 10884 - protein, 9 aa, Neisseria
YTPNDRSIQ

SEQ ID NO: 10885 - protein, 17 aa, Neisseria
VEVKDKERIFESREADL

SEQ ID NO: 10886 - protein, 11 aa, Neisseria
GNPLGGEDVNG

SEQ ID NO: 10887 - protein, 52 aa, Neisseria
PLEKDADKPAVKEKGKKKKDEDLSSRRIPNPAKDDQLRKALDLVKSPEQWQK

SEQ ID NO: 10888 - protein, 18 aa, Neisseria
AAKKPVSNKDKKDKKDKK

SEQ ID NO: 10889 - protein, 11 aa, Neisseria
AAEKDRRDNEV

SEQ ID NO: 10890 - protein, 11 aa, Neisseria
YYQDKPDADLF

SEQ ID NO: 10891 - protein, 22 aa, Neisseria
DPHSEYMDKKGYAEIKESTSGE

SEQ ID NO: 10892 - protein, 7 aa, Neisseria
IGQEDGF

SEQ ID NO: 10893 - protein, 18 aa, Neisseria
SPIEDTPAERAGVKSGDF

SEQ ID NO: 10894 - protein, 5 aa, Neisseria
DNVST

SEQ ID NO: 10895 - protein, 12 aa, Neisseria
EAVKKMRGKPGT

SEQ ID NO: 10896 - protein, 10 aa, Neisseria
LSRKNADKPI

SEQ ID NO: 10897 - protein, 8 aa, Neisseria
QFQERTVE

SEQ ID NO: 10898 - protein, 17 aa, Neisseria
NTAAKELVKENKGKPLK

SEQ ID NO: 10899 - protein, 7 aa, Neisseria
DLRDDPG

SEQ ID NO: 10900 - protein, 11 aa, Neisseria
TKGRDGKDRMV

SEQ ID NO: 10901 - protein, 5 aa, Neisseria
AELKT

SEQ ID NO: 10902 - protein, 7 aa, Neisseria
QDHKRAV

SEQ ID NO: 10903 - protein, 7 aa, Neisseria
PNDRSIQ

SEQ ID NO: 10904 - protein, 17 aa, Neisseria
VEVKDKERIFESREADL

SEQ ID NO: 10905 - protein, 8 aa, Neisseria
LGGEDVNG

SEQ ID NO: 10906 - protein, 51 aa, Neisseria
PLEKDADKPAVKEKGKKKKDEDLSSRRIPNPAKDDQLRKALDLVKSPEQWQ

SEQ ID NO: 10907 - protein, 18 aa, Neisseria
AAKKPVSNKDKKDKKDKK

SEQ ID NO: 10908 - protein, 6 aa, Neisseria
TLSRLS

SEQ ID NO: 10909 - protein, 11 aa, Neisseria
YGGYPDTVYEG

SEQ ID NO: 10910 - protein, 11 aa, Neisseria
KQTEKMEKYFV

SEQ ID NO: 10911 - protein, 8 aa, Neisseria
GAFRQFEE

SEQ ID NO: 10912 - protein, 7 aa, Neisseria
MNPKTLS

SEQ ID NO: 10913 - protein, 8 aa, Neisseria
CGGNGQKS

SEQ ID NO: 10914 - protein, 30 aa, Neisseria
YGGYPDTVYEGLKNDDTSLGKQTEKMEKYF

SEQ ID NO: 10915 - protein, 12 aa, Neisseria
AGNKKMNAAPGA

SEQ ID NO: 10916 - protein, 23 aa, Neisseria
LSRSGDKEGAFRQFEEEKRLFPE

SEQ ID NO: 10917 - protein, 9 aa, Neisseria
MKTGKGGKR

SEQ ID NO: 10918 - protein, 23 aa, Neisseria
VYEGLKNDDTSLGKQTEKMEKYF

SEQ ID NO: 10919 - protein, 8 aa, Neisseria
AGNKKMNA

SEQ ID NO: 10920 - protein, 20 aa, Neisseria
RSGDKEGAFRQFEEEKRLFP

SEQ ID NO: 10921 - protein, 9 aa, Neisseria
MKTGKGGKR

SEQ ID NO: 10922 - protein, 6 aa, Neisseria
RAADTY

SEQ ID NO: 10923 - protein, 12 aa, Neisseria
YLAVWQNPQNAD

SEQ ID NO: 10924 - protein, 11 aa, Neisseria
EAFSELEAFCK

SEQ ID NO: 10925 - protein, 8 aa, Neisseria
TGCRSVVS

SEQ ID NO: 10926 - protein, 11 aa, Neisseria
LAYPKALGALR

SEQ ID NO: 10927 - protein, 5 aa, Neisseria
RFTSV

SEQ ID NO: 10928 - protein, 7 aa, Neisseria
ALNQCIK

SEQ ID NO: 10929 - protein, 5 aa, Neisseria
ARAAD

SEQ ID NO: 10930 - protein, 11 aa, Neisseria
QNPQNADDVLQ

SEQ ID NO: 10931 - protein, 15 aa, Neisseria
KTTKEDSTKSEAFSE

SEQ ID NO: 10932 - protein, 9 aa, Neisseria
EAFCKGQDT

SEQ ID NO: 10933 - protein, 11 aa, Neisseria
IAEDEPTGCRS

SEQ ID NO: 10934 - protein, 5 aa, Neisseria
LRVDN

SEQ ID NO: 10935 - protein, 6 aa, Neisseria
SPRFTS

SEQ ID NO: 10936 - protein, 7 aa, Neisseria
CIKKYGV

SEQ ID NO: 10937 - protein, 5 aa, Neisseria
SSYYG

SEQ ID NO: 10938 - protein, 5 aa, Neisseria
ARAAD

SEQ ID NO: 10939 - protein, 8 aa, Neisseria
QNADDVLQ

SEQ ID NO: 10940 - protein, 15 aa, Neisseria
KTTKEDSTKSEAFSE

SEQ ID NO: 10941 - protein, 9 aa, Neisseria
EAFCKGQDT

SEQ ID NO: 10942 - protein, 9 aa, Neisseria
IAEDEPTGC

SEQ ID NO: 10943 - protein, 5 aa, Neisseria
LRVDN

SEQ ID NO: 10944 - protein, 5 aa, Neisseria
LLANN

SEQ ID NO: 10945 - protein, 7 aa, Neisseria
QPIAIIA

SEQ ID NO: 10946 - protein, 7 aa, Neisseria
GCIDGFG

SEQ ID NO: 10947 - protein, 12 aa, Neisseria
HHQGYKSAFAKQ

SEQ ID NO: 10948 - protein, 12 aa, Neisseria
AVIDKMERDKAQ

SEQ ID NO: 10949 - protein, 20 aa, Neisseria
NYARELELARAEAKKYEVKA

SEQ ID NO: 10950 - protein, 21 aa, Neisseria
LAKKQAEVSRLKTENKKEIEN

SEQ ID NO: 10951 - protein, 20 aa, Neisseria
LTQDRKNASGGCIDGFGSHG

SEQ ID NO: 10952 - protein, 6 aa, Neisseria
ALGYGN

SEQ ID NO: 10953 - protein, 12 aa, Neisseria
AVIDKMERDKAQ

SEQ ID NO: 10954 - protein, 20 aa, Neisseria
NYARELELARAEAKKYEVKA

SEQ ID NO: 10955 - protein, 21 aa, Neisseria
LAKKQAEVSRLKTENKKEIEN

SEQ ID NO: 10956 - protein, 9 aa, Neisseria
LTQDRKNAS

SEQ ID NO: 10957 - protein, 8 aa, Neisseria
GLIQSLGS

SEQ ID NO: 10958 - protein, 5 aa, Neisseria
GVLSV

SEQ ID NO: 10959 - protein, 5 aa, Neisseria
GLFVG

SEQ ID NO: 10960 - protein, 15 aa, Neisseria
LQGYTQLSKFKSADI

SEQ ID NO: 10961 - protein, 8 aa, Neisseria
LLRELGPV

SEQ ID NO: 10962 - protein, 14 aa, Neisseria
LMKTTEQLEAMNVM

SEQ ID NO: 10963 - protein, 8 aa, Neisseria
VNPVARVV

SEQ ID NO: 10964 - protein, 11 aa, Neisseria
PRFWAGVFSMP

SEQ ID NO: 10965 - protein, 13 aa, Neisseria
LASIFNVAGIFGA

SEQ ID NO: 10966 - protein, 6 aa, Neisseria
DVINGL

SEQ ID NO: 10967 - protein, 7 aa, Neisseria
LRASTRT

SEQ ID NO: 10968 - protein, 7 aa, Neisseria
VRPRLSV

SEQ ID NO: 10969 - protein, 5 aa, Neisseria
SKFKS

SEQ ID NO: 10970 - protein, 6 aa, Neisseria
LLRELG

SEQ ID NO: 10971 - protein, 8 aa, Neisseria
SAGGAMTS

SEQ ID NO: 10972 - protein, 7 aa, Neisseria
KTTEQLE

SEQ ID NO: 10973 - protein, 5 aa, Neisseria
QMQNN

SEQ ID NO: 10974 - protein, 11 aa, Neisseria
PTSEGILRAST

SEQ ID NO: 10975 - protein, 5 aa, Neisseria
PRLSV

SEQ ID NO: 10976 - protein, 5 aa, Neisseria
SKFKS

SEQ ID NO: 10977 - protein, 6 aa, Neisseria
LLRELG

SEQ ID NO: 10978 - protein, 7 aa, Neisseria
KTTEQLE

SEQ ID NO: 10979 - protein, 8 aa, Neisseria
AALARVGG

SEQ ID NO: 10980 - protein, 13 aa, Neisseria
AHHDGHGDDDHGH

SEQ ID NO: 10981 - protein, 12 aa, Neisseria
AHQHNKQDKIIS

SEQ ID NO: 10982 - protein, 8 aa, Neisseria
AQAEKAAL

SEQ ID NO: 10983 - protein, 31 aa, Neisseria
RVGGKITDIDLEHDNGRPHYDVEIVKNGQEY

SEQ ID NO: 10984 - protein, 15 aa, Neisseria
VDARTGRVISSRRDD

SEQ ID NO: 10985 - protein, 10 aa, Neisseria
DGHGDDDHGH

SEQ ID NO: 10986 - protein, 10 aa, Neisseria
QHNKQDKIIS

SEQ ID NO: 10987 - protein, 8 aa, Neisseria
AQAEKAAL

SEQ ID NO: 10988 - protein, 19 aa, Neisseria
VGGKITDIDLEHDNGRPHY

SEQ ID NO: 10989 - protein, 9 aa, Neisseria
EIVKNGQEY

SEQ ID NO: 10990 - protein, 7 aa, Neisseria
VDARTGR

SEQ ID NO: 10991 - protein, 7 aa, Neisseria
ISSRRDD

SEQ ID NO: 10992 - protein, 11 aa, Neisseria
LMNLIYPGMND

SEQ ID NO: 10993 - protein, 9 aa, Neisseria
IGSLLQSCI

SEQ ID NO: 10994 - protein, 9 aa, Neisseria
TYIAAIALI

SEQ ID NO: 10995 - protein, 9 aa, Neisseria
TILETFTGI

SEQ ID NO: 10996 - protein, 19 aa, Neisseria
VERVANGGFTDLPRQIEWN

SEQ ID NO: 10997 - protein, 7 aa, Neisseria
ALAAFQS

SEQ ID NO: 10998 - protein, 8 aa, Neisseria
GHGWNSFA

SEQ ID NO: 10999 - protein, 9 aa, Neisseria
DNLLSNLFT

SEQ ID NO: 11000 - protein, 11 aa, Neisseria
LLTGIAGLLKR

SEQ ID NO: 11001 - protein, 6 aa, Neisseria
MCHSML

SEQ ID NO: 11002 - protein, 8 aa, Neisseria
RLVNAFSP

SEQ ID NO: 11003 - protein, 9 aa, Neisseria
DSAKTLNRK

SEQ ID NO: 11004 - protein, 7 aa, Neisseria
NELRYIS

SEQ ID NO: 11005 - protein, 7 aa, Neisseria
LPEYPET

SEQ ID NO: 11006 - protein, 8 aa, Neisseria
AKQWMRAT

SEQ ID NO: 11007 - protein, 10 aa, Neisseria
YADEIRKLPV

SEQ ID NO: 11008 - protein, 17 aa, Neisseria
PLLPELLKDCKAFAAAP

SEQ ID NO: 11009 - protein, 9 aa, Neisseria
KLKPSPDFY

SEQ ID NO: 11010 - protein, 7 aa, Neisseria
AGKKLFD

SEQ ID NO: 11011 - protein, 6 aa, Neisseria
FGQERI

SEQ ID NO: 11012 - protein, 7 aa, Neisseria
GWEDTPL

SEQ ID NO: 11013 - protein, 7 aa, Neisseria
GQRNNLG

SEQ ID NO: 11014 - protein, 8 aa, Neisseria
LNGQRKIP

SEQ ID NO: 11015 - protein, 11 aa, Neisseria
FRSDKSNRRTM

SEQ ID NO: 11016 - protein, 20 aa, Neisseria
TAVERVANGGFTDLPRQIEW

SEQ ID NO: 11017 - protein, 8 aa, Neisseria
GHGWNSFA

SEQ ID NO: 11018 - protein, 7 aa, Neisseria
LLKRPLT

SEQ ID NO: 11019 - protein, 14 aa, Neisseria
PAEASDGIAFKKAA

SEQ ID NO: 11020 - protein, 16 aa, Neisseria
PATDDSAKTLNRKINE

SEQ ID NO: 11021 - protein, 11 aa, Neisseria
PEYPETQTWAE

SEQ ID NO: 11022 - protein, 13 aa, Neisseria
ATLKSLKYRPHSA

SEQ ID NO: 11023 - protein, 12 aa, Neisseria
RQGKVAEAKQWM

SEQ ID NO: 11024 - protein, 5 aa, Neisseria
ATQSY

SEQ ID NO: 11025 - protein, 8 aa, Neisseria
RYADEIRK

SEQ ID NO: 11026 - protein, 7 aa, Neisseria
LLKDCKA

SEQ ID NO: 11027 - protein, 10 aa, Neisseria
PGHPEAKPCK

SEQ ID NO: 11028 - protein, 5 aa, Neisseria
LKPSP

SEQ ID NO: 11029 - protein, 7 aa, Neisseria
AGKKLFD

SEQ ID NO: 11030 - protein, 5 aa, Neisseria
GQERI

SEQ ID NO: 11031 - protein, 6 aa, Neisseria
GQRKIP

SEQ ID NO: 11032 - protein, 10 aa, Neisseria
RSDKSNRRTM

SEQ ID NO: 11033 - protein, 7 aa, Neisseria
TAVERVA

SEQ ID NO: 11034 - protein, 7 aa, Neisseria
LLKRPLT

SEQ ID NO: 11035 - protein, 5 aa, Neisseria
AEASD

SEQ ID NO: 11036 - protein, 7 aa, Neisseria
IAFKKAA

SEQ ID NO: 11037 - protein, 15 aa, Neisseria
ATDDSAKTLNRKINE

SEQ ID NO: 11038 - protein, 5 aa, Neisseria
LKYRP

SEQ ID NO: 11039 - protein, 12 aa, Neisseria
RQGKVAEAKQWM

SEQ ID NO: 11040 - protein, 8 aa, Neisseria
RYADEIRK

SEQ ID NO: 11041 - protein, 7 aa, Neisseria
LLKDCKA

SEQ ID NO: 11042 - protein, 9 aa, Neisseria
GHPEAKPCK

SEQ ID NO: 11043 - protein, 6 aa, Neisseria
NKPFRL

SEQ ID NO: 11044 - protein, 5 aa, Neisseria
HTDSP

SEQ ID NO: 11045 - protein, 6 aa, Neisseria
QPDGTD

SEQ ID NO: 11046 - protein, 10 aa, Neisseria
TDRQPDDAGT

SEQ ID NO: 11047 - protein, 5 aa, Neisseria
AENTL

SEQ ID NO: 11048 - protein, 13 aa, Neisseria
MAKKPNKPFRLTP

SEQ ID NO: 11049 - protein, 24 aa, Neisseria
FNPNGDKTLQAEPQHTDSPRETEF

SEQ ID NO: 11050 - protein, 17 aa, Neisseria
LPNGVVGQDAAQPEHHH

SEQ ID NO: 11051 - protein, 106 aa, Neisseria
ASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEIL

SEQ ID NO: 11052 - protein, 11 aa, Neisseria
MAKKPNKPFRL

SEQ ID NO: 11053 - protein, 21 aa, Neisseria
PNGDKTLQAEPQHTDSPRETE

SEQ ID NO: 11054 - protein, 9 aa, Neisseria
DAAQPEHHH

SEQ ID NO: 11055 - protein, 16 aa, Neisseria
ASSEPAQPDGTDESGS

SEQ ID NO: 11056 - protein, 37 aa, Neisseria
AAPKKNRVKPQPADTAQTDRQPDDAGTQAENTLKETP

SEQ ID NO: 11057 - protein, 43 aa, Neisseria
VPRPEPRKETPEKQAQPKETPKENHTKPDTPKNTPPKPHKEIL

SEQ ID NO: 11058 - protein, 7 aa, Neisseria
LVRWLAV

SEQ ID NO: 11059 - protein, 12 aa, Neisseria
PEDKLQHLINGI

SEQ ID NO: 11060 - protein, 8 aa, Neisseria
NPPEDKLQ

SEQ ID NO: 11061 - protein, 15 aa, Neisseria
IKHHLKQEFDLKRQT

SEQ ID NO: 11062 - protein, 7 aa, Neisseria
PPEDKLQ

SEQ ID NO: 11063 - protein, 15 aa, Neisseria
IKHHLKQEFDLKRQT

SEQ ID NO: 11064 - protein, 10 aa, Neisseria
GAGLADALTA

SEQ ID NO: 11065 - protein, 10 aa, Neisseria
SRFDFIRQIE

SEQ ID NO: 11066 - protein, 11 aa, Neisseria
TSFDKLPEGGR

SEQ ID NO: 11067 - protein, 18 aa, Neisseria
SAEVKTVNGIRHIGLAAK

SEQ ID NO: 11068 - protein, 5 aa, Neisseria
SSGGG

SEQ ID NO: 11069 - protein, 8 aa, Neisseria
LDHKDKGL

SEQ ID NO: 11070 - protein, 12 aa, Neisseria
DQSVRKNEKLKL

SEQ ID NO: 11071 - protein, 27 aa, Neisseria
GAEKTYGNGDSLNTGKLKNDKVSRFDF

SEQ ID NO: 11072 - protein, 7 aa, Neisseria
IEVDGQL

SEQ ID NO: 11073 - protein, 8 aa, Neisseria
VYKQSHSA

SEQ ID NO: 11074 - protein, 44 aa, Neisseria
QTEQIQDSEHSGKMVAKRQFRIGDIAGEHTSFDKLPEGGRATYR

SEQ ID NO: 11075 - protein, 10 aa, Neisseria
TAFGSDDAGG

SEQ ID NO: 11076 - protein, 20 aa, Neisseria
FAAKQGNGKIEHLKSPELNV

SEQ ID NO: 11077 - protein, 13 aa, Neisseria
AAADIKPDGKRHA

SEQ ID NO: 11078 - protein, 9 aa, Neisseria
NQAEKGSYS

SEQ ID NO: 11079 - protein, 9 aa, Neisseria
GGKAQEVAG

SEQ ID NO: 11080 - protein, 8 aa, Neisseria
AEVKTVNG

SEQ ID NO: 11081 - protein, 8 aa, Neisseria
LDHKDKGL

SEQ ID NO: 11082 - protein, 11 aa, Neisseria
QSVRKNEKLKL

SEQ ID NO: 11083 - protein, 8 aa, Neisseria
GAEKTYGN

SEQ ID NO: 11084 - protein, 10 aa, Neisseria
GKLKNDKVSR

SEQ ID NO: 11085 - protein, 5 aa, Neisseria
IEVDG

SEQ ID NO: 11086 - protein, 9 aa, Neisseria
QIQDSEHSG

SEQ ID NO: 11087 - protein, 9 aa, Neisseria
MVAKRQFRI

SEQ ID NO: 11088 - protein, 5 aa, Neisseria
DIAGE

SEQ ID NO: 11089 - protein, 14 aa, Neisseria
TSFDKLPEGGRATY

SEQ ID NO: 11090 - protein, 7 aa, Neisseria
GSDDAGG

SEQ ID NO: 11091 - protein, 16 aa, Neisseria
QGNGKIEHLKSPELNV

SEQ ID NO: 11092 - protein, 13 aa, Neisseria
AAADIKPDGKRHA

SEQ ID NO: 11093 - protein, 6 aa, Neisseria
QAEKGS

SEQ ID NO: 11094 - protein, 7 aa, Neisseria
KAQEVAG

SEQ ID NO: 11095 - protein, 5 aa, Neisseria
AEVKT

SEQ ID NO: 11096 - protein, 5 aa, Neisseria
REVPD

SEQ ID NO: 11097 - protein, 5 aa, Neisseria
NRPLQ

SEQ ID NO: 11098 - protein, 6 aa, Neisseria
EDWSRL

SEQ ID NO: 11099 - protein, 11 aa, Neisseria
NLFSGFKHVFD

SEQ ID NO: 11100 - protein, 8 aa, Neisseria
KALEKLKA

SEQ ID NO: 11101 - protein, 8 aa, Neisseria
DETAKEYR

SEQ ID NO: 11102 - protein, 12 aa, Neisseria
NAAQRFPNSLYD

SEQ ID NO: 11103 - protein, 8 aa, Neisseria
VYAGSCQE

SEQ ID NO: 11104 - protein, 5 aa, Neisseria
SSPLV

SEQ ID NO: 11105 - protein, 6 aa, Neisseria
RNAKKI

SEQ ID NO: 11106 - protein, 18 aa, Neisseria
TPAFTGFSGTVPVWKTVK

SEQ ID NO: 11107 - protein, 11 aa, Neisseria
LYNYAKYLNTN

SEQ ID NO: 11108 - protein, 9 aa, Neisseria
LHLLGGLHY

SEQ ID NO: 11109 - protein, 6 aa, Neisseria
FQTASS

SEQ ID NO: 11110 - protein, 14 aa, Neisseria
IYGSYTKIFKQQDN

SEQ ID NO: 11111 - protein, 16 aa, Neisseria
GSFQTVAKPIGKVVSR

SEQ ID NO: 11112 - protein, 8 aa, Neisseria
EDWKVFAG

SEQ ID NO: 11113 - protein, 5 aa, Neisseria
RYKNA

SEQ ID NO: 11114 - protein, 5 aa, Neisseria
AKNSS

SEQ ID NO: 11115 - protein, 12 aa, Neisseria
PYNFSNFTPVHI

SEQ ID NO: 11116 - protein, 7 aa, Neisseria
TSSLYNI

SEQ ID NO: 11117 - protein, 10 aa, Neisseria
YGLIDGFVRY

SEQ ID NO: 11118 - protein, 7 aa, Neisseria
LGKHAKL

SEQ ID NO: 11119 - protein, 14 aa, Neisseria
YNRTRGANNFYGEP

SEQ ID NO: 11120 - protein, 7 aa, Neisseria
AEADAGD

SEQ ID NO: 11121 - protein, 13 aa, Neisseria
MYQKSREVPDFSG

SEQ ID NO: 11122 - protein, 41 aa, Neisseria
PCENQKTAPFSSTPACNRPLQLPRNTYLGEDWSRLSADKYN

SEQ ID NO: 11123 - protein, 5 aa, Neisseria
FDNGW

SEQ ID NO: 11124 - protein, 11 aa, Neisseria
SYTKNESDAKV

SEQ ID NO: 11125 - protein, 6 aa, Neisseria
LSGEDA

SEQ ID NO: 11126 - protein, 46 aa, Neisseria
TEKNEVIPFEPKDKALEKLKAYRDETAKEYRERKDDFVKNRFDNTA

SEQ ID NO: 11127 - protein, 24 aa, Neisseria
EQYRSRRAAERKAGFDKCMSDPFA

SEQ ID NO: 11128 - protein, 19 aa, Neisseria
CQGSWGDPGVDADKAEFVD

SEQ ID NO: 11129 - protein, 28 aa, Neisseria
AAQRFPNSLYDSSFNRKATANRRYSYMP

SEQ ID NO: 11130 - protein, 9 aa, Neisseria
RHTKDDRQW

SEQ ID NO: 11131 - protein, 5 aa, Neisseria
GREHD

SEQ ID NO: 11132 - protein, 12 aa, Neisseria
YAYGDEKIRSEY

SEQ ID NO: 11133 - protein, 15 aa, Neisseria
EIYERRYRVRPNTGA

SEQ ID NO: 11134 - protein, 13 aa, Neisseria
AGSCQEEPDGDLS

SEQ ID NO: 11135 - protein, 42 aa, Neisseria
RGHKEPDWQAYDEKGNRTVYAEECRNAKKIKTEPKLDAEGKQ

SEQ ID NO: 11136 - protein, 10 aa, Neisseria
YYDEYSGSRT

SEQ ID NO: 11137 - protein, 19 aa, Neisseria
YELDEKGNKIQETNPDGTP

SEQ ID NO: 11138 - protein, 7 aa, Neisseria
KVADDHV

SEQ ID NO: 11139 - protein, 8 aa, Neisseria
YLNTNKTH

SEQ ID NO: 11140 - protein, 23 aa, Neisseria
RYETSQTKDMPVRYGQPASDFQT

SEQ ID NO: 11141 - protein, 11 aa, Neisseria
SSIRADQDHYT

SEQ ID NO: 11142 - protein, 9 aa, Neisseria
KMQGHKLTP

SEQ ID NO: 11143 - protein, 5 aa, Neisseria
GSYTK

SEQ ID NO: 11144 - protein, 11 aa, Neisseria
FKQQDNVDVSA

SEQ ID NO: 11145 - protein, 5 aa, Neisseria
GRLNA

SEQ ID NO: 11146 - protein, 9 aa, Neisseria
LEQKNRTVV

SEQ ID NO: 11147 - protein, 8 aa, Neisseria
GAGGKQGS

SEQ ID NO: 11148 - protein, 19 aa, Neisseria
VVSRGAEFELSGELNEDWK

SEQ ID NO: 11149 - protein, 31 aa, Neisseria
TYNKSRYKNAAEVNAERLAKNSSADPYNFSN

SEQ ID NO: 11150 - protein, 17 aa, Neisseria
VSAQSGTSSLYNIRQGG

SEQ ID NO: 11151 - protein, 7 aa, Neisseria
ELGKHAK

SEQ ID NO: 11152 - protein, 32 aa, Neisseria
GTNLNGRTYFENNYNRTRGANNFYGEPRTVSM

SEQ ID NO: 11153 - protein, 7 aa, Neisseria
AEADAGD

SEQ ID NO: 11154 - protein, 8 aa, Neisseria
QKSREVPD

SEQ ID NO: 11155 - protein, 9 aa, Neisseria
DWSRLSADK

SEQ ID NO: 11156 - protein, 11 aa, Neisseria
SYTKNESDAKV

SEQ ID NO: 11157 - protein, 6 aa, Neisseria
LSGEDA

SEQ ID NO: 11158 - protein, 46 aa, Neisseria; identical to SEQ ID NO: 11126

SEQ ID NO: 11159 - protein, 20 aa, Neisseria
EQYRSRRAAERKAGFDKCMS

SEQ ID NO: 11160 - protein, 12 aa, Neisseria
PGVDADKAEFVD

SEQ ID NO: 11161 - protein, 13 aa, Neisseria
SFNRKATANRRYS

SEQ ID NO: 11162 - protein, 9 aa, Neisseria
RHTKDDRQW

SEQ ID NO: 11163 - protein, 5 aa, Neisseria
GREHD

SEQ ID NO: 11164 - protein, 10 aa, Neisseria
YGDEKIRSEY

SEQ ID NO: 11165 - protein, 13 aa, Neisseria
EIYERRYRVRPNT

SEQ ID NO: 11166 - protein, 9 aa, Neisseria
CQEEPDGDL

SEQ ID NO: 11167 - protein, 7 aa, Neisseria
RGHKEPD

SEQ ID NO: 11168 - protein, 8 aa, Neisseria
AYDEKGNR

SEQ ID NO: 11169 - protein, 24 aa, Neisseria
VYAEECRNAKKIKTEPKLDAEGKQ

SEQ ID NO: 11170 - protein, 5 aa, Neisseria
YSGSR

SEQ ID NO: 11171 - protein, 17 aa, Neisseria
YELDEKGNKIQETNPDG

SEQ ID NO: 11172 - protein, 7 aa, Neisseria
KVADDHV

SEQ ID NO: 11173 - protein, 12 aa, Neisseria
RYETSQTKDMPV

SEQ ID NO: 11174 - protein, 5 aa, Neisseria
QPASD

SEQ ID NO: 11175 - protein, 11 aa, Neisseria
SSIRADQDHYT

SEQ ID NO: 11176 - protein, 11 aa, Neisseria
FKQQDNVDVSA

SEQ ID NO: 11177 - protein, 7 aa, Neisseria
QKNRTVV

SEQ ID NO: 11178 - protein, 7 aa, Neisseria
AGGKQGS

SEQ ID NO: 11179 - protein, 19 aa, Neisseria
VVSRGAEFELSGELNEDWK

SEQ ID NO: 11180 - protein, 23 aa, Neisseria
NKSRYKNAAEVNAERLAKNSSAD

SEQ ID NO: 11181 - protein, 7 aa, Neisseria
ELGKHAK

SEQ ID NO: 11182 - protein, 7 aa, Neisseria
NYNRTRG

SEQ ID NO: 11183 - protein, 8 aa, Neisseria
GEPRTVSM

SEQ ID NO: 11184 - protein, 5 aa, Neisseria
YGGSF

SEQ ID NO: 11185 - protein, 5 aa, Neisseria
SYTID

SEQ ID NO: 11186 - protein, 6 aa, Neisseria
MSTATG

SEQ ID NO: 11187 - protein, 17 aa, Neisseria
TLEEAMKNTTGVNVVRD

SEQ ID NO: 11188 - protein, 13 aa, Neisseria
VYDHIEVVRGATG

SEQ ID NO: 11189 - protein, 5 aa, Neisseria
MNQNH

SEQ ID NO: 11190 - protein, 7 aa, Neisseria
VSDGNTV

SEQ ID NO: 11191 - protein, 6 aa, Neisseria
VNVRGS

SEQ ID NO: 11192 - protein, 16 aa, Neisseria
GKTEKTRSYTIDRMST

SEQ ID NO: 11193 - protein, 9 aa, Neisseria
IAGKDTPQS

SEQ ID NO: 11194 - protein, 22 aa, Neisseria
TRSRLDDKAVHTLEEAMKNTTG

SEQ ID NO: 11195 - protein, 16 aa, Neisseria
VVRDSGLQTRFLSRGF

SEQ ID NO: 11196 - protein, 7 aa, Neisseria
QIGEDGM

SEQ ID NO: 11197 - protein, 16 aa, Neisseria
GRSGYTAKIDVSPSTD

SEQ ID NO: 11198 - protein, 18 aa, Neisseria
EVVRGATGLTQSNSEPGG

SEQ ID NO: 11199 - protein, 16 aa, Neisseria
GKTEKTRSYTIDRMST

SEQ ID NO: 11200 - protein, 8 aa, Neisseria
IAGKDTPQ

SEQ ID NO: 11201 - protein, 19 aa, Neisseria
TRSRLDDKAVHTLEEAMKN

SEQ ID NO: 11202 - protein, 7 aa, Neisseria
VVRDSGL

SEQ ID NO: 11203 - protein, 7 aa, Neisseria
QIGEDGM

SEQ ID NO: 11204 - protein, 7 aa, Neisseria
SNSEPGG

SEQ ID NO: 11205 - protein, 5 aa, Neisseria
LDELC

SEQ ID NO: 11206 - protein, 44 aa, Neisseria
NFYKNIHATTKFVRETDYSKFIQLKKARHLTVSDFTSIWKVILY

SEQ ID NO: 11207 - protein, 19 aa, Neisseria
SSIFNKFKALDEAINEYYY

SEQ ID NO: 11208 - protein, 10 aa, Neisseria
MIFGKFVKLG

SEQ ID NO: 11209 - protein, 6 aa, Neisseria
RKFKDA

SEQ ID NO: 11210 - protein, 13 aa, Neisseria
FDEYHECVKGLAN

SEQ ID NO: 11211 - protein, 5 aa, Neisseria
IFDSL

SEQ ID NO: 11212 - protein, 16 aa, Neisseria
YRSSKIFGVFDHLLRT

SEQ ID NO: 11213 - protein, 6 aa, Neisseria
LEKGNS

SEQ ID NO: 11214 - protein, 15 aa, Neisseria
NLHDEYKNLTSFISF

SEQ ID NO: 11215 - protein, 7 aa, Neisseria
RDILQML

SEQ ID NO: 11216 - protein, 10 aa, Neisseria
YQNFLKFFEF

SEQ ID NO: 11217 - protein, 14 aa, Neisseria
YSDFLKAFERLKKH

SEQ ID NO: 11218 - protein, 11 aa, Neisseria
EIPKFMSTANE

SEQ ID NO: 11219 - protein, 6 aa, Neisseria
NVIAYL

SEQ ID NO: 11220 - protein, 10 aa, Neisseria
SGLSKALDVG

SEQ ID NO: 11221 - protein, 12 aa, Neisseria
ANYRRRENKDLF

SEQ ID NO: 11222 - protein, 12 aa, Neisseria
GEYLDELCEPNI

SEQ ID NO: 11223 - protein, 9 aa, Neisseria
IGEKGTGKT

SEQ ID NO: 11224 - protein, 5 aa, Neisseria
NNFYK

SEQ ID NO: 11225 - protein, 8 aa, Neisseria
KFVRETDY

SEQ ID NO: 11226 - protein, 5 aa, Neisseria
KKARH

SEQ ID NO: 11227 - protein, 10 aa, Neisseria
NQIKCKENGI

SEQ ID NO: 11228 - protein, 8 aa, Neisseria
KALDEAIN

SEQ ID NO: 11229 - protein, 10 aa, Neisseria
YYYGAFDPEI

SEQ ID NO: 11230 - protein, 7 aa, Neisseria
ENSKEAA

SEQ ID NO: 11231 - protein, 9 aa, Neisseria
VKLGEEESQ

SEQ ID NO: 11232 - protein, 5 aa, Neisseria
TESKF

SEQ ID NO: 11233 - protein, 11 aa, Neisseria
FIERKFKDALS

SEQ ID NO: 11234 - protein, 6 aa, Neisseria
LKLKDN

SEQ ID NO: 11235 - protein, 12 aa, Neisseria
DGIDIRPSQIPF

SEQ ID NO: 11236 - protein, 7 aa, Neisseria
EYHECVK

SEQ ID NO: 11237 - protein, 10 aa, Neisseria
PSIKDSKGRM

SEQ ID NO: 11238 - protein, 22 aa, Neisseria
RPDIFDSLGLQNQNTKLQDNSV

SEQ ID NO: 11239 - protein, 14 aa, Neisseria
DWRTDYKSYRSSKI

SEQ ID NO: 11240 - protein, 35 aa, Neisseria
LRTQQEKQDSLEKGNSWDYYFPWNAPNLHDEYKNL

SEQ ID NO: 11241 - protein, 11 aa, Neisseria
LRKSYYRPRDI

SEQ ID NO: 11242 - protein, 12 aa, Neisseria
QKNKKSKEDYVV

SEQ ID NO: 11243 - protein, 13 aa, Neisseria
EDFDNTSFQREYS

SEQ ID NO: 11244 - protein, 7 aa, Neisseria
SQSDYQN

SEQ ID NO: 11245 - protein, 11 aa, Neisseria
NGKDRFKYSDF

SEQ ID NO: 11246 - protein, 11 aa, Neisseria
KAFERLKKHLQ

SEQ ID NO: 11247 - protein, 5 aa, Neisseria
EIPKF

SEQ ID NO: 11248 - protein, 10 aa, Neisseria
LDNPEDETKP

SEQ ID NO: 11249 - protein, 17 aa, Neisseria
FKDRNYANISPKIKTET

SEQ ID NO: 11250 - protein, 5 aa, Neisseria
SKALD

SEQ ID NO: 11251 - protein, 8 aa, Neisseria
GTPFKNKQ

SEQ ID NO: 11252 - protein, 12 aa, Neisseria
ANYRRRENKDLF

SEQ ID NO: 11253 - protein, 8 aa, Neisseria
EYLDELCE

SEQ ID NO: 11254 - protein, 5 aa, Neisseria
EKGTG

SEQ ID NO: 11255 - protein, 8 aa, Neisseria
KFVRETDY

SEQ ID NO: 11256 - protein, 5 aa, Neisseria
KKARH

SEQ ID NO: 11257 - protein, 8 aa, Neisseria
IKCKENGI

SEQ ID NO: 11258 - protein, 7 aa, Neisseria
KALDEAI

SEQ ID NO: 11259 - protein, 7 aa, Neisseria
ENSKEAA

SEQ ID NO: 11260 - protein, 9 aa, Neisseria
VKLGEEESQ

SEQ ID NO: 11261 - protein, 5 aa, Neisseria
TESKF

SEQ ID NO: 11262 - protein, 11 aa, Neisseria
FIERKFKDALS

SEQ ID NO: 11263 - protein, 6 aa, Neisseria
LKLKDN

SEQ ID NO: 11264 - protein, 5 aa, Neisseria
IDIRP

SEQ ID NO: 11265 - protein, 7 aa, Neisseria
EYHECVK

SEQ ID NO: 11266 - protein, 10 aa, Neisseria
PSIKDSKGRM

SEQ ID NO: 11267 - protein, 7 aa, Neisseria
QNTKLQD

SEQ ID NO: 11268 - protein, 10 aa, Neisseria
WRTDYKSYRS

SEQ ID NO: 11269 - protein, 14 aa, Neisseria
TQQEKQDSLEKGNS

SEQ ID NO: 11270 - protein, 8 aa, Neisseria
NLHDEYKN

SEQ ID NO: 11271 - protein, 8 aa, Neisseria
SYYRPRDI

SEQ ID NO: 11272 - protein, 12 aa, Neisseria
QKNKKSKEDYVV

SEQ ID NO: 11273 - protein, 5 aa, Neisseria
EDFDN

SEQ ID NO: 11274 - protein, 8 aa, Neisseria
NGKDRFKY

SEQ ID NO: 11275 - protein, 11 aa, Neisseria
KAFERLKKHLQ

SEQ ID NO: 11276 - protein, 9 aa, Neisseria
DNPEDETKP

SEQ ID NO: 11277 - protein, 6 aa, Neisseria
FKDRNY

SEQ ID NO: 11278 - protein, 7 aa, Neisseria
PKIKTET

SEQ ID NO: 11279 - protein, 5 aa, Neisseria
FKNKQ

SEQ ID NO: 11280 - protein, 6 aa, Neisseria
SVTAVI

SEQ ID NO: 11281 - protein, 6 aa, Neisseria
DVILND

SEQ ID NO: 11282 - protein, 12 aa, Neisseria
CTNFIKLWNAVS

SEQ ID NO: 11283 - protein, 6 aa, Neisseria
ELEILV

SEQ ID NO: 11284 - protein, 11 aa, Neisseria
INKKTSKQKAT

SEQ ID NO: 11285 - protein, 5 aa, Neisseria
NDYQD

SEQ ID NO: 11286 - protein, 13 aa, Neisseria
QFVEADNHISPYI

SEQ ID NO: 11287 - protein, 9 aa, Neisseria
TAVDDNNAR

SEQ ID NO: 11288 - protein, 14 aa, Neisseria
YQNKGGQWEKERGH

SEQ ID NO: 11289 - protein, 11 aa, Neisseria
NSGVLDEDLFK

SEQ ID NO: 11290 - protein, 16 aa, Neisseria
KIREEERKDTIFRELE

SEQ ID NO: 11291 - protein, 8 aa, Neisseria
NPLKASDL

SEQ ID NO: 11292 - protein, 9 aa, Neisseria
KKTSKQKAT

SEQ ID NO: 11293 - protein, 8 aa, Neisseria
QFVEADNH

SEQ ID NO: 11294 - protein, 9 aa, Neisseria
TAVDDNNAR

SEQ ID NO: 11295 - protein, 11 aa, Neisseria
KGGQWEKERGH

SEQ ID NO: 11296 - protein, 8 aa, Neisseria
VLDEDLFK

SEQ ID NO: 11297 - protein, 16 aa, Neisseria
KIREEERKDTIFRELE

SEQ ID NO: 11298 - protein, 8 aa, Neisseria
NPLKASDL

SEQ ID NO: 11299 - protein, 8 aa, Neisseria
LSGYEQLK

SEQ ID NO: 11300 - protein, 10 aa, Neisseria
LSSGPAEQTA

SEQ ID NO: 11301 - protein, 8 aa, Neisseria
SAADKPQD

SEQ ID NO: 11302 - protein, 5 aa, Neisseria
SEPEN

SEQ ID NO: 11303 - protein, 17 aa, Neisseria
LEASEKLQQAETAKTAP

SEQ ID NO: 11304 - protein, 6 aa, Neisseria
DTVAVE

SEQ ID NO: 11305 - protein, 7 aa, Neisseria
PKRTAET

SEQ ID NO: 11306 - protein, 5 aa, Neisseria
KAERT

SEQ ID NO: 11307 - protein, 12 aa, Neisseria
TKTAEKVADKPK

SEQ ID NO: 11308 - protein, 14 aa, Neisseria
SAVKEAKKADKAES

SEQ ID NO: 11309 - protein, 17 aa, Neisseria
ETAQKTDKADKTKTAEK

SEQ ID NO: 11310 - protein, 8 aa, Neisseria
STITEIMT

SEQ ID NO: 11311 - protein, 11 aa, Neisseria
YKNARDAERDL

SEQ ID NO: 11312 - protein, 26 aa, Neisseria
MSENKQNEVLSGYEQLKRRNRRRLVT

SEQ ID NO: 11313 - protein, 21 aa, Neisseria
SSGPAEQTAGETSGVENKAAG

SEQ ID NO: 11314 - protein, 32 aa, Neisseria
PALKSAADKPQDLAGEDKPSAADSEISEPENV

SEQ ID NO: 11315 - protein, 155 aa, Neisseria
ERLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAA

SEQ ID NO: 11316 - protein, 20 aa, Neisseria
GYAEKERALSLQRKMKAAGI

SEQ ID NO: 11317 - protein, 31 aa, Neisseria
IMTDNGKVYRVKSSNYKNARDAERDLNKLRV

SEQ ID NO: 11318 - protein, 9 aa, Neisseria
MSENKQNEV

SEQ ID NO: 11319 - protein, 12 aa, Neisseria
EQLKRRNRRRLV

SEQ ID NO: 11320 - protein, 19 aa, Neisseria
GPAEQTAGETSGVENKAAG

SEQ ID NO: 11321 - protein, 32 aa, Neisseria; identical to SEQ ID NO: 11314

SEQ ID NO: 11322 - protein, 46 aa, Neisseria
ERLEDSNIKGLEASEKLQQAETAKTAPKQAKQRAAEKVPATADSTD

SEQ ID NO: 11323 - protein, 108 aa, Neisseria
VAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAA

SEQ ID NO: 11324 - protein, 19 aa, Neisseria
YAEKERALSLQRKMKAAGI

SEQ ID NO: 11325 - protein, 31 aa, Neisseria; identical to SEQ ID NO: 11317

SEQ ID NO: 11326 - protein, 12 aa, Neisseria
ASRDVSKSAKGW

SEQ ID NO: 11327 - protein, 10 aa, Neisseria
YADLRGKTKV

SEQ ID NO: 11328 - protein, 13 aa, Neisseria
GASRDVSKSAKGW

SEQ ID NO: 11329 - protein, 47 aa, Neisseria
NVGKQLTDSVGLEFDPYYRHKTIYKPREIVLDGDKTKMGRSKSNEYG

SEQ ID NO: 11330 - protein, 6 aa, Neisseria
SQLKSK

SEQ ID NO: 11331 - protein, 10 aa, Neisseria
YADLRGKTKV

SEQ ID NO: 11332 - protein, 11 aa, Neisseria
GASRDVSKSAK

SEQ ID NO: 11333 - protein, 25 aa, Neisseria
TIYKPREIVLDGDKTKMGRSKSNEY

SEQ ID NO: 11334 - protein, 8 aa, Neisseria
GAVGAIGG

SEQ ID NO: 11335 - protein, 12 aa, Neisseria
GETAERTAESQH

SEQ ID NO: 11336 - protein, 12 aa, Neisseria
SAKQLENLFRTL

SEQ ID NO: 11337 - protein, 16 aa, Neisseria
LQEMRDFSNDKLQKSW

SEQ ID NO: 11338 - protein, 13 aa, Neisseria
QAALRDIIKHTVQ

SEQ ID NO: 11339 - protein, 6 aa, Neisseria
GVAANS

SEQ ID NO: 11340 - protein, 5 aa, Neisseria
DEPEW

SEQ ID NO: 11341 - protein, 15 aa, Neisseria
QAVRLIRHFVEFWDR

SEQ ID NO: 11342 - protein, 9 aa, Neisseria
QPDFAKDPE

SEQ ID NO: 11343 - protein, 6 aa, Neisseria
RDPEFL

SEQ ID NO: 11344 - protein, 8 aa, Neisseria
LEEYISPF

SEQ ID NO: 11345 - protein, 15 aa, Neisseria
MSKKQPAQPTRRTLF

SEQ ID NO: 11346 - protein, 23 aa, Neisseria
YLGGKKQGETAERTAESQHSPQA

SEQ ID NO: 11347 - protein, 9 aa, Neisseria
AQSAKQLEN

SEQ ID NO: 11348 - protein, 19 aa, Neisseria
TQGGEYQDGDDKLPPAGSG

SEQ ID NO: 11349 - protein, 7 aa, Neisseria
FNPDGLT

SEQ ID NO: 11350 - protein, 16 aa, Neisseria
SLFDGRFGLKDKKPIH

SEQ ID NO: 11351 - protein, 21 aa, Neisseria
QEMRDFSNDKLQKSWCDGDLS

SEQ ID NO: 11352 - protein, 5 aa, Neisseria
TPETC

SEQ ID NO: 11353 - protein, 14 aa, Neisseria
IDGWQPKSEPGAMA

SEQ ID NO: 11354 - protein, 20 aa, Neisseria
LGFRDGTGNPKVSDPKTADE

SEQ ID NO: 11355 - protein, 15 aa, Neisseria
SLDEPEWAKNGSYQA

SEQ ID NO: 11356 - protein, 68 aa, Neisseria
FWDRTPLQEQTDIFGRRKYSGAPMDGKKEADQPDFAKDPEGDITPKDSHIRLANPRDPEFLKKHRLFR

SEQ ID NO: 11357 - protein, 14 aa, Neisseria
AYSYSRGLASSGQL

SEQ ID NO: 11358 - protein, 9 aa, Neisseria
LNGEPLEEY

SEQ ID NO: 11359 - protein, 8 aa, Neisseria
PGVEKGGF

SEQ ID NO: 11360 - protein, 15 aa, Neisseria
MSKKQPAQPTRRTLF

SEQ ID NO: 11361 - protein, 18 aa, Neisseria
GGKKQGETAERTAESQHS

SEQ ID NO: 11362 - protein, 9 aa, Neisseria
AQSAKQLEN

SEQ ID NO: 11363 - protein, 12 aa, Neisseria
GEYQDGDDKLPP

SEQ ID NO: 11364 - protein, 10 aa, Neisseria
FGLKDKKPIH

SEQ ID NO: 11365 - protein, 20 aa, Neisseria
QEMRDFSNDKLQKSWCDGDL

SEQ ID NO: 11366 - protein, 11 aa, Neisseria
WQPKSEPGAMA

SEQ ID NO: 11367 - protein, 16 aa, Neisseria
RDGTGNPKVSDPKTAD

SEQ ID NO: 11368 - protein, 9 aa, Neisseria
SLDEPEWAK

SEQ ID NO: 11369 - protein, 16 aa, Neisseria
TPLQEQTDIFGRRKYS

SEQ ID NO: 11370 - protein, 28 aa, Neisseria
PMDGKKEADQPDFAKDPEGDITPKDSHI

SEQ ID NO: 11371 - protein, 16 aa, Neisseria
ANPRDPEFLKKHRLFR

SEQ ID NO: 11372 - protein, 6 aa, Neisseria
EPLEEY

SEQ ID NO: 11373 - protein, 6 aa, Neisseria
GVEKGG

SEQ ID NO: 11374 - protein, 6 aa, Neisseria
CQPPEA

SEQ ID NO: 11375 - protein, 11 aa, Neisseria
ADLEKLSQPLA

SEQ ID NO: 11376 - protein, 8 aa, Neisseria
QGEVKELV

SEQ ID NO: 11377 - protein, 14 aa, Neisseria
TFTEAVKAGDIEKA

SEQ ID NO: 11378 - protein, 13 aa, Neisseria
IEPIAELFSELDP

SEQ ID NO: 11379 - protein, 8 aa, Neisseria
AGFTGFHR

SEQ ID NO: 11380 - protein, 22 aa, Neisseria
SGVKEIAAKLMTDVEALQKEID

SEQ ID NO: 11381 - protein, 13 aa, Neisseria
VGGASELIEEVAG

SEQ ID NO: 11382 - protein, 13 aa, Neisseria
DGSKKIVDLFRPL

SEQ ID NO: 11383 - protein, 10 aa, Neisseria
FKQVNEILAK

SEQ ID NO: 11384 - protein, 11 aa, Neisseria
DGFETYDKLGE

SEQ ID NO: 11385 - protein, 22 aa, Neisseria
ALQASINALAEDLAQLRGILGL

SEQ ID NO: 11386 - protein, 5 aa, Neisseria
MRKFN

SEQ ID NO: 11387 - protein, 10 aa, Neisseria
QPPEAEKAAP

SEQ ID NO: 11388 - protein, 13 aa, Neisseria
ASGEAQTANEGGS

SEQ ID NO: 11389 - protein, 9 aa, Neisseria
NDNACEPME

SEQ ID NO: 11390 - protein, 13 aa, Neisseria
IKNNSGRKLEWEI

SEQ ID NO: 11391 - protein, 10 aa, Neisseria
MVVDERENIA

SEQ ID NO: 11392 - protein, 7 aa, Neisseria
GLSDKMT

SEQ ID NO: 11393 - protein, 7 aa, Neisseria
LPGEYEM

SEQ ID NO: 11394 - protein, 27 aa, Neisseria
TNPRGKLVVTDSGFKDTANEADLEKLS

SEQ ID NO: 11395 - protein, 30 aa, Neisseria; identical to SEQ ID NO: 7563

SEQ ID NO: 11396 - protein, 11 aa, Neisseria
TRVHYERIEPI

SEQ ID NO: 11397 - protein, 22 aa, Neisseria
SELDPVIDAREDDFKDGAKDAG

SEQ ID NO: 11398 - protein, 13 aa, Neisseria
VEKDVSGVKEIAA

SEQ ID NO: 11399 - protein, 13 aa, Neisseria
LMTDVEALQKEID

SEQ ID NO: 11400 - protein, 9 aa, Neisseria
PPGKVVGGA

SEQ ID NO: 11401 - protein, 38 aa, Neisseria; identical to SEQ ID NO: 7569

SEQ ID NO: 11402 - protein, 20 aa, Neisseria
IEAKNKALLEKTDTNFKQVN

SEQ ID NO: 11403 - protein, 23 aa, Neisseria
AKYRTKDGFETYDKLGEADRKAL

SEQ ID NO: 11404 - protein, 7 aa, Neisseria
LAEDLAQ

SEQ ID NO: 11405 - protein, 5 aa, Neisseria
MRKFN

SEQ ID NO: 11406 - protein, 10 aa, Neisseria
QPPEAEKAAP

SEQ ID NO: 11407 - protein, 13 aa, Neisseria
ASGEAQTANEGGS

SEQ ID NO: 11408 - protein, 7 aa, Neisseria
NACEPME

SEQ ID NO: 11409 - protein, 11 aa, Neisseria
NNSGRKLEWEI

SEQ ID NO: 11410 - protein, 9 aa, Neisseria
MVVDERENI

SEQ ID NO: 11411 - protein, 6 aa, Neisseria
LSDKMT

SEQ ID NO: 11412 - protein, 5 aa, Neisseria
GEYEM

SEQ ID NO: 11413 - protein, 7 aa, Neisseria
PRGKLVV

SEQ ID NO: 11414 - protein, 16 aa, Neisseria
SGFKDTANEADLEKLS

SEQ ID NO: 11415 - protein, 30 aa, Neisseria; identical to SEQ ID NO: 7563

SEQ ID NO: 11416 - protein, 11 aa, Neisseria
TRVHYERIEPI

SEQ ID NO: 11417 - protein, 22 aa, Neisseria
SELDPVIDAREDDFKDGAKDAG

SEQ ID NO: 11418 - protein, 13 aa, Neisseria
VEKDVSGVKEIAA

SEQ ID NO: 11419 - protein, 13 aa, Neisseria
LMTDVEALQKEID

SEQ ID NO: 11420 - protein, 8 aa, Neisseria
ELIEEVAG

SEQ ID NO: 11421 - protein, 11 aa, Neisseria
KISGEEDRYSH

SEQ ID NO: 11422 - protein, 9 aa, Neisseria
VDGSKKIVD

SEQ ID NO: 11423 - protein, 16 aa, Neisseria
IEAKNKALLEKTDTNF

SEQ ID NO: 11424 - protein, 21 aa, Neisseria
YRTKDGFETYDKLGEADRKAL

SEQ ID NO: 11425 - protein, 7 aa, Neisseria
LAEDLAQ

SEQ ID NO: 11426 - protein, 321 aa, Neisseria
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 11427 - protein, 9 aa, Neisseria
ADRAVRSAT

SEQ ID NO: 11428 - protein, 5 aa, Neisseria
IQDTN

SEQ ID NO: 11429 - protein, 5 aa, Neisseria
LSNAA

SEQ ID NO: 11430 - protein, 9 aa, Neisseria
LNNKVFQGY

SEQ ID NO: 11431 - protein, 13 aa, Neisseria
LNQDIYREVQKMG

SEQ ID NO: 11432 - protein, 10 aa, Neisseria
NVQNDYADVL

SEQ ID NO: 11433 - protein, 23 aa, Neisseria
SYFAEVPKAGTKEFDDYVKIWGE

SEQ ID NO: 11434 - protein, 8 aa, Neisseria
TQADRAVR

SEQ ID NO: 11435 - protein, 5 aa, Neisseria
ATAPK

SEQ ID NO: 11436 - protein, 17 aa, Neisseria
KIIDEKTGKVSFDTRQI

SEQ ID NO: 11437 - protein, 17 aa, Neisseria
DLSKEELASIQDTNGKV

SEQ ID NO: 11438 - protein, 25 aa, Neisseria
PGIFNNREDSLSNAAKQNRNSTNGS

SEQ ID NO: 11439 - protein, 15 aa, Neisseria
PPTGKYKSDSNNKIK

SEQ ID NO: 11440 - protein, 6 aa, Neisseria
DQLNNK

SEQ ID NO: 11441 - protein, 37 aa, Neisseria
YLPKTNSEKLNQDIYREVQKMGNGWSVDTSNHSRGGI

SEQ ID NO: 11442 - protein, 11 aa, Neisseria
KDWVNNQKQNG

SEQ ID NO: 11443 - protein, 7 aa, Neisseria
PIRKARF

SEQ ID NO: 11444 - protein, 16 aa, Neisseria
TNVQNDYADVLQKNGY

SEQ ID NO: 11445 - protein, 11 aa, Neisseria
GADGKTYNSGS

SEQ ID NO: 11446 - protein, 10 aa, Neisseria
VHDKDFVGNK

SEQ ID NO: 11447 - protein, 14 aa, Neisseria
GTNDTTQGTCKGLC

SEQ ID NO: 11448 - protein, 13 aa, Neisseria
VPKAGTKEFDDYV

SEQ ID NO: 11449 - protein, 34 aa, Neisseria
VEYDAQGKPINKSKPILVEPNKTKDNEKYEKEAF

SEQ ID NO: 11450 - protein, 7 aa, Neisseria
QADRAVR

SEQ ID NO: 11451 - protein, 5 aa, Neisseria
ATAPK

SEQ ID NO: 11452 - protein, 14 aa, Neisseria
KIIDEKTGKVSFDT

SEQ ID NO: 11453 - protein, 9 aa, Neisseria
DLSKEELAS

SEQ ID NO: 11454 - protein, 5 aa, Neisseria
QDTNG

SEQ ID NO: 11455 - protein, 19 aa, Neisseria
NNREDSLSNAAKQNRNSTN

SEQ ID NO: 11456 - protein, 14 aa, Neisseria
PTGKYKSDSNNKIK

SEQ ID NO: 11457 - protein, 17 aa, Neisseria
TNSEKLNQDIYREVQKM

SEQ ID NO: 11458 - protein, 9 aa, Neisseria
TSNHSRGGI

SEQ ID NO: 11459 - protein, 5 aa, Neisseria
QKQNG

SEQ ID NO: 11460 - protein, 7 aa, Neisseria
PIRKARF

SEQ ID NO: 11461 - protein, 7 aa, Neisseria
DYADVLQ

SEQ ID NO: 11462 - protein, 7 aa, Neisseria
ADGKTYN

SEQ ID NO: 11463 - protein, 7 aa, Neisseria
VHDKDFV

SEQ ID NO: 11464 - protein, 8 aa, Neisseria
NDTTQGTC

SEQ ID NO: 11465 - protein, 13 aa, Neisseria
VPKAGTKEFDDYV

SEQ ID NO: 11466 - protein, 17 aa, Neisseria
VEYDAQGKPINKSKPIL

SEQ ID NO: 11467 - protein, 16 aa, Neisseria
EPNKTKDNEKYEKEAF

SEQ ID NO: 11468 - protein, 13 aa, Neisseria
ERMTQIAKLLNSS

SEQ ID NO: 11469 - protein, 11 aa, Neisseria
FLTEIKDYSEF

SEQ ID NO: 11470 - protein, 7 aa, Neisseria
WDKFRRI

SEQ ID NO: 11471 - protein, 13 aa, Neisseria
VKESRKKIQKPID

SEQ ID NO: 11472 - protein, 8 aa, Neisseria
KSCGSSIG

SEQ ID NO: 11473 - protein, 7 aa, Neisseria
SSLGGFG

SEQ ID NO: 11474 - protein, 16 aa, Neisseria
GAATTRKVAKDMLKSQ

SEQ ID NO: 11475 - protein, 10 aa, Neisseria
ILDLHRIATS

SEQ ID NO: 11476 - protein, 6 aa, Neisseria
QPPPHG

SEQ ID NO: 11477 - protein, 8 aa, Neisseria
VHTLMEEV

SEQ ID NO: 11478 - protein, 17 aa, Neisseria
TYDGVENPFIHPVVQAI

SEQ ID NO: 11479 - protein, 10 aa, Neisseria
LHFLIGYIHP

SEQ ID NO: 11480 - protein, 14 aa, Neisseria
ISISRLLKNAPAQY

SEQ ID NO: 11481 - protein, 10 aa, Neisseria
IKRAVADLEH

SEQ ID NO: 11482 - protein, 12 aa, Neisseria
AIAQYTEKIGKL

SEQ ID NO: 11483 - protein, 9 aa, Neisseria
LQKAVEESG

SEQ ID NO: 11484 - protein, 8 aa, Neisseria
SKLGEYRF

SEQ ID NO: 11485 - protein, 10 aa, Neisseria
SGNALEYVAP

SEQ ID NO: 11486 - protein, 7 aa, Neisseria
LTERMTQ

SEQ ID NO: 11487 - protein, 24 aa, Neisseria
LNSSANNPDIDIPDFLTEIKDYSE

SEQ ID NO: 11488 - protein, 8 aa, Neisseria
SVTDENGT

SEQ ID NO: 11489 - protein, 30 aa, Neisseria
DKFRRIHTEDTRMKWRAVKESRKKIQKPID

SEQ ID NO: 11490 - protein, 6 aa, Neisseria
IPDSLQ

SEQ ID NO: 11491 - protein, 11 aa, Neisseria
LIDKSCGSSIG

SEQ ID NO: 11492 - protein, 12 aa, Neisseria
GGFGRSEQNRFL

SEQ ID NO: 11493 - protein, 23 aa, Neisseria
ATTRKVAKDMLKSQRKPKTKDEI

SEQ ID NO: 11494 - protein, 9 aa, Neisseria
KKAVELKNT

SEQ ID NO: 11495 - protein, 19 aa, Neisseria
NAIENKAEPGQFRQDDEIF

SEQ ID NO: 11496 - protein, 13 aa, Neisseria
INGNSLYQPPPHG

SEQ ID NO: 11497 - protein, 10 aa, Neisseria
NTYDGVENPF

SEQ ID NO: 11498 - protein, 12 aa, Neisseria
HPFGDGNGRTAR

SEQ ID NO: 11499 - protein, 7 aa, Neisseria
RLLKNAP

SEQ ID NO: 11500 - protein, 6 aa, Neisseria
ETDDLD

SEQ ID NO: 11501 - protein, 7 aa, Neisseria
YQCDIIK

SEQ ID NO: 11502 - protein, 13 aa, Neisseria
ISDKQKHQQEFKA

SEQ ID NO: 11503 - protein, 12 aa, Neisseria
YTEKIGKLNQRQ

SEQ ID NO: 11504 - protein, 8 aa, Neisseria
KAVEESGK

SEQ ID NO: 11505 - protein, 15 aa, Neisseria
NTARSDLSKLGEYRF

SEQ ID NO: 11506 - protein, 7 aa, Neisseria
FKSGNAL

SEQ ID NO: 11507 - protein, 10 aa, Neisseria
QDLLERLEKK

SEQ ID NO: 11508 - protein, 7 aa, Neisseria
LTERMTQ

SEQ ID NO: 11509 - protein, 8 aa, Neisseria
ANNPDIDI

SEQ ID NO: 11510 - protein, 8 aa, Neisseria
TEIKDYSE

SEQ ID NO: 11511 - protein, 7 aa, Neisseria
SVTDENG

SEQ ID NO: 11512 - protein, 29 aa, Neisseria
DKFRRIHTEDTRMKWRAVKESRKKIQKPI

SEQ ID NO: 11513 - protein, 7 aa, Neisseria
LIDKSCG

SEQ ID NO: 11514 - protein, 9 aa, Neisseria
GRSEQNRFL

SEQ ID NO: 11515 - protein, 23 aa, Neisseria
ATTRKVAKDMLKSQRKPKTKDEI

SEQ ID NO: 11516 - protein, 8 aa, Neisseria
KKAVELKN

SEQ ID NO: 11517 - protein, 19 aa, Neisseria
NAIENKAEPGQFRQDDEIF

SEQ ID NO: 11518 - protein, 9 aa, Neisseria
GDGNGRTAR

SEQ ID NO: 11519 - protein, 6 aa, Neisseria
ETDDLD

SEQ ID NO: 11520 - protein, 13 aa, Neisseria
ISDKQKHQQEFKA

SEQ ID NO: 11521 - protein, 12 aa, Neisseria
YTEKIGKLNQRQ

SEQ ID NO: 11522 - protein, 8 aa, Neisseria
KAVEESGK

SEQ ID NO: 11523 - protein, 11 aa, Neisseria
TARSDLSKLGE

SEQ ID NO: 11524 - protein, 9 aa, Neisseria
DLLERLEKK

SEQ ID NO: 11525 - protein, 9 aa, Neisseria
IVEMMTYIL

SEQ ID NO: 11526 - protein, 9 aa, Neisseria
WAYFDEVAQ

SEQ ID NO: 11527 - protein, 6 aa, Neisseria
QWFAPL

SEQ ID NO: 11528 - protein, 7 aa, Neisseria
RSAVRQL

SEQ ID NO: 11529 - protein, 7 aa, Neisseria
PSTTVRA

SEQ ID NO: 11530 - protein, 13 aa, Neisseria
KLYPNEQWNESEA

SEQ ID NO: 11531 - protein, 8 aa, Neisseria
YQSPTHRQ

SEQ ID NO: 11532 - protein, 5 aa, Neisseria
LKNGQ

SEQ ID NO: 11533 - protein, 8 aa, Neisseria
CKGTQPIG

SEQ ID NO: 11534 - protein, 21 aa, Neisseria
HYLESDRHLRDNSDWNCGDNI

SEQ ID NO: 11535 - protein, 13 aa, Neisseria
APLGHSHQMRSAV

SEQ ID NO: 11536 - protein, 11 aa, Neisseria
LYHKGSDKGLR

SEQ ID NO: 11537 - protein, 7 aa, Neisseria
QWNESEA

SEQ ID NO: 11538 - protein, 12 aa, Neisseria
LESDRHLRDNSD

SEQ ID NO: 11539 - protein, 8 aa, Neisseria
KGSDKGLR

SEQ ID NO: 11540 - protein, 10 aa, Neisseria
RIGTLEKGAM

SEQ ID NO: 11541 - protein, 15 aa, Neisseria
MPHIFAQYFPEGFLD

SEQ ID NO: 11542 - protein, 6 aa, Neisseria
RETLGR

SEQ ID NO: 11543 - protein, 11 aa, Neisseria
PLFNEWIDGLE

SEQ ID NO: 11544 - protein, 8 aa, Neisseria
FQQYMAEI

SEQ ID NO: 11545 - protein, 9 aa, Neisseria
HHGRFVSVS

SEQ ID NO: 11546 - protein, 5 aa, Neisseria
RRNTK

SEQ ID NO: 11547 - protein, 6 aa, Neisseria
SYIAKG

SEQ ID NO: 11548 - protein, 9 aa, Neisseria
MEDFTSLRQ

SEQ ID NO: 11549 - protein, 15 aa, Neisseria
AAIAQIIRQISGRPD

SEQ ID NO: 11550 - protein, 8 aa, Neisseria
HFFNQLAA

SEQ ID NO: 11551 - protein, 7 aa, Neisseria
VYDVLDT

SEQ ID NO: 11552 - protein, 10 aa, Neisseria
GTQGIFDAYD

SEQ ID NO: 11553 - protein, 5 aa, Neisseria
YSDVL

SEQ ID NO: 11554 - protein, 10 aa, Neisseria
VSGNRMRKPR

SEQ ID NO: 11555 - protein, 13 aa, Neisseria
ANDERIGTLEKGA

SEQ ID NO: 11556 - protein, 8 aa, Neisseria
YDNPNSSL

SEQ ID NO: 11557 - protein, 8 aa, Neisseria
HYQDRSKV

SEQ ID NO: 11558 - protein, 6 aa, Neisseria
FPEGFL

SEQ ID NO: 11559 - protein, 9 aa, Neisseria
APFEDNEML

SEQ ID NO: 11560 - protein, 10 aa, Neisseria
IHVRCNDPLF

SEQ ID NO: 11561 - protein, 15 aa, Neisseria
LEMKNPRILTERDLL

SEQ ID NO: 11562 - protein, 5 aa, Neisseria
GRFVS

SEQ ID NO: 11563 - protein, 19 aa, Neisseria
GIQQKMSLDAIRRNTKQTA

SEQ ID NO: 11564 - protein, 9 aa, Neisseria
GFDASEYPC

SEQ ID NO: 11565 - protein, 8 aa, Neisseria
TSLSEDSS

SEQ ID NO: 11566 - protein, 10 aa, Neisseria
RRFDVSEQGY

SEQ ID NO: 11567 - protein, 5 aa, Neisseria
EDFTS

SEQ ID NO: 11568 - protein, 13 aa, Neisseria
RQYSVEDKYKGSY

SEQ ID NO: 11569 - protein, 9 aa, Neisseria
ISGRPDEDL

SEQ ID NO: 11570 - protein, 8 aa, Neisseria
LKNGDAHL

SEQ ID NO: 11571 - protein, 5 aa, Neisseria
DEYDV

SEQ ID NO: 11572 - protein, 6 aa, Neisseria
AYDDTL

SEQ ID NO: 11573 - protein, 14 aa, Neisseria
LTNHGKKTYPSKNT

SEQ ID NO: 11574 - protein, 15 aa, Neisseria
FAEKYCDLGREDASF

SEQ ID NO: 11575 - protein, 7 aa, Neisseria
VQAKEQV

SEQ ID NO: 11576 - protein, 11 aa, Neisseria
YSDVLRENEWL

SEQ ID NO: 11577 - protein, 10 aa, Neisseria
FIPDENEEGL

SEQ ID NO: 11578 - protein, 8 aa, Neisseria
GNRMRKPR

SEQ ID NO: 11579 - protein, 13 aa, Neisseria
ANDERIGTLEKGA

SEQ ID NO: 11580 - protein, 7 aa, Neisseria
YQDRSKV

SEQ ID NO: 11581 - protein, 9 aa, Neisseria
APFEDNEML

SEQ ID NO: 11582 - protein, 7 aa, Neisseria
IHVRCND

SEQ ID NO: 11583 - protein, 15 aa, Neisseria
LEMKNPRILTERDLL

SEQ ID NO: 11584 - protein, 12 aa, Neisseria
MSLDAIRRNTKQ

SEQ ID NO: 11585 - protein, 6 aa, Neisseria
GFDASE

SEQ ID NO: 11586 - protein, 7 aa, Neisseria
SLSEDSS

SEQ ID NO: 11587 - protein, 7 aa, Neisseria
RRFDVSE

SEQ ID NO: 11588 - protein, 5 aa, Neisseria
EDFTS

SEQ ID NO: 11589 - protein, 9 aa, Neisseria
YSVEDKYKG

SEQ ID NO: 11590 - protein, 9 aa, Neisseria
ISGRPDEDL

SEQ ID NO: 11591 - protein, 7 aa, Neisseria
KNGDAHL

SEQ ID NO: 11592 - protein, 5 aa, Neisseria
DEYDV

SEQ ID NO: 11593 - protein, 9 aa, Neisseria
NHGKKTYPS

SEQ ID NO: 11594 - protein, 15 aa, Neisseria
FAEKYCDLGREDASF

SEQ ID NO: 11595 - protein, 7 aa, Neisseria
VQAKEQV

SEQ ID NO: 11596 - protein, 9 aa, Neisseria
DVLRENEWL

SEQ ID NO: 11597 - protein, 8 aa, Neisseria
PDENEEGL

SEQ ID NO: 11598 - protein, 13 aa, Neisseria
NNYTNAYSDIKTI

SEQ ID NO: 11599 - protein, 8 aa, Neisseria
HGFENIQG

SEQ ID NO: 11600 - protein, 8 aa, Neisseria
SCISNIKF

SEQ ID NO: 11601 - protein, 7 aa, Neisseria
EQINQVL

SEQ ID NO: 11602 - protein, 21 aa, Neisseria
MDTNCLKDNYHGNNYTNAYSD

SEQ ID NO: 11603 - protein, 5 aa, Neisseria
NIQGS

SEQ ID NO: 11604 - protein, 11 aa, Neisseria
YLGREGISEAH

SEQ ID NO: 11605 - protein, 7 aa, Neisseria
YRLESDL

SEQ ID NO: 11606 - protein, 6 aa, Neisseria
RVEQLR

SEQ ID NO: 11607 - protein, 7 aa, Neisseria
GLSDEQI

SEQ ID NO: 11608 - protein, 15 aa, Neisseria
VLEKQKFELESPNLK

SEQ ID NO: 11609 - protein, 11 aa, Neisseria
MDTNCLKDNYH

SEQ ID NO: 11610 - protein, 10 aa, Neisseria
LGREGISEAH

SEQ ID NO: 11611 - protein, 7 aa, Neisseria
YRLESDL

SEQ ID NO: 11612 - protein, 6 aa, Neisseria
RVEQLR

SEQ ID NO: 11613 - protein, 7 aa, Neisseria
GLSDEQI

SEQ ID NO: 11614 - protein, 14 aa, Neisseria
VLEKQKFELESPNL

SEQ ID NO: 11615 - protein, 18 aa, Neisseria
AQTLVEIQDSLYRVVSTV

SEQ ID NO: 11616 - protein, 6 aa, Neisseria
NLKRLT

SEQ ID NO: 11617 - protein, 18 aa, Neisseria
DFKETLVRFGRDMLQDMP

SEQ ID NO: 11618 - protein, 10 aa, Neisseria
YLEYLKQVAS

SEQ ID NO: 11619 - protein, 16 aa, Neisseria
ERLYNAVDRLAESQER

SEQ ID NO: 11620 - protein, 5 aa, Neisseria
TSAIL

SEQ ID NO: 11621 - protein, 7 aa, Neisseria
GARGADF

SEQ ID NO: 11622 - protein, 7 aa, Neisseria
EIQDSLY

SEQ ID NO: 11623 - protein, 18 aa, Neisseria
QYGDDNLKRLTADKRKQY

SEQ ID NO: 11624 - protein, 18 aa, Neisseria
FKISEGSTRVESDFKETL

SEQ ID NO: 11625 - protein, 15 aa, Neisseria
FGRDMLQDMPPKIRS

SEQ ID NO: 11626 - protein, 26 aa, Neisseria
VASEGYQTERLYNAVDRLAESQERIT

SEQ ID NO: 11627 - protein, 7 aa, Neisseria
KGARGAD

SEQ ID NO: 11628 - protein, 24 aa, Neisseria
QIGRRSYSREDISEANRRAERVPY

SEQ ID NO: 11629 - protein, 6 aa, Neisseria
LVSDGN

SEQ ID NO: 11630 - protein, 5 aa, Neisseria
SDIGD

SEQ ID NO: 11631 - protein, 6 aa, Neisseria
EIQDSL

SEQ ID NO: 11632 - protein, 17 aa, Neisseria
YGDDNLKRLTADKRKQY

SEQ ID NO: 11633 - protein, 18 aa, Neisseria
FKISEGSTRVESDFKETL

SEQ ID NO: 11634 - protein, 7 aa, Neisseria
FGRDMLQ

SEQ ID NO: 11635 - protein, 7 aa, Neisseria
MPPKIRS

SEQ ID NO: 11636 - protein, 17 aa, Neisseria
RLYNAVDRLAESQERIT

SEQ ID NO: 11637 - protein, 7 aa, Neisseria
KGARGAD

SEQ ID NO: 11638 - protein, 24 aa, Neisseria
QIGRRSYSREDISEANRRAERVPY

SEQ ID NO: 11639 - protein, 8 aa, Neisseria
DYQSAANK

SEQ ID NO: 11640 - protein, 10 aa, Neisseria
NLLHDFSDGL

SEQ ID NO: 11641 - protein, 6 aa, Neisseria
KADKIT

SEQ ID NO: 11642 - protein, 10 aa, Neisseria
QKAEKLSKAA

SEQ ID NO: 11643 - protein, 5 aa, Neisseria
RDTGD

SEQ ID NO: 11644 - protein, 11 aa, Neisseria
NAQKEPTREWA

SEQ ID NO: 11645 - protein, 27 aa, Neisseria
ACGSQSEEQPASAQPQEQAQSELKTMP

SEQ ID NO: 11646 - protein, 20 aa, Neisseria
TDYQSAANKGLNDQKTGLTL

SEQ ID NO: 11647 - protein, 16 aa, Neisseria
DNAEGKNLLHDFSDGL

SEQ ID NO: 11648 - protein, 11 aa, Neisseria
VDTDKADKITA

SEQ ID NO: 11649 - protein, 15 aa, Neisseria
WNTDAMPQKAEKLSK

SEQ ID NO: 11650 - protein, 37 aa, Neisseria
APEDRTMLRDTGDQIEMAIDSHNAQKEPTREWARGGI

SEQ ID NO: 11651 - protein, 8 aa, Neisseria
SQSEEQPA

SEQ ID NO: 11652 - protein, 12 aa, Neisseria
QPQEQAQSELKT

SEQ ID NO: 11653 - protein, 12 aa, Neisseria
SAANKGLNDQKT

SEQ ID NO: 11654 - protein, 8 aa, Neisseria
DNAEGKNL

SEQ ID NO: 11655 - protein, 11 aa, Neisseria
VDTDKADKITA

SEQ ID NO: 11656 - protein, 11 aa, Neisseria
AMPQKAEKLSK

SEQ ID NO: 11657 - protein, 19 aa, Neisseria
APEDRTMLRDTGDQIEMAI

SEQ ID NO: 11658 - protein, 14 aa, Neisseria
SHNAQKEPTREWAR

SEQ ID NO: 11659 - protein, 10 aa, Neisseria
ATLADELQYV

SEQ ID NO: 11660 - protein, 5 aa, Neisseria
AEVAA

SEQ ID NO: 11661 - protein, 12 aa, Neisseria
QTVISEIVRRHT

SEQ ID NO: 11662 - protein, 12 aa, Neisseria
PYLGGLPEALHT

SEQ ID NO: 11663 - protein, 11 aa, Neisseria
FASPGGWQIIG

SEQ ID NO: 11664 - protein, 6 aa, Neisseria
RFDTDL

SEQ ID NO: 11665 - protein, 7 aa, Neisseria
DHQGKLV

SEQ ID NO: 11666 - protein, 11 aa, Neisseria
YGGEYGPDLAE

SEQ ID NO: 11667 - protein, 7 aa, Neisseria
IVRRHTA

SEQ ID NO: 11668 - protein, 14 aa, Neisseria
LHTPRRAVPRTSVP

SEQ ID NO: 11669 - protein, 5 aa, Neisseria
IGGSQ

SEQ ID NO: 11670 - protein, 5 aa, Neisseria
DLNPP

SEQ ID NO: 11671 - protein, 14 aa, Neisseria
AGDQVRFVAERIEP

SEQ ID NO: 11672 - protein, 5 aa, Neisseria
FDTDL

SEQ ID NO: 11673 - protein, 7 aa, Neisseria
DHQGKLV

SEQ ID NO: 11674 - protein, 7 aa, Neisseria
YGPDLAE

SEQ ID NO: 11675 - protein, 6 aa, Neisseria
IVRRHT

SEQ ID NO: 11676 - protein, 8 aa, Neisseria
HTPRRAVP

SEQ ID NO: 11677 - protein, 12 aa, Neisseria
DQVRFVAERIEP

SEQ ID NO: 11678 - protein, 11 aa, Neisseria
PFCSVLSTLGL

SEQ ID NO: 11679 - protein, 9 aa, Neisseria
YQYFRDFAE

SEQ ID NO: 11680 - protein, 11 aa, Neisseria
KILGRVLNGIP

SEQ ID NO: 11681 - protein, 5 aa, Neisseria
YVNSV

SEQ ID NO: 11682 - protein, 9 aa, Neisseria
RLNKLVTEI

SEQ ID NO: 11683 - protein, 8 aa, Neisseria
TQQVRKAD

SEQ ID NO: 11684 - protein, 5 aa, Neisseria
GGTPL

SEQ ID NO: 11685 - protein, 13 aa, Neisseria
LSTYAGFDNFFNK

SEQ ID NO: 11686 - protein, 5 aa, Neisseria
IRSTI

SEQ ID NO: 11687 - protein, 5 aa, Neisseria
TLQGL

SEQ ID NO: 11688 - protein, 10 aa, Neisseria
KGDRLSKLGA

SEQ ID NO: 11689 - protein, 8 aa, Neisseria
ASDGSKQA

SEQ ID NO: 11690 - protein, 5 aa, Neisseria
VYEYI

SEQ ID NO: 11691 - protein, 7 aa, Neisseria
EQVAQAE

SEQ ID NO: 11692 - protein, 11 aa, Neisseria
KTPECYRSYHS

SEQ ID NO: 11693 - protein, 6 aa, Neisseria
ENYRAL

SEQ ID NO: 11694 - protein, 6 aa, Neisseria
SIRAGK

SEQ ID NO: 11695 - protein, 14 aa, Neisseria
TLDGFGTFRFLTGI

SEQ ID NO: 11696 - protein, 5 aa, Neisseria
PQTTE

SEQ ID NO: 11697 - protein, 7 aa, Neisseria
YADLGAY

SEQ ID NO: 11698 - protein, 6 aa, Neisseria
LYNPLK

SEQ ID NO: 11699 - protein, 14 aa, Neisseria
YNQLQATDISRQVQ

SEQ ID NO: 11700 - protein, 10 aa, Neisseria
QALQAWQNSQ

SEQ ID NO: 11701 - protein, 11 aa, Neisseria
KQTDPLTGILT

SEQ ID NO: 11702 - protein, 14 aa, Neisseria
SADICRQVAKAADT

SEQ ID NO: 11703 - protein, 5 aa, Neisseria
ELDTY

SEQ ID NO: 11704 - protein, 31 aa, Neisseria
ARQGGDAQAVETARHAYLNALNRLSRQIHSL

SEQ ID NO: 11705 - protein, 17 aa, Neisseria
IRMPNLAELISRSANTA

SEQ ID NO: 11706 - protein, 13 aa, Neisseria
QAGRRIDRHLTDP

SEQ ID NO: 11707 - protein, 11 aa, Neisseria
GTHRPYQQTTN

SEQ ID NO: 11708 - protein, 7 aa, Neisseria
TNNRFDE

SEQ ID NO: 11709 - protein, 8 aa, Neisseria
EINSPAQI

SEQ ID NO: 11710 - protein, 5 aa, Neisseria
DKTVE

SEQ ID NO: 11711 - protein, 7 aa, Neisseria
QAAHGTL

SEQ ID NO: 11712 - protein, 9 aa, Neisseria
VRNDVDYQY

SEQ ID NO: 11713 - protein, 8 aa, Neisseria
DFAENKGA

SEQ ID NO: 11714 - protein, 10 aa, Neisseria
SIQDKQGKIL

SEQ ID NO: 11715 - protein, 13 aa, Neisseria
PMPDFRVSNRQTA

SEQ ID NO: 11716 - protein, 12 aa, Neisseria
GNDTQNPEEQAY

SEQ ID NO: 11717 - protein, 22 aa, Neisseria
LVSRNPHPDYDYHLPRLNKLVT

SEQ ID NO: 11718 - protein, 5 aa, Neisseria
ISPTA

SEQ ID NO: 11719 - protein, 7 aa, Neisseria
GNGQPKA

SEQ ID NO: 11720 - protein, 9 aa, Neisseria
AYLDTDRFP

SEQ ID NO: 11721 - protein, 20 aa, Neisseria
LGSGTQQVRKADGTRTRTAP

SEQ ID NO: 11722 - protein, 7 aa, Neisseria
TGGTPLK

SEQ ID NO: 11723 - protein, 8 aa, Neisseria
SLTDQPLN

SEQ ID NO: 11724 - protein, 7 aa, Neisseria
AGDSGSP

SEQ ID NO: 11725 - protein, 6 aa, Neisseria
DKHENR

SEQ ID NO: 11726 - protein, 11 aa, Neisseria
TIRQYETRLDV

SEQ ID NO: 11727 - protein, 11 aa, Neisseria
IWRDNGNGNST

SEQ ID NO: 11728 - protein, 7 aa, Neisseria
GLNERIT

SEQ ID NO: 11729 - protein, 20 aa, Neisseria
NPSLAPQNDSRHMPSEDAGK

SEQ ID NO: 11730 - protein, 9 aa, Neisseria
LSSRFDNKT

SEQ ID NO: 11731 - protein, 6 aa, Neisseria
NINQGA

SEQ ID NO: 11732 - protein, 5 aa, Neisseria
GKNHT

SEQ ID NO: 11733 - protein, 8 aa, Neisseria
VADGKRVF

SEQ ID NO: 11734 - protein, 14 aa, Neisseria
VSNPKGDRLSKLGA

SEQ ID NO: 11735 - protein, 15 aa, Neisseria
GQGINQGDISIGEGT

SEQ ID NO: 11736 - protein, 10 aa, Neisseria
KAASDGSKQA

SEQ ID NO: 11737 - protein, 7 aa, Neisseria
ITSGRGT

SEQ ID NO: 11738 - protein, 10 aa, Neisseria
ADSQQIKPEN

SEQ ID NO: 11739 - protein, 13 aa, Neisseria
FRGGRLDLNGNNL

SEQ ID NO: 11740 - protein, 7 aa, Neisseria
RHADGGA

SEQ ID NO: 11741 - protein, 7 aa, Neisseria
HNPDQAA

SEQ ID NO: 11742 - protein, 7 aa, Neisseria
LSPEHVE

SEQ ID NO: 11743 - protein, 8 aa, Neisseria
WGNRPQGN

SEQ ID NO: 11744 - protein, 9 aa, Neisseria
NPHRNRRTD

SEQ ID NO: 11745 - protein, 8 aa, Neisseria
KPGGNPRE

SEQ ID NO: 11746 - protein, 8 aa, Neisseria
LNMKNSTS

SEQ ID NO: 11747 - protein, 21 aa, Neisseria
GNNRQQAAEQVAQAENARPDL

SEQ ID NO: 11748 - protein, 29 aa, Neisseria
GYLGENAQTGKAAPSYSKTNEAAIEKTRH

SEQ ID NO: 11749 - protein, 9 aa, Neisseria
GRPEYRYNG

SEQ ID NO: 11750 - protein, 8 aa, Neisseria
YRPKRTDS

SEQ ID NO: 11751 - protein, 7 aa, Neisseria
GGMNLNG

SEQ ID NO: 11752 - protein, 31 aa, Neisseria
VSGRPVPHAYDHQAKREPVLENEWTDGSFKA

SEQ ID NO: 11753 - protein, 8 aa, Neisseria
RFTLRNHA

SEQ ID NO: 11754 - protein, 14 aa, Neisseria
TAGRNTAHLDGDIT

SEQ ID NO: 11755 - protein, 18 aa, Neisseria
TQGKTPECYRSYHSGSTH

SEQ ID NO: 11756 - protein, 7 aa, Neisseria
LKAENYR

SEQ ID NO: 11757 - protein, 19 aa, Neisseria
TQVRGDITLNDRSELRLGK

SEQ ID NO: 11758 - protein, 19 aa, Neisseria
SIRAGKDTAVRMEADSNWT

SEQ ID NO: 11759 - protein, 7 aa, Neisseria
SQSSHTG

SEQ ID NO: 11760 - protein, 13 aa, Neisseria
PDFANNTHNNRFN

SEQ ID NO: 11761 - protein, 5 aa, Neisseria
GTLDG

SEQ ID NO: 11762 - protein, 19 aa, Neisseria
IVRKQNAPPLKLEGDSRGA

SEQ ID NO: 11763 - protein, 13 aa, Neisseria
VKNTGQEPQTTES

SEQ ID NO: 11764 - protein, 8 aa, Neisseria
LNPKHSHQ

SEQ ID NO: 11765 - protein, 9 aa, Neisseria
ILRKNNNGY

SEQ ID NO: 11766 - protein, 23 aa, Neisseria
NPLKEAELQIEATRAEHERNQQA

SEQ ID NO: 11767 - protein, 16 aa, Neisseria
DISRQVQHDSDATRQA

SEQ ID NO: 11768 - protein, 14 aa, Neisseria
WQNSQTELARIDSQ

SEQ ID NO: 11769 - protein, 8 aa, Neisseria
LKQTDPLT

SEQ ID NO: 11770 - protein, 14 aa, Neisseria
DICRQVAKAADTND

SEQ ID NO: 11771 - protein, 28 aa, Neisseria
TELDTYIERVEMAESELDKARQGGDAQA

SEQ ID NO: 11772 - protein, 5 aa, Neisseria
NRLSR

SEQ ID NO: 11773 - protein, 12 aa, Neisseria
LISRSANTAVSE

SEQ ID NO: 11774 - protein, 25 aa, Neisseria
AAYNTGRQQAGRRIDRHLTDPQQQN

SEQ ID NO: 11775 - protein, 22 aa, Neisseria
ETGTQQTDYHSGTHRPYQQTTN

SEQ ID NO: 11776 - protein, 6 aa, Neisseria
ITDRLS

SEQ ID NO: 11777 - protein, 22 aa, Neisseria
LTDERTNNRFDEGVSARNRSNG

SEQ ID NO: 11778 - protein, 7 aa, Neisseria
VKGENGA

SEQ ID NO: 11779 - protein, 18 aa, Neisseria
GYSNSRTRFTDYDGAAVR

SEQ ID NO: 11780 - protein, 17 aa, Neisseria
HAWDAGINTGIKIDTGI

SEQ ID NO: 11781 - protein, 11 aa, Neisseria
RINRSNGNRYV

SEQ ID NO: 11782 - protein, 11 aa, Neisseria
GAEINSPAQIQ

SEQ ID NO: 11783 - protein, 8 aa, Neisseria
IRLDKTVE

SEQ ID NO: 11784 - protein, 15 aa, Neisseria
FSSDYYHTRQNSGSA

SEQ ID NO: 11785 - protein, 7 aa, Neisseria
SVNDRTL

SEQ ID NO: 11786 - protein, 7 aa, Neisseria
AGYKGWN

SEQ ID NO: 11787 - protein, 14 aa, Neisseria
YGKDSNTARHKQAG

SEQ ID NO: 11788 - protein, 6 aa, Neisseria
VRNDVD

SEQ ID NO: 11789 - protein, 7 aa, Neisseria
DFAENKG

SEQ ID NO: 11790 - protein, 10 aa, Neisseria
SIQDKQGKIL

SEQ ID NO: 11791 - protein, 10 aa, Neisseria
PDFRVSNRQT

SEQ ID NO: 11792 - protein, 11 aa, Neisseria
NDTQNPEEQAY

SEQ ID NO: 11793 - protein, 6 aa, Neisseria
NPHPDY

SEQ ID NO: 11794 - protein, 7 aa, Neisseria
RLNKLVT

SEQ ID NO: 11795 - protein, 5 aa, Neisseria
GQPKA

SEQ ID NO: 11796 - protein, 5 aa, Neisseria
LDTDR

SEQ ID NO: 11797 - protein, 13 aa, Neisseria
QQVRKADGTRTRT

SEQ ID NO: 11798 - protein, 5 aa, Neisseria
DKHEN

SEQ ID NO: 11799 - protein, 11 aa, Neisseria
TIRQYETRLDV

SEQ ID NO: 11800 - protein, 5 aa, Neisseria
DNGNG

SEQ ID NO: 11801 - protein, 6 aa, Neisseria
LNERIT

SEQ ID NO: 11802 - protein, 15 aa, Neisseria
PQNDSRHMPSEDAGK

SEQ ID NO: 11803 - protein, 7 aa, Neisseria
SRFDNKT

SEQ ID NO: 11804 - protein, 5 aa, Neisseria
ADGKR

SEQ ID NO: 11805 - protein, 9 aa, Neisseria
NPKGDRLSK

SEQ ID NO: 11806 - protein, 10 aa, Neisseria
KAASDGSKQA

SEQ ID NO: 11807 - protein, 6 aa, Neisseria
QQIKPE

SEQ ID NO: 11808 - protein, 9 aa, Neisseria
RGGRLDLNG

SEQ ID NO: 11809 - protein, 6 aa, Neisseria
RHADGG

SEQ ID NO: 11810 - protein, 7 aa, Neisseria
HRNRRTD

SEQ ID NO: 11811 - protein, 6 aa, Neisseria
GGNPRE

SEQ ID NO: 11812 - protein, 18 aa, Neisseria
NRQQAAEQVAQAENARPD

SEQ ID NO: 11813 - protein, 24 aa, Neisseria
NAQTGKAAPSYSKTNEAAIEKTRH

SEQ ID NO: 11814 - protein, 5 aa, Neisseria
PEYRY

SEQ ID NO: 11815 - protein, 8 aa, Neisseria
YRPKRTDS

SEQ ID NO: 11816 - protein, 9 aa, Neisseria
HQAKREPVL

SEQ ID NO: 11817 - protein, 5 aa, Neisseria
TAGRN

SEQ ID NO: 11818 - protein, 6 aa, Neisseria
LDGDIT

SEQ ID NO: 11819 - protein, 7 aa, Neisseria
KTPECYR

SEQ ID NO: 11820 - protein, 7 aa, Neisseria
LKAENYR

SEQ ID NO: 11821 - protein, 18 aa, Neisseria
QVRGDITLNDRSELRLGK

SEQ ID NO: 11822 - protein, 14 aa, Neisseria
RAGKDTAVRMEADS

SEQ ID NO: 11823 - protein, 8 aa, Neisseria
IVRKQNAP

SEQ ID NO: 11824 - protein, 9 aa, Neisseria
LKLEGDSRG

SEQ ID NO: 11825 - protein, 10 aa, Neisseria
NTGQEPQTTE

SEQ ID NO: 11826 - protein, 5 aa, Neisseria
PKHSH

SEQ ID NO: 11827 - protein, 7 aa, Neisseria
ILRKNNN

SEQ ID NO: 11828 - protein, 21 aa, Neisseria
PLKEAELQIEATRAEHERNQQ

SEQ ID NO: 11829 - protein, 11 aa, Neisseria
VQHDSDATRQA

SEQ ID NO: 11830 - protein, 10 aa, Neisseria
SQTELARIDS

SEQ ID NO: 11831 - protein, 6 aa, Neisseria
LKQTDP

SEQ ID NO: 11832 - protein, 14 aa, Neisseria
DICRQVAKAADTND

SEQ ID NO: 11833 - protein, 24 aa, Neisseria
TYIERVEMAESELDKARQGGDAQA

SEQ ID NO: 11834 - protein, 19 aa, Neisseria
TGRQQAGRRIDRHLTDPQQ

SEQ ID NO: 11835 - protein, 6 aa, Neisseria
THRPYQ

SEQ ID NO: 11836 - protein, 6 aa, Neisseria
ITDRLS

SEQ ID NO: 11837 - protein, 22 aa, Neisseria
LTDERTNNRFDEGVSARNRSNG

SEQ ID NO: 11838 - protein, 15 aa, Neisseria
NSRTRFTDYDGAAVR

SEQ ID NO: 11839 - protein, 5 aa, Neisseria
IKIDT

SEQ ID NO: 11840 - protein, 7 aa, Neisseria
RINRSNG

SEQ ID NO: 11841 - protein, 6 aa, Neisseria
GAEINS

SEQ ID NO: 11842 - protein, 8 aa, Neisseria
IRLDKTVE

SEQ ID NO: 11843 - protein, 7 aa, Neisseria
SVNDRTL

SEQ ID NO: 11844 - protein, 14 aa, Neisseria
YGKDSNTARHKQAG

SEQ ID NO: 11845 - protein, 8 aa, Neisseria
TVLAALSS

SEQ ID NO: 11846 - protein, 5 aa, Neisseria
QTEGL

SEQ ID NO: 11847 - protein, 5 aa, Neisseria
GQRSY

SEQ ID NO: 11848 - protein, 8 aa, Neisseria
FAATVGTK

SEQ ID NO: 11849 - protein, 11 aa, Neisseria
PASLREIPQSV

SEQ ID NO: 11850 - protein, 11 aa, Neisseria
RNVDTFDQLAR

SEQ ID NO: 11851 - protein, 57 aa, Neisseria
PAQMQSINGTLPNLFAFDRVEVMRGPSGLFDSSGEMGGIVNLVRKRPTKAFQGHAAA

SEQ ID NO: 11852 - protein, 5 aa, Neisseria
GTHKQ

SEQ ID NO: 11853 - protein, 5 aa, Neisseria
SLPQH

SEQ ID NO: 11854 - protein, 9 aa, Neisseria
HDVFADLKH

SEQ ID NO: 11855 - protein, 7 aa, Neisseria
LNNTGQA

SEQ ID NO: 11856 - protein, 5 aa, Neisseria
RLRST

SEQ ID NO: 11857 - protein, 7 aa, Neisseria
NEQGRST

SEQ ID NO: 11858 - protein, 9 aa, Neisseria
ALDGFRALP

SEQ ID NO: 11859 - protein, 6 aa, Neisseria
KGFNHS

SEQ ID NO: 11860 - protein, 15 aa, Neisseria
KTVFRPLEGLSLIAG

SEQ ID NO: 11861 - protein, 9 aa, Neisseria
GKTLHKASK

SEQ ID NO: 11862 - protein, 6 aa, Neisseria
PREGNQ

SEQ ID NO: 11863 - protein, 9 aa, Neisseria
GKRVMEGVE

SEQ ID NO: 11864 - protein, 7 aa, Neisseria
ANLWTTY

SEQ ID NO: 11865 - protein, 10 aa, Neisseria
VNAMSGITSS

SEQ ID NO: 11866 - protein, 11 aa, Neisseria
GGYATFDAMAA

SEQ ID NO: 11867 - protein, 6 aa, Neisseria
QTEGLE

SEQ ID NO: 11868 - protein, 9 aa, Neisseria
HIKGQRSYN

SEQ ID NO: 11869 - protein, 10 aa, Neisseria
ATEKNGDYSS

SEQ ID NO: 11870 - protein, 8 aa, Neisseria
ASLREIPQ

SEQ ID NO: 11871 - protein, 31 aa, Neisseria
QQVKDRNVDTFDQLARKTPGLRVLSNDDGRS

SEQ ID NO: 11872 - protein, 13 aa, Neisseria
RGYEYSEYNIDGL

SEQ ID NO: 11873 - protein, 21 aa, Neisseria
DRVEVMRGPSGLFDSSGEMGG

SEQ ID NO: 11874 - protein, 9 aa, Neisseria
VRKRPTKAF

SEQ ID NO: 11875 - protein, 26 aa, Neisseria
GTHKQYKAEADVSGSLNSDGSVRGRV

SEQ ID NO: 11876 - protein, 15 aa, Neisseria
GASPRPAEKNNRRET

SEQ ID NO: 11877 - protein, 9 aa, Neisseria
WDINPDTVL

SEQ ID NO: 11878 - protein, 9 aa, Neisseria
QQRRLAPYN

SEQ ID NO: 11879 - protein, 11 aa, Neisseria
PADANNKLPSL

SEQ ID NO: 11880 - protein, 7 aa, Neisseria
FGNGGYG

SEQ ID NO: 11881 - protein, 14 aa, Neisseria
VGMRYSDRKADSNY

SEQ ID NO: 11882 - protein, 12 aa, Neisseria
AGSKLNNTGQAD

SEQ ID NO: 11883 - protein, 19 aa, Neisseria
GTDIKQKAFAVDASYSRPF

SEQ ID NO: 11884 - protein, 21 aa, Neisseria
DYNRLRSTNEQGRSTLSKSVA

SEQ ID NO: 11885 - protein, 10 aa, Neisseria
NARAGNKGFN

SEQ ID NO: 11886 - protein, 12 aa, Neisseria
SVTEENLDETGL

SEQ ID NO: 11887 - protein, 26 aa, Neisseria
AGGRVGHHKIESGDGKTLHKASKTKF

SEQ ID NO: 11888 - protein, 8 aa, Neisseria
DIDGSNSL

SEQ ID NO: 11889 - protein, 20 aa, Neisseria
TPQTSIGTDGKLLKPREGNQ

SEQ ID NO: 11890 - protein, 13 aa, Neisseria
GYKGSYMDDRLNT

SEQ ID NO: 11891 - protein, 7 aa, Neisseria
RMKDKNA

SEQ ID NO: 11892 - protein, 11 aa, Neisseria
PLDSNNKKTRY

SEQ ID NO: 11893 - protein, 9 aa, Neisseria
ALGLLETEI

SEQ ID NO: 11894 - protein, 13 aa, Neisseria
QIKTASNSRDEGI

SEQ ID NO: 11895 - protein, 6 aa, Neisseria
KHSANL

SEQ ID NO: 11896 - protein, 7 aa, Neisseria
FTPKLKL

SEQ ID NO: 11897 - protein, 7 aa, Neisseria
INADNIF

SEQ ID NO: 11898 - protein, 16 aa, Neisseria
VGSESTFNIPGSERSL

SEQ ID NO: 11899 - protein, 5 aa, Neisseria
KGQRS

SEQ ID NO: 11900 - protein, 7 aa, Neisseria
ATEKNGD

SEQ ID NO: 11901 - protein, 8 aa, Neisseria
ASLREIPQ

SEQ ID NO: 11902 - protein, 9 aa, Neisseria
QVKDRNVDT

SEQ ID NO: 11903 - protein, 9 aa, Neisseria
DQLARKTPG

SEQ ID NO: 11904 - protein, 8 aa, Neisseria
LSNDDGRS

SEQ ID NO: 11905 - protein, 9 aa, Neisseria
DRVEVMRGP

SEQ ID NO: 11906 - protein, 5 aa, Neisseria
SSGEM

SEQ ID NO: 11907 - protein, 7 aa, Neisseria
VRKRPTK

SEQ ID NO: 11908 - protein, 9 aa, Neisseria
KQYKAEADV

SEQ ID NO: 11909 - protein, 11 aa, Neisseria
LNSDGSVRGRV

SEQ ID NO: 11910 - protein, 14 aa, Neisseria
ASPRPAEKNNRRET

SEQ ID NO: 11911 - protein, 5 aa, Neisseria
WDINP

SEQ ID NO: 11912 - protein, 6 aa, Neisseria
QQRRLA

SEQ ID NO: 11913 - protein, 8 aa, Neisseria
PADANNKL

SEQ ID NO: 11914 - protein, 12 aa, Neisseria
VGMRYSDRKADS

SEQ ID NO: 11915 - protein, 9 aa, Neisseria
TDIKQKAFA

SEQ ID NO: 11916 - protein, 17 aa, Neisseria
DYNRLRSTNEQGRSTLS

SEQ ID NO: 11917 - protein, 8 aa, Neisseria
ARAGNKGF

SEQ ID NO: 11918 - protein, 8 aa, Neisseria
VTEENLDE

SEQ ID NO: 11919 - protein, 23 aa, Neisseria
RVGHHKIESGDGKTLHKASKTKF

SEQ ID NO: 11920 - protein, 15 aa, Neisseria
IGTDGKLLKPREGNQ

SEQ ID NO: 11921 - protein, 9 aa, Neisseria
SYMDDRLNT

SEQ ID NO: 11922 - protein, 7 aa, Neisseria
RMKDKNA

SEQ ID NO: 11923 - protein, 11 aa, Neisseria
PLDSNNKKTRY

SEQ ID NO: 11924 - protein, 14 aa, Neisseria
ALGKRVMEGVETEI

SEQ ID NO: 11925 - protein, 11 aa, Neisseria
IKTASNSRDEG

SEQ ID NO: 11926 - protein, 6 aa, Neisseria
GSERSL

SEQ ID NO: 11927 - protein, 5 aa, Neisseria
KGYIN

SEQ ID NO: 11928 - protein, 11 aa, Neisseria
ETPQTIDTLNI

SEQ ID NO: 11929 - protein, 8 aa, Neisseria
NDLSSILE

SEQ ID NO: 11930 - protein, 6 aa, Neisseria
YRDGVR

SEQ ID NO: 11931 - protein, 5 aa, Neisseria
RSTAN

SEQ ID NO: 11932 - protein, 10 aa, Neisseria
ERVEILKGPS

SEQ ID NO: 11933 - protein, 25 aa, Neisseria
VINMVSKYANFKQSRNIGAVYGSWA

SEQ ID NO: 11934 - protein, 16 aa, Neisseria
YDNVERTPDRSPTKSV

SEQ ID NO: 11935 - protein, 7 aa, Neisseria
DFDHFYA

SEQ ID NO: 11936 - protein, 6 aa, Neisseria
INPYDR

SEQ ID NO: 11937 - protein, 5 aa, Neisseria
SSRQY

SEQ ID NO: 11938 - protein, 11 aa, Neisseria
HTLYASYNKGF

SEQ ID NO: 11939 - protein, 6 aa, Neisseria
YTRQYE

SEQ ID NO: 11940 - protein, 6 aa, Neisseria
DRLSTT

SEQ ID NO: 11941 - protein, 8 aa, Neisseria
LSAIGQII

SEQ ID NO: 11942 - protein, 5 aa, Neisseria
NTSNV

SEQ ID NO: 11943 - protein, 10 aa, Neisseria
LPGFARVDAM

SEQ ID NO: 11944 - protein, 9 aa, Neisseria
ADTQDNGEH

SEQ ID NO: 11945 - protein, 8 aa, Neisseria
GQSDTSVL

SEQ ID NO: 11946 - protein, 22 aa, Neisseria
INYDEAAVTRNGQLIKETPQTI

SEQ ID NO: 11947 - protein, 12 aa, Neisseria
NIQKNKNYGTND

SEQ ID NO: 11948 - protein, 5 aa, Neisseria
GNAGI

SEQ ID NO: 11949 - protein, 11 aa, Neisseria
AAYDMRGESIF

SEQ ID NO: 11950 - protein, 37 aa, Neisseria
FQADASDIYRDGVRESGQVRRSTANIERVEILKGPSS

SEQ ID NO: 11951 - protein, 7 aa, Neisseria
GRTNGGG

SEQ ID NO: 11952 - protein, 10 aa, Neisseria
ANFKQSRNIG

SEQ ID NO: 11953 - protein, 10 aa, Neisseria
WANRSLNMDI

SEQ ID NO: 11954 - protein, 9 aa, Neisseria
EVLNKNVAI

SEQ ID NO: 11955 - protein, 20 aa, Neisseria
LTGEVGRANSFRSGIDSKNV

SEQ ID NO: 11956 - protein, 38 aa, Neisseria
VKLDNGLKWTGQYTYDNVERTPDRSPTKSVYDRFGLPY

SEQ ID NO: 11957 - protein, 13 aa, Neisseria
FAHRNDFVKDKLQ

SEQ ID NO: 11958 - protein, 17 aa, Neisseria
WRSDLEYAFNDKWRAQW

SEQ ID NO: 11959 - protein, 6 aa, Neisseria
TAAQDF

SEQ ID NO: 11960 - protein, 24 aa, Neisseria
AGSENGNLIKRNYAWQQTDNKTLS

SEQ ID NO: 11961 - protein, 13 aa, Neisseria
GMDYSREHRNPTL

SEQ ID NO: 11962 - protein, 16 aa, Neisseria
NPYDRASWPASGRLQP

SEQ ID NO: 11963 - protein, 9 aa, Neisseria
TQNRHKADS

SEQ ID NO: 11964 - protein, 40 aa, Neisseria
SATPDLKFVLGGRYDKYTFNSENKLTGSSRQYSGHSFSPN

SEQ ID NO: 11965 - protein, 13 aa, Neisseria
YNKGFAPYGGRGG

SEQ ID NO: 11966 - protein, 25 aa, Neisseria
NADPEYTRQYETGVKSSWLDDRLST

SEQ ID NO: 11967 - protein, 14 aa, Neisseria
RFNIRYRPDPKNNP

SEQ ID NO: 11968 - protein, 11 aa, Neisseria
VSGKHRSRGVE

SEQ ID NO: 11969 - protein, 7 aa, Neisseria
IPKKLYL

SEQ ID NO: 11970 - protein, 13 aa, Neisseria
KVVEDKENPDRVG

SEQ ID NO: 11971 - protein, 6 aa, Neisseria
NNTSNV

SEQ ID NO: 11972 - protein, 9 aa, Neisseria
RYTPTENLY

SEQ ID NO: 11973 - protein, 17 aa, Neisseria
GTGKRYGYNSRNKEVTT

SEQ ID NO: 11974 - protein, 5 aa, Neisseria
WNHKN

SEQ ID NO: 11975 - protein, 20 aa, Neisseria
LNQKYWRSDSMPGNPRGYTA

SEQ ID NO: 11976 - protein, 7 aa, Neisseria
DTQDNGE

SEQ ID NO: 11977 - protein, 7 aa, Neisseria
GQSDTSV

SEQ ID NO: 11978 - protein, 7 aa, Neisseria
DEAAVTR

SEQ ID NO: 11979 - protein, 9 aa, Neisseria
QLIKETPQT

SEQ ID NO: 11980 - protein, 7 aa, Neisseria
QKNKNYG

SEQ ID NO: 11981 - protein, 9 aa, Neisseria
YDMRGESIF

SEQ ID NO: 11982 - protein, 36 aa, Neisseria
FQADASDIYRDGVRESGQVRRSTANIERVEILKGPS

SEQ ID NO: 11983 - protein, 5 aa, Neisseria
KQSRN

SEQ ID NO: 11984 - protein, 7 aa, Neisseria
LTGEVGR

SEQ ID NO: 11985 - protein, 7 aa, Neisseria
SGIDSKN

SEQ ID NO: 11986 - protein, 5 aa, Neisseria
VKLDN

SEQ ID NO: 11987 - protein, 11 aa, Neisseria
NVERTPDRSPT

SEQ ID NO: 11988 - protein, 11 aa, Neisseria
HRNDFVKDKLQ

SEQ ID NO: 11989 - protein, 6 aa, Neisseria
TAAQDF

SEQ ID NO: 11990 - protein, 8 aa, Neisseria
SENGNLIK

SEQ ID NO: 11991 - protein, 6 aa, Neisseria
TDNKTL

SEQ ID NO: 11992 - protein, 9 aa, Neisseria
DYSREHRNP

SEQ ID NO: 11993 - protein, 6 aa, Neisseria
PYDRAS

SEQ ID NO: 11994 - protein, 7 aa, Neisseria
NRHKADS

SEQ ID NO: 11995 - protein, 5 aa, Neisseria
GRYDK

SEQ ID NO: 11996 - protein, 13 aa, Neisseria
SENKLTGSSRQYS

SEQ ID NO: 11997 - protein, 13 aa, Neisseria
ADPEYTRQYETGV

SEQ ID NO: 11998 - protein, 7 aa, Neisseria
WLDDRLS

SEQ ID NO: 11999 - protein, 7 aa, Neisseria
YRPDPKN

SEQ ID NO: 12000 - protein, 9 aa, Neisseria
GKHRSRGVE

SEQ ID NO: 12001 - protein, 13 aa, Neisseria
KVVEDKENPDRVG

SEQ ID NO: 12002 - protein, 8 aa, Neisseria
GTGKRYGY

SEQ ID NO: 12003 - protein, 7 aa, Neisseria
SRNKEVT

SEQ ID NO: 12004 - protein, 11 aa, Neisseria
DSMPGNPRGYT

SEQ ID NO: 12005 - protein, 147 aa, Neisseria
MKWLLNMIMRPIKFSMVNTLLFIVICSSFFDLLVQLCTILFHSQKIYFITLFLLFIFNFVTKSIYMAIIYPILYFFTIKKYYPYSRKVIILLSLALSIYFSFMDFYFFSIYSDNLSYETEPLHLYIPIIINFFSLLVSNFILSFINK

SEQ ID NO: 12006 - protein, 467 aa, Neisseria
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTDLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 12007 - protein, 475 aa, Neisseria
MFFSALKSFLSRYITVWRNVWAVRDQLKPPKRTAEEQAFLPAHLELTDTPVSAAPKWAARFIMAFALLALLWSWFGKIDIVAAASGKTVSGGRSKTIQPLETAVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVIAPDDDKMDVEVLVLNKDIGFVEQGQDAVVKIESFPYTRYGYLTGKVKSVSHDAVSHEQLGLVYTAVVSLDKHTLNIDGKAVNLTAGMNVTAEIKTGKRRVLDYLLSPLQTKLDESFRER

SEQ ID NO: 12008 - protein, 7 aa, Neisseria
SAISSFC

SEQ ID NO: 12009 - protein, 6 aa, Neisseria
KIIHTY

SEQ ID NO: 12010 - protein, 7 aa, Neisseria
VIGIING

SEQ ID NO: 12011 - protein, 6 aa, Neisseria
RFLNRG

SEQ ID NO: 12012 - protein, 6 aa, Neisseria
FGLCYP

SEQ ID NO: 12013 - protein, 8 aa, Neisseria
GNFKKIAT

SEQ ID NO: 12014 - protein, 7 aa, Neisseria
QGLDRKY

SEQ ID NO: 12015 - protein, 8 aa, Neisseria
VKNKQKFL

SEQ ID NO: 12016 - protein, 7 aa, Neisseria
FLNRGMK

SEQ ID NO: 12017 - protein, 8 aa, Neisseria
LNEEGGWM

SEQ ID NO: 12018 - protein, 8 aa, Neisseria
LSRDYKHI

SEQ ID NO: 12019 - protein, 7 aa, Neisseria
NFKKIAT

SEQ ID NO: 12020 - protein, 6 aa, Neisseria
QGLDRK

SEQ ID NO: 12021 - protein, 8 aa, Neisseria
VKNKQKFL

SEQ ID NO: 12022 - protein, 5 aa, Neisseria
NEEGG

SEQ ID NO: 12023 - protein, 5 aa, Neisseria
RDYKH

SEQ ID NO: 12024 - protein, 214 aa, Neisseria
MKLKHLLPLLLSAVLSAQAYALTEGEDYLVLDKPIPQEQSGKIEVLEFFGYFCVHCHHFDPLLLKLGKALPSDAYLRTEHVVWQPEMLGLARMAAAVNLSGLKYQANPAVFKAVYEQKIRLENRSVAGKWALSQKGFDGKKLMRAYDSPEAAAAALKMQKLTEQYRIDSTPTVIVGGKYRVIFNNGFDGGVHTIKELVAKVREERKRQTPAVQK

SEQ ID NO: 12025 - protein, 10 aa, Neisseria
PQKPVSAAQT

SEQ ID NO: 12026 - protein, 13 aa, Neisseria
PVDQIVRRIHEAA

SEQ ID NO: 12027 - protein, 16 aa, Neisseria
LQELKKAGYTNVANHG

SEQ ID NO: 12028 - protein, 8 aa, Neisseria
AAPQKPVS

SEQ ID NO: 12029 - protein, 11 aa, Neisseria
VRSEQEFSEGH

SEQ ID NO: 12030 - protein, 16 aa, Neisseria
QIVRRIHEAAPDKDTP

SEQ ID NO: 12031 - protein, 20 aa, Neisseria
YCRSGRRAEAALQELKKAGY

SEQ ID NO: 12032 - protein, 14 aa, Neisseria
NHGGYEDLLKKGMK

SEQ ID NO: 12033 - protein, 7 aa, Neisseria
APQKPVS

SEQ ID NO: 12034 - protein, 9 aa, Neisseria
VRSEQEFSE

SEQ ID NO: 12035 - protein, 16 aa, Neisseria
QIVRRIHEAAPDKDTP

SEQ ID NO: 12036 - protein, 17 aa, Neisseria
RSGRRAEAALQELKKAG

SEQ ID NO: 12037 - protein, 11 aa, Neisseria
GYEDLLKKGMK

SEQ ID NO: 12038 - protein, 490 aa, Neisseria
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 12039 - protein, 186 aa, Neisseria
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENLDKR

SEQ ID NO: 12040 - protein, 705 aa, Neisseria
MDLLSVFHKYRLKYAVAVLTILLLAAVGLHASVYRTFTPENIRSRLQQSIAHTHRKISFDADIQRRLLPRPTVILKNLTITEPGGDQTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSNGIGPPEISPFHFEASTSLDGHGITISTTGSPSVRFNAGGADAAGLGLRADTSFRNLHLTAQIPALALRNNSIKIETVNGAFTAGGEYARWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEPA

SEQ ID NO: 12041 - protein, 298 aa, Neisseria
MFGAVLRIDADCLQIIVACKLFQIVAYGFAALVEGEFHEFGKMLEIVRLADAVFHRNHTDDGGIHFRRRVERFGRYVNQHFHIEKILQHHAQAAVVVAFRRGNHTLDHFFLQHKVHIDDIVRHLRQLEQKRCGNVVREVADDFLFACDAVEIKLQYIAFVNHQFIRKRQRFQTAYDVAVDFDNVQAVQLFRQRFGNRRQTRADFNHDIIRLRAHGVDNIADNPRVLQKILPETLAGFVFFHRVSFSVETPPFRAVESDSIWEGRNSFQIRMAHRAVLYVSSCVLKHKCVYSIRLMSAL

SEQ ID NO: 12042 - protein, 260 aa, Neisseria
MGLGATTFVGSGAIGGGLCSTGIGCAAGGLIATAGMTGGYTQASEGSRQLFGTYQSDFGKKVVLSLGTPIEYESPLVSDAKNLAVWGLETLITRKLGNLATGVKTSLTPKTADVQRNILSQSEVGIKWGKGIEGQGMPWEDYVGKGLSANARLPKNFKTFDYFDRGTGTAISAKTLDTQTTARLSKPEQLYSTMKGYIDKTANFKSYELSEVPLRADMIKQREIHLAIPAQTNKEQRLQLQRVVEYGKSQNITVKITEIE

SEQ ID NO: 12043 - protein, 237 aa, Neisseria
MKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 12044 - protein, 6 aa, Neisseria
EAAAEV

SEQ ID NO: 12045 - protein, 10 aa, Neisseria
GNQTCSRYSN

SEQ ID NO: 12046 - protein, 5 aa, Neisseria
KQAVT

SEQ ID NO: 12047 - protein, 11 aa, Neisseria
TQAYNEMTKSV

SEQ ID NO: 12048 - protein, 7 aa, Neisseria
FARTGKL

SEQ ID NO: 12049 - protein, 9 aa, Neisseria
GSFDLFASV

SEQ ID NO: 12050 - protein, 12 aa, Neisseria
PSEAFDLPEGST

SEQ ID NO: 12051 - protein, 11 aa, Neisseria
FLRFWQATRGI

SEQ ID NO: 12052 - protein, 25 aa, Neisseria
MARRSKTFEEAAAEVEERFGHRGIK

SEQ ID NO: 12053 - protein, 8 aa, Neisseria
EGTAKPCV

SEQ ID NO: 12054 - protein, 14 aa, Neisseria
NCPKHGNQTCSRYS

SEQ ID NO: 12055 - protein, 15 aa, Neisseria
GSSWGCPSCGNEQAA

SEQ ID NO: 12056 - protein, 7 aa, Neisseria
TLRKNHI

SEQ ID NO: 12057 - protein, 8 aa, Neisseria
MTKQERIT

SEQ ID NO: 12058 - protein, 8 aa, Neisseria
DVQGDTTI

SEQ ID NO: 12059 - protein, 16 aa, Neisseria
HTHTHNHSDADGKALS

SEQ ID NO: 12060 - protein, 12 aa, Neisseria
LTPRPLLSDRQA

SEQ ID NO: 12061 - protein, 8 aa, Neisseria
ARTGKLTG

SEQ ID NO: 12062 - protein, 6 aa, Neisseria
MPDTSM

SEQ ID NO: 12063 - protein, 7 aa, Neisseria
PVIEKGD

SEQ ID NO: 12064 - protein, 11 aa, Neisseria
PRMCPADEDIA

SEQ ID NO: 12065 - protein, 8 aa, Neisseria
ELSDKRLV

SEQ ID NO: 12066 - protein, 17 aa, Neisseria
YQTGRPSEAFDLPEGST

SEQ ID NO: 12067 - protein, 16 aa, Neisseria
LESKNGLCPPHRQEGV

SEQ ID NO: 12068 - protein, 17 aa, Neisseria
SASKTSCTRPTAARKSA

SEQ ID NO: 12069 - protein, 17 aa, Neisseria
ATRGIPKTRSWRNPNNA

SEQ ID NO: 12070 - protein, 25 aa, Neisseria
MARRSKTFEEAAAEVEERFGHRGIK

SEQ ID NO: 12071 - protein, 7 aa, Neisseria
CGNEQAA

SEQ ID NO: 12072 - protein, 7 aa, Neisseria
TLRKNHI

SEQ ID NO: 12073 - protein, 7 aa, Neisseria
TKQERIT

SEQ ID NO: 12074 - protein, 11 aa, Neisseria
NHSDADGKALS

SEQ ID NO: 12075 - protein, 7 aa, Neisseria
LLSDRQA

SEQ ID NO: 12076 - protein, 5 aa, Neisseria
RTGKL

SEQ ID NO: 12077 - protein, 6 aa, Neisseria
VIEKGD

SEQ ID NO: 12078 - protein, 11 aa, Neisseria
PRMCPADEDIA

SEQ ID NO: 12079 - protein, 8 aa, Neisseria
ELSDKRLV

SEQ ID NO: 12080 - protein, 11 aa, Neisseria
GRPSEAFDLPE

SEQ ID NO: 12081 - protein, 7 aa, Neisseria
LESKNGL

SEQ ID NO: 12082 - protein, 6 aa, Neisseria
HRQEGV

SEQ ID NO: 12083 - protein, 15 aa, Neisseria
SKTSCTRPTAARKSA

SEQ ID NO: 12084 - protein, 11 aa, Neisseria
RGIPKTRSWRN

SEQ ID NO: 12085 - protein, 7 aa, Neisseria
VVAFARF

SEQ ID NO: 12086 - protein, 16 aa, Neisseria
VGKHFRKFHRFRRRGE

SEQ ID NO: 12087 - protein, 33 aa, Neisseria
FVDFKQWAFVGLFRLARLFHIGDDFVDRFLGFF

SEQ ID NO: 12088 - protein, 25 aa, Neisseria
GEEFPEAVVEAAGDVARHFDVLDLV

SEQ ID NO: 12089 - protein, 6 aa, Neisseria
SHQNRI

SEQ ID NO: 12090 - protein, 9 aa, Neisseria
HQTLGSDAG

SEQ ID NO: 12091 - protein, 7 aa, Neisseria
VQFHHFG

SEQ ID NO: 12092 - protein, 20 aa, Neisseria
GKPSGGNGLGGLVNHLRLVA

SEQ ID NO: 12093 - protein, 10 aa, Neisseria
IEVLRRADGG

SEQ ID NO: 12094 - protein, 9 aa, Neisseria
DGADVVAQM

SEQ ID NO: 12095 - protein, 7 aa, Neisseria
LRRVGGQ

SEQ ID NO: 12096 - protein, 18 aa, Neisseria
GVDFRRQKFFGFTPRQAV

SEQ ID NO: 12097 - protein, 15 aa, Neisseria
KHFRKFHRFRRRGEG

SEQ ID NO: 12098 - protein, 7 aa, Neisseria
GDDFVDR

SEQ ID NO: 12099 - protein, 8 aa, Neisseria
FPKRNGVA

SEQ ID NO: 12100 - protein, 8 aa, Neisseria
SVQTDQEF

SEQ ID NO: 12101 - protein, 9 aa, Neisseria
FGQGEEFPE

SEQ ID NO: 12102 - protein, 7 aa, Neisseria
AAGDVAR

SEQ ID NO: 12103 - protein, 5 aa, Neisseria
VAPDG

SEQ ID NO: 12104 - protein, 16 aa, Neisseria
QNIGSHQNRITEQTHF

SEQ ID NO: 12105 - protein, 10 aa, Neisseria
LGSDAGQNPV

SEQ ID NO: 12106 - protein, 11 aa, Neisseria
ESAGKPSGGNG

SEQ ID NO: 12107 - protein, 16 aa, Neisseria
AFDDTVVIGEEEEGFG

SEQ ID NO: 12108 - protein, 13 aa, Neisseria
VLRRADGGADGAD

SEQ ID NO: 12109 - protein, 12 aa, Neisseria
AQMRDAGGGYAG

SEQ ID NO: 12110 - protein, 11 aa, Neisseria
MPSEREKDVPI

SEQ ID NO: 12111 - protein, 12 aa, Neisseria
PDLPPTSSRQQT

SEQ ID NO: 12112 - protein, 5 aa, Neisseria
LRRVG

SEQ ID NO: 12113 - protein, 7 aa, Neisseria
VDFRRQK

SEQ ID NO: 12114 - protein, 15 aa, Neisseria
KHFRKFHRFRRRGEG

SEQ ID NO: 12115 - protein, 5 aa, Neisseria
PKRNG

SEQ ID NO: 12116 - protein, 6 aa, Neisseria
QTDQEF

SEQ ID NO: 12117 - protein, 6 aa, Neisseria
QGEEFP

SEQ ID NO: 12118 - protein, 7 aa, Neisseria
AAGDVAR

SEQ ID NO: 12119 - protein, 7 aa, Neisseria
HQNRITE

SEQ ID NO: 12120 - protein, 7 aa, Neisseria
LGSDAGQ

SEQ ID NO: 12121 - protein, 7 aa, Neisseria
SAGKPSG

SEQ ID NO: 12122 - protein, 11 aa, Neisseria
VVIGEEEEGFG

SEQ ID NO: 12123 - protein, 13 aa, Neisseria
VLRRADGGADGAD

SEQ ID NO: 12124 - protein, 7 aa, Neisseria
AQMRDAG

SEQ ID NO: 12125 - protein, 11 aa, Neisseria
MPSEREKDVPI

SEQ ID NO: 12126 - protein, 8 aa, Neisseria
PPTSSRQQ

SEQ ID NO: 12127 - protein, 7 aa, Neisseria
GLFTVLG

SEQ ID NO: 12128 - protein, 10 aa, Neisseria
VSLTEIFSKS

SEQ ID NO: 12129 - protein, 8 aa, Neisseria
EAFAEIYD

SEQ ID NO: 12130 - protein, 12 aa, Neisseria
AFLAGMGGIALI

SEQ ID NO: 12131 - protein, 11 aa, Neisseria
RLVPNPHETLD

SEQ ID NO: 12132 - protein, 7 aa, Neisseria
VGMMAAF

SEQ ID NO: 12133 - protein, 14 aa, Neisseria
NFPEGLATFFATLE

SEQ ID NO: 12134 - protein, 8 aa, Neisseria
HNIPEGIS

SEQ ID NO: 12135 - protein, 13 aa, Neisseria
CLLSGLAEPLGAA

SEQ ID NO: 12136 - protein, 12 aa, Neisseria
FGSVFGVIAGVM

SEQ ID NO: 12137 - protein, 6 aa, Neisseria
YSDGHE

SEQ ID NO: 12138 - protein, 6 aa, Neisseria
MPDFSM

SEQ ID NO: 12139 - protein, 8 aa, Neisseria
SKTPNPRV

SEQ ID NO: 12140 - protein, 8 aa, Neisseria
FSKSSEAF

SEQ ID NO: 12141 - protein, 7 aa, Neisseria
IYDKDHA

SEQ ID NO: 12142 - protein, 25 aa, Neisseria
LVPNPHETLDAQDPSFQESKRRHIA

SEQ ID NO: 12143 - protein, 5 aa, Neisseria
NFPEG

SEQ ID NO: 12144 - protein, 8 aa, Neisseria
ATRSRKKT

SEQ ID NO: 12145 - protein, 8 aa, Neisseria
SGLAEPLG

SEQ ID NO: 12146 - protein, 15 aa, Neisseria
ELLPAAKRYSDGHET

SEQ ID NO: 12147 - protein, 8 aa, Neisseria
FSKSSEAF

SEQ ID NO: 12148 - protein, 7 aa, Neisseria
IYDKDHA

SEQ ID NO: 12149 - protein, 21 aa, Neisseria
PHETLDAQDPSFQESKRRHIA

SEQ ID NO: 12150 - protein, 7 aa, Neisseria
TRSRKKT

SEQ ID NO: 12151 - protein, 14 aa, Neisseria
ELLPAAKRYSDGHE

SEQ ID NO: 12152 - protein, 360 aa, Neisseria
LHFQRIIKCSEGIWAVGARPTVGFFGKSFKITCKHVVLRRRTVQAVDFTTCLFAVGHFVDVPAYVFACDAHTGGVAVKRVYGADVVQNSGGAFCQTQGRRQNTVFGIMFQIAEEPRPALRAAPYHNAVGGGLFEDGLGFLRRSNVAVDPDRDVQTAFGFGDEFVTRFAFVHLRTRASVDGKGGDAAIFGDFGDDGQVLMVVVPTQTGFEGNGYACRTDDGFQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 12153 - protein, 9 aa, Neisseria
ELIRSMQRQ

SEQ ID NO: 12154 - protein, 8 aa, Neisseria
NLSRLQKA

SEQ ID NO: 12155 - protein, 13 aa, Neisseria
EQGLENLRRLPSV

SEQ ID NO: 12156 - protein, 8 aa, Neisseria
GGKTTGKY

SEQ ID NO: 12157 - protein, 5 aa, Neisseria
SDLFY

SEQ ID NO: 12158 - protein, 7 aa, Neisseria
RYHEATE

SEQ ID NO: 12159 - protein, 10 aa, Neisseria
TRQTYKYIDD

SEQ ID NO: 12160 - protein, 11 aa, Neisseria
HKPKGFQTTNT

SEQ ID NO: 12161 - protein, 21 aa, Neisseria
LAADENDAELIRSMQRQQHID

SEQ ID NO: 12162 - protein, 25 aa, Neisseria
ANVRFEQPLEKNNYVLSEDETPCTR

SEQ ID NO: 12163 - protein, 8 aa, Neisseria
SLDDKTVR

SEQ ID NO: 12164 - protein, 12 aa, Neisseria
GSNNLSRLQKAA

SEQ ID NO: 12165 - protein, 9 aa, Neisseria
PQNMDSGIL

SEQ ID NO: 12166 - protein, 25 aa, Neisseria
RVSAGEIGDIRYEEKRDGKSAEGSI

SEQ ID NO: 12167 - protein, 9 aa, Neisseria
PLYRNKILN

SEQ ID NO: 12168 - protein, 20 aa, Neisseria
RDVEQGLENLRRLPSVKTDI

SEQ ID NO: 12169 - protein, 11 aa, Neisseria
IPSEEEGKSDL

SEQ ID NO: 12170 - protein, 9 aa, Neisseria
KWQQNKPIR

SEQ ID NO: 12171 - protein, 16 aa, Neisseria
IGIDDAGGKTTGKYQG

SEQ ID NO: 12172 - protein, 5 aa, Neisseria
DNPLG

SEQ ID NO: 12173 - protein, 26 aa, Neisseria
YGRGLAHKTDLTDATGTETESGSRSY

SEQ ID NO: 12174 - protein, 27 aa, Neisseria
FNHNGHRYHEATEGYSVNYDYNGKQYQ

SEQ ID NO: 12175 - protein, 12 aa, Neisseria
MLWRNRLHKTSV

SEQ ID NO: 12176 - protein, 27 aa, Neisseria
QTYKYIDDAEIEVQRRRSAGWEAELRH

SEQ ID NO: 12177 - protein, 38 aa, Neisseria; identical to SEQ ID NO: 9984

SEQ ID NO: 12178 - protein, 6 aa, Neisseria
QWNKTP

SEQ ID NO: 12179 - protein, 33 aa, Neisseria; identical to SEQ ID NO: 9986

SEQ ID NO: 12180 - protein, 11 aa, Neisseria
ADYGRVSGESA

SEQ ID NO: 12181 - protein, 5 aa, Neisseria
VSGKQ

SEQ ID NO: 12182 - protein, 8 aa, Neisseria
FRGGHKVG

SEQ ID NO: 12183 - protein, 10 aa, Neisseria
KPLHKPKGFQ

SEQ ID NO: 12184 - protein, 21 aa, Neisseria
LAADENDAELIRSMQRQQHID

SEQ ID NO: 12185 - protein, 13 aa, Neisseria
ANVRFEQPLEKNN

SEQ ID NO: 12186 - protein, 8 aa, Neisseria
LSEDETPC

SEQ ID NO: 12187 - protein, 8 aa, Neisseria
SLDDKTVR

SEQ ID NO: 12188 - protein, 9 aa, Neisseria
NLSRLQKAA

SEQ ID NO: 12189 - protein, 19 aa, Neisseria
EIGDIRYEEKRDGKSAEGS

SEQ ID NO: 12190 - protein, 20 aa, Neisseria
RDVEQGLENLRRLPSVKTDI

SEQ ID NO: 12191 - protein, 10 aa, Neisseria
PSEEEGKSDL

SEQ ID NO: 12192 - protein, 14 aa, Neisseria
IGIDDAGGKTTGKY

SEQ ID NO: 12193 - protein, 9 aa, Neisseria
LAHKTDLTD

SEQ ID NO: 12194 - protein, 11 aa, Neisseria
TGTETESGSRS

SEQ ID NO: 12195 - protein, 7 aa, Neisseria
RYHEATE

SEQ ID NO: 12196 - protein, 17 aa, Neisseria
YIDDAEIEVQRRRSAGW

SEQ ID NO: 12197 - protein, 5 aa, Neisseria
AELRH

SEQ ID NO: 12198 - protein, 23 aa, Neisseria
GKLSYKRGTGMRQSMPAPEENGG

SEQ ID NO: 12199 - protein, 5 aa, Neisseria
SRMKI

SEQ ID NO: 12200 - protein, 7 aa, Neisseria
AQDKLSI

SEQ ID NO: 12201 - protein, 6 aa, Neisseria
GFDGEQ

SEQ ID NO: 12202 - protein, 9 aa, Neisseria
DYGRVSGES

SEQ ID NO: 12203 - protein, 7 aa, Neisseria
PLHKPKG

SEQ ID NO: 12204 - protein, 17 aa, Neisseria
DFFNPFQICFGVFGQCA

SEQ ID NO: 12205 - protein, 12 aa, Neisseria
FVNRLAGFHRIG

SEQ ID NO: 12206 - protein, 9 aa, Neisseria
FNAVHYIEF

SEQ ID NO: 12207 - protein, 10 aa, Neisseria
EFVSAFCQTY

SEQ ID NO: 12208 - protein, 21 aa, Neisseria
AQNIIQHLRTYARACRSCARQ

SEQ ID NO: 12209 - protein, 7 aa, Neisseria
ISAVVDV

SEQ ID NO: 12210 - protein, 6 aa, Neisseria
RTLRAF

SEQ ID NO: 12211 - protein, 6 aa, Neisseria
GIVQML

SEQ ID NO: 12212 - protein, 16 aa, Neisseria
QFFTQFFRMQQIGGAN

SEQ ID NO: 12213 - protein, 8 aa, Neisseria
RCFAGLVE

SEQ ID NO: 12214 - protein, 9 aa, Neisseria
TAFDVFHAC

SEQ ID NO: 12215 - protein, 8 aa, Neisseria
VQTFMQDA

SEQ ID NO: 12216 - protein, 6 aa, Neisseria
RIVAAL

SEQ ID NO: 12217 - protein, 8 aa, Neisseria
GFFRQPVN

SEQ ID NO: 12218 - protein, 12 aa, Neisseria
PLCADYYNIFSH

SEQ ID NO: 12219 - protein, 13 aa, Neisseria
GAGGDDGDRRAAD

SEQ ID NO: 12220 - protein, 7 aa, Neisseria
GTARQDV

SEQ ID NO: 12221 - protein, 5 aa, Neisseria
ADIDG

SEQ ID NO: 12222 - protein, 7 aa, Neisseria
SNTHTGN

SEQ ID NO: 12223 - protein, 5 aa, Neisseria
VDLDG

SEQ ID NO: 12224 - protein, 5 aa, Neisseria
GGGIK

SEQ ID NO: 12225 - protein, 7 aa, Neisseria
SGYRTEF

SEQ ID NO: 12226 - protein, 19 aa, Neisseria
FGRERARTDARGIGFDDAQ

SEQ ID NO: 12227 - protein, 21 aa, Neisseria
TYARACRSCARQTVGRGNEGI

SEQ ID NO: 12228 - protein, 10 aa, Neisseria
VQQRTLRAFK

SEQ ID NO: 12229 - protein, 19 aa, Neisseria
HVGNHRRNARRDFFDNRHH

SEQ ID NO: 12230 - protein, 6 aa, Neisseria
IGKDGI

SEQ ID NO: 12231 - protein, 5 aa, Neisseria
GGANG

SEQ ID NO: 12232 - protein, 9 aa, Neisseria
RADAAAGRA

SEQ ID NO: 12233 - protein, 19 aa, Neisseria
VERDVVRQDQRAGRRDFQT

SEQ ID NO: 12234 - protein, 14 aa, Neisseria
GFGGDDNARTDEAV

SEQ ID NO: 12235 - protein, 10 aa, Neisseria
DAARNQAQNG

SEQ ID NO: 12236 - protein, 5 aa, Neisseria
DNQGM

SEQ ID NO: 12237 - protein, 5 aa, Neisseria
PVNDF

SEQ ID NO: 12238 - protein, 12 aa, Neisseria
AGGDDGDRRAAD

SEQ ID NO: 12239 - protein, 7 aa, Neisseria
GTARQDV

SEQ ID NO: 12240 - protein, 5 aa, Neisseria
ADIDG

SEQ ID NO: 12241 - protein, 19 aa, Neisseria
FGRERARTDARGIGFDDAQ

SEQ ID NO: 12242 - protein, 11 aa, Neisseria
TYARACRSCAR

SEQ ID NO: 12243 - protein, 8 aa, Neisseria
TVGRGNEG

SEQ ID NO: 12244 - protein, 10 aa, Neisseria
VQQRTLRAFK

SEQ ID NO: 12245 - protein, 17 aa, Neisseria
GNHRRNARRDFFDNRHH

SEQ ID NO: 12246 - protein, 5 aa, Neisseria
IGKDG

SEQ ID NO: 12247 - protein, 9 aa, Neisseria
RADAAAGRA

SEQ ID NO: 12248 - protein, 19 aa, Neisseria
VERDVVRQDQRAGRRDFQT

SEQ ID NO: 12249 - protein, 13 aa, Neisseria
FGGDDNARTDEAV

SEQ ID NO: 12250 - protein, 7 aa, Neisseria
DAARNQA

SEQ ID NO: 12251 - protein, 9 aa, Neisseria
DDVASVMRS

SEQ ID NO: 12252 - protein, 11 aa, Neisseria
KEGERWLSAMS

SEQ ID NO: 12253 - protein, 6 aa, Neisseria
RLARFV

SEQ ID NO: 12254 - protein, 5 aa, Neisseria
GARGL

SEQ ID NO: 12255 - protein, 8 aa, Neisseria
NYIGKPAH

SEQ ID NO: 12256 - protein, 11 aa, Neisseria
LRHYRNLEKGN

SEQ ID NO: 12257 - protein, 9 aa, Neisseria
VRALARFNG

SEQ ID NO: 12258 - protein, 9 aa, Neisseria
MRKPTDTLP

SEQ ID NO: 12259 - protein, 7 aa, Neisseria
LQRRRLL

SEQ ID NO: 12260 - protein, 14 aa, Neisseria
GAQREETLADDVAS

SEQ ID NO: 12261 - protein, 21 aa, Neisseria
SVGSVNPPRLVFDNPKEGERW

SEQ ID NO: 12262 - protein, 10 aa, Neisseria
VPEEEERRRL

SEQ ID NO: 12263 - protein, 9 aa, Neisseria
QYESSRAGL

SEQ ID NO: 12264 - protein, 6 aa, Neisseria
EVESAF

SEQ ID NO: 12265 - protein, 9 aa, Neisseria
NYIGKPAHN

SEQ ID NO: 12266 - protein, 7 aa, Neisseria
RTNLRYG

SEQ ID NO: 12267 - protein, 9 aa, Neisseria
YRNLEKGNI

SEQ ID NO: 12268 - protein, 12 aa, Neisseria
NGSLGSNKYPNA

SEQ ID NO: 12269 - protein, 7 aa, Neisseria
WRNRWQW

SEQ ID NO: 12270 - protein, 6 aa, Neisseria
MRKPTD

SEQ ID NO: 12271 - protein, 7 aa, Neisseria
LQRRRLL

SEQ ID NO: 12272 - protein, 14 aa, Neisseria
GAQREETLADDVAS

SEQ ID NO: 12273 - protein, 12 aa, Neisseria
LVFDNPKEGERW

SEQ ID NO: 12274 - protein, 10 aa, Neisseria
VPEEEERRRL

SEQ ID NO: 12275 - protein, 7 aa, Neisseria
ESSRAGL

SEQ ID NO: 12276 - protein, 6 aa, Neisseria
EVESAF

SEQ ID NO: 12277 - protein, 8 aa, Neisseria
RNLEKGNI

SEQ ID NO: 12278 - protein, 5 aa, Neisseria
YKQNK

SEQ ID NO: 12279 - protein, 5 aa, Neisseria
TAAEL

SEQ ID NO: 12280 - protein, 19 aa, Neisseria
TDCYRSYDVLDVREFSHFS

SEQ ID NO: 12281 - protein, 14 aa, Neisseria
MRKSRLSRYKQNKL

SEQ ID NO: 12282 - protein, 5 aa, Neisseria
QNSPH

SEQ ID NO: 12283 - protein, 26 aa, Neisseria
FDGEVEADESYFGGQRKGKRGRGAAG

SEQ ID NO: 12284 - protein, 8 aa, Neisseria
LLKRNGKV

SEQ ID NO: 12285 - protein, 11 aa, Neisseria
IREQVKPDSIV

SEQ ID NO: 12286 - protein, 8 aa, Neisseria
TDCYRSYD

SEQ ID NO: 12287 - protein, 5 aa, Neisseria
LDVRE

SEQ ID NO: 12288 - protein, 6 aa, Neisseria
RTTKPY

SEQ ID NO: 12289 - protein, 14 aa, Neisseria
MRKSRLSRYKQNKL

SEQ ID NO: 12290 - protein, 11 aa, Neisseria
FDGEVEADESY

SEQ ID NO: 12291 - protein, 13 aa, Neisseria
GQRKGKRGRGAAG

SEQ ID NO: 12292 - protein, 6 aa, Neisseria
LKRNGK

SEQ ID NO: 12293 - protein, 9 aa, Neisseria
IREQVKPDS

SEQ ID NO: 12294 - protein, 5 aa, Neisseria
LDVRE

SEQ ID NO: 12295 - protein, 6 aa, Neisseria
GNNADE

SEQ ID NO: 12296 - protein, 18 aa, Neisseria
TYQDGNGKTAVRQKYPAG

SEQ ID NO: 12297 - protein, 20 aa, Neisseria
QDGSYSKNMNYNQYRPERHA

SEQ ID NO: 12298 - protein, 23 aa, Neisseria
NQTGNNADEEHRQHWQKPKFQNR

SEQ ID NO: 12299 - protein, 14 aa, Neisseria
YQDGNGKTAVRQKY

SEQ ID NO: 12300 - protein, 7 aa, Neisseria
YRPERHA

SEQ ID NO: 12301 - protein, 12 aa, Neisseria
NNADEEHRQHWQ

SEQ ID NO: 12302 - protein, 6 aa, Neisseria
PKFQNR

SEQ ID NO: 12303 - protein, 6 aa, Neisseria
VSLSAA

SEQ ID NO: 12304 - protein, 6 aa, Neisseria
SAERQI

SEQ ID NO: 12305 - protein, 7 aa, Neisseria
KAVKMLE

SEQ ID NO: 12306 - protein, 6 aa, Neisseria
DHWGKP

SEQ ID NO: 12307 - protein, 6 aa, Neisseria
AYKDGR

SEQ ID NO: 12308 - protein, 32 aa, Neisseria
AGDSAERQIYGDPHFEQNRTKAVKMLEQRGYQ

SEQ ID NO: 12309 - protein, 14 aa, Neisseria
DVDADDHWGKPVLE

SEQ ID NO: 12310 - protein, 10 aa, Neisseria
EAYKDGREYD

SEQ ID NO: 12311 - protein, 12 aa, Neisseria
PDLKIIKEQLDR

SEQ ID NO: 12312 - protein, 8 aa, Neisseria
DSAERQIY

SEQ ID NO: 12313 - protein, 18 aa, Neisseria
PHFEQNRTKAVKMLEQRG

SEQ ID NO: 12314 - protein, 9 aa, Neisseria
DVDADDHWG

SEQ ID NO: 12315 - protein, 10 aa, Neisseria
EAYKDGREYD

SEQ ID NO: 12316 - protein, 9 aa, Neisseria
KIIKEQLDR

SEQ ID NO: 12317 - protein, 8 aa, Neisseria
LEFWVGLF

SEQ ID NO: 12318 - protein, 9 aa, Neisseria
VYADFGDIG

SEQ ID NO: 12319 - protein, 5 aa, Neisseria
VSAQI

SEQ ID NO: 12320 - protein, 7 aa, Neisseria
GDTENLA

SEQ ID NO: 12321 - protein, 10 aa, Neisseria
NLIGKFMTSF

SEQ ID NO: 12322 - protein, 5 aa, Neisseria
MKKNI

SEQ ID NO: 12323 - protein, 7 aa, Neisseria
GGSDKTY

SEQ ID NO: 12324 - protein, 13 aa, Neisseria
GDIGGLKVNAPVK

SEQ ID NO: 12325 - protein, 24 aa, Neisseria
LDPKSYQARVRLDLDGKYQFSSDV

SEQ ID NO: 12326 - protein, 6 aa, Neisseria
TSGLLG

SEQ ID NO: 12327 - protein, 8 aa, Neisseria
QQGGDTEN

SEQ ID NO: 12328 - protein, 16 aa, Neisseria
FAEKNADGGNAEKAAE

SEQ ID NO: 12329 - protein, 5 aa, Neisseria
MKKNI

SEQ ID NO: 12330 - protein, 5 aa, Neisseria
GSDKT

SEQ ID NO: 12331 - protein, 16 aa, Neisseria
LDPKSYQARVRLDLDG

SEQ ID NO: 12332 - protein, 7 aa, Neisseria
QGGDTEN

SEQ ID NO: 12333 - protein, 16 aa, Neisseria
FAEKNADGGNAEKAAE

SEQ ID NO: 12334 - protein, 8 aa, Neisseria
PADAVSQI

SEQ ID NO: 12335 - protein, 23 aa, Neisseria
FDFQRMTALAVGNPWRTASDAQK

SEQ ID NO: 12336 - protein, 6 aa, Neisseria
KEFQTL

SEQ ID NO: 12337 - protein, 12 aa, Neisseria
YRNQFGEIIKAK

SEQ ID NO: 12338 - protein, 5 aa, Neisseria
MKKSS

SEQ ID NO: 12339 - protein, 9 aa, Neisseria
SQIRQNATQ

SEQ ID NO: 12340 - protein, 15 aa, Neisseria
LKNGDANTARQKAEA

SEQ ID NO: 12341 - protein, 18 aa, Neisseria
NPWRTASDAQKQALAKEF

SEQ ID NO: 12342 - protein, 25 aa, Neisseria
LKLKNANVNVKDNPIVNKGGKEIIV

SEQ ID NO: 12343 - protein, 12 aa, Neisseria
AEVGVPGQKPVN

SEQ ID NO: 12344 - protein, 10 aa, Neisseria
TYQSGGKYRT

SEQ ID NO: 12345 - protein, 5 aa, Neisseria
YRNQF

SEQ ID NO: 12346 - protein, 11 aa, Neisseria
IKAKGVDGLIA

SEQ ID NO: 12347 - protein, 8 aa, Neisseria
LKAKNGGK

SEQ ID NO: 12348 - protein, 5 aa, Neisseria
MKKSS

SEQ ID NO: 12349 - protein, 5 aa, Neisseria
IRQNA

SEQ ID NO: 12350 - protein, 14 aa, Neisseria
KNGDANTARQKAEA

SEQ ID NO: 12351 - protein, 14 aa, Neisseria
TASDAQKQALAKEF

SEQ ID NO: 12352 - protein, 5 aa, Neisseria
LKLKN

SEQ ID NO: 12353 - protein, 10 aa, Neisseria
NVNVKDNPIV

SEQ ID NO: 12354 - protein, 8 aa, Neisseria
KGGKEIIV

SEQ ID NO: 12355 - protein, 8 aa, Neisseria
VPGQKPVN

SEQ ID NO: 12356 - protein, 7 aa, Neisseria
IKAKGVD

SEQ ID NO: 12357 - protein, 8 aa, Neisseria
LKAKNGGK

SEQ ID NO: 12358 - protein, 13 aa, Neisseria
ETRPADPYEGYNR

SEQ ID NO: 12359 - protein, 9 aa, Neisseria
RGYRKVAPK

SEQ ID NO: 12360 - protein, 14 aa, Neisseria
GVSNFFNNLCDVVS

SEQ ID NO: 12361 - protein, 10 aa, Neisseria
LGGLIDIAGA

SEQ ID NO: 12362 - protein, 14 aa, Neisseria
VRDALGTGITSVYS

SEQ ID NO: 12363 - protein, 10 aa, Neisseria
DLTDSLDEAA

SEQ ID NO: 12364 - protein, 5 aa, Neisseria
LVESA

SEQ ID NO: 12365 - protein, 5 aa, Neisseria
SETQA

SEQ ID NO: 12366 - protein, 13 aa, Neisseria
AETRPADPYEGYN

SEQ ID NO: 12367 - protein, 8 aa, Neisseria
FNDQADRY

SEQ ID NO: 12368 - protein, 15 aa, Neisseria
AARGYRKVAPKPVRA

SEQ ID NO: 12369 - protein, 5 aa, Neisseria
GSNIL

SEQ ID NO: 12370 - protein, 11 aa, Neisseria
LDIKRASEDLV

SEQ ID NO: 12371 - protein, 12 aa, Neisseria
GGIPDNKNTLGD

SEQ ID NO: 12372 - protein, 8 aa, Neisseria
SWGWKNSN

SEQ ID NO: 12373 - protein, 7 aa, Neisseria
STVRDAL

SEQ ID NO: 12374 - protein, 6 aa, Neisseria
YSPKNI

SEQ ID NO: 12375 - protein, 7 aa, Neisseria
TPVGRWG

SEQ ID NO: 12376 - protein, 30 aa, Neisseria
VSTREGLLDLTDSLDEAAIDKYSYTRDLYM

SEQ ID NO: 12377 - protein, 32 aa, Neisseria
VRARQTGATPAEGTEDNIDIDELVESAETGAA

SEQ ID NO: 12378 - protein, 26 aa, Neisseria
AVQEDSVSETQAEAAGEAETQPGTQP

SEQ ID NO: 12379 - protein, 13 aa, Neisseria
AETRPADPYEGYN

SEQ ID NO: 12380 - protein, 5 aa, Neisseria
NDQAD

SEQ ID NO: 12381 - protein, 12 aa, Neisseria
RGYRKVAPKPVR

SEQ ID NO: 12382 - protein, 11 aa, Neisseria
LDIKRASEDLV

SEQ ID NO: 12383 - protein, 9 aa, Neisseria
GIPDNKNTL

SEQ ID NO: 12384 - protein, 6 aa, Neisseria
TVRDAL

SEQ ID NO: 12385 - protein, 19 aa, Neisseria
STREGLLDLTDSLDEAAID

SEQ ID NO: 12386 - protein, 7 aa, Neisseria
VRARQTG

SEQ ID NO: 12387 - protein, 24 aa, Neisseria
TPAEGTEDNIDIDELVESAETGAA

SEQ ID NO: 12388 - protein, 22 aa, Neisseria
AVQEDSVSETQAEAAGEAETQP

SEQ ID NO: 12389 - protein, 10 aa, Neisseria
LGILTACAAM

SEQ ID NO: 12390 - protein, 9 aa, Neisseria
AFADRIGDL

SEQ ID NO: 12391 - protein, 6 aa, Neisseria
FQKTFE

SEQ ID NO: 12392 - protein, 7 aa, Neisseria
QKVRQAC

SEQ ID NO: 12393 - protein, 30 aa, Neisseria
FADRIGDLEARLAQLEHRVAVLESGGNTVK

SEQ ID NO: 12394 - protein, 6 aa, Neisseria
LFGSNS

SEQ ID NO: 12395 - protein, 30 aa, Neisseria
PFQKTFEASDRNEGVARQKVRQACNRETSA

SEQ ID NO: 12396 - protein, 13 aa, Neisseria
FCEDEAIRCRKFD

SEQ ID NO: 12397 - protein, 21 aa, Neisseria
FADRIGDLEARLAQLEHRVAV

SEQ ID NO: 12398 - protein, 26 aa, Neisseria
KTFEASDRNEGVARQKVRQACNRETS

SEQ ID NO: 12399 - protein, 13 aa, Neisseria
FCEDEAIRCRKFD

SEQ ID NO: 12400 - protein, 12 aa, Neisseria
VAVSALSACRQA

SEQ ID NO: 12401 - protein, 6 aa, Neisseria
ISDRSV

SEQ ID NO: 12402 - protein, 34 aa, Neisseria; identical to SEQ ID NO: 8203

SEQ ID NO: 12403 - protein, 5 aa, Neisseria
QAEKF

SEQ ID NO: 12404 - protein, 24 aa, Neisseria
SACRQAEEGPPPLPRQISDRSVGH

SEQ ID NO: 12405 - protein, 10 aa, Neisseria
NLTEHNGPKA

SEQ ID NO: 12406 - protein, 8 aa, Neisseria
NGKPDQPV

SEQ ID NO: 12407 - protein, 11 aa, Neisseria
YTKLPEEPKGI

SEQ ID NO: 12408 - protein, 17 aa, Neisseria
TDWTNPNADTEWMDAKK

SEQ ID NO: 12409 - protein, 37 aa, Neisseria; identical to SEQ ID NO: 8210

SEQ ID NO: 12410 - protein, 10 aa, Neisseria
RQAEEGPPPL

SEQ ID NO: 12411 - protein, 7 aa, Neisseria
QISDRSV

SEQ ID NO: 12412 - protein, 6 aa, Neisseria
EHNGPK

SEQ ID NO: 12413 - protein, 5 aa, Neisseria
GKPDQ

SEQ ID NO: 12414 - protein, 9 aa, Neisseria
KLPEEPKGI

SEQ ID NO: 12415 - protein, 11 aa, Neisseria
NADTEWMDAKK

SEQ ID NO: 12416 - protein, 6 aa, Neisseria
GAEDAL

SEQ ID NO: 12417 - protein, 16 aa, Neisseria
GNKEQAEKFAKDKGGK

SEQ ID NO: 12418 - protein, 5 aa, Neisseria
DDMPD

SEQ ID NO: 12419 - protein, 10 aa, Neisseria
PLAVLTALLL

SEQ ID NO: 12420 - protein, 20 aa, Neisseria
QNVLKIYNWSEYVDPETVAD

SEQ ID NO: 12421 - protein, 13 aa, Neisseria
IKAGAYQKIDKSL

SEQ ID NO: 12422 - protein, 8 aa, Neisseria
RLMDGVDP

SEQ ID NO: 12423 - protein, 6 aa, Neisseria
RVKKAL

SEQ ID NO: 12424 - protein, 5 aa, Neisseria
DSAAE

SEQ ID NO: 12425 - protein, 12 aa, Neisseria
NSSNTEDIREAT

SEQ ID NO: 12426 - protein, 16 aa, Neisseria
AKNVANAHKYINDFLD

SEQ ID NO: 12427 - protein, 9 aa, Neisseria
KPARELMED

SEQ ID NO: 12428 - protein, 20 aa, Neisseria
CGGSDKPPAEKPAPAENQNV

SEQ ID NO: 12429 - protein, 21 aa, Neisseria
SEYVDPETVADFEKKNGIKVT

SEQ ID NO: 12430 - protein, 19 aa, Neisseria
YDSDETLESKVLTGKSGYD

SEQ ID NO: 12431 - protein, 34 aa, Neisseria
GAYQKIDKSLIPNYKHLNPEMMRLMDGVDPGHEY

SEQ ID NO: 12432 - protein, 18 aa, Neisseria
NTERVKKALGTDKLPDNQ

SEQ ID NO: 12433 - protein, 13 aa, Neisseria
FDPEYTSKLKQCG

SEQ ID NO: 12434 - protein, 36 aa, Neisseria
LGKNPNSSNTEDIREATALLKKNRPNIKRFTSSGFI

SEQ ID NO: 12435 - protein, 7 aa, Neisseria
DLARGDT

SEQ ID NO: 12436 - protein, 26 aa, Neisseria
NIAKRRAEEAGGKEKIRVMMPKEGVG

SEQ ID NO: 12437 - protein, 11 aa, Neisseria
VIPKDAKNVAN

SEQ ID NO: 12438 - protein, 12 aa, Neisseria
FLDPEVSAKNGN

SEQ ID NO: 12439 - protein, 31 aa, Neisseria
YAPSSKPARELMEDEFKNDNTIFPTEEDLKN

SEQ ID NO: 12440 - protein, 9 aa, Neisseria
QWQDVKAGK

SEQ ID NO: 12441 - protein, 16 aa, Neisseria
GGSDKPPAEKPAPAEN

SEQ ID NO: 12442 - protein, 15 aa, Neisseria
VDPETVADFEKKNGI

SEQ ID NO: 12443 - protein, 13 aa, Neisseria
YDSDETLESKVLT

SEQ ID NO: 12444 - protein, 7 aa, Neisseria
QKIDKSL

SEQ ID NO: 12445 - protein, 13 aa, Neisseria
EMMRLMDGVDPGH

SEQ ID NO: 12446 - protein, 18 aa, Neisseria
NTERVKKALGTDKLPDNQ

SEQ ID NO: 12447 - protein, 8 aa, Neisseria
EYTSKLKQ

SEQ ID NO: 12448 - protein, 28 aa, Neisseria
NPNSSNTEDIREATALLKKNRPNIKRFT

SEQ ID NO: 12449 - protein, 7 aa, Neisseria
DLARGDT

SEQ ID NO: 12450 - protein, 24 aa, Neisseria
NIAKRRAEEAGGKEKIRVMMPKEG

SEQ ID NO: 12451 - protein, 8 aa, Neisseria
KDAKNVAN

SEQ ID NO: 12452 - protein, 10 aa, Neisseria
FLDPEVSAKN

SEQ ID NO: 12453 - protein, 18 aa, Neisseria
PSSKPARELMEDEFKNDN

SEQ ID NO: 12454 - protein, 8 aa, Neisseria
PTEEDLKN

SEQ ID NO: 12455 - protein, 7 aa, Neisseria
QDVKAGK

SEQ ID NO: 12456 - protein, 7 aa, Neisseria
GIAAAIL

SEQ ID NO: 12457 - protein, 8 aa, Neisseria
KSIQTFPQ

SEQ ID NO: 12458 - protein, 12 aa, Neisseria
INGPDRPVGIPD

SEQ ID NO: 12459 - protein, 7 aa, Neisseria
DFAKSLQ

SEQ ID NO: 12460 - protein, 12 aa, Neisseria
QDVCAQAFQTPV

SEQ ID NO: 12461 - protein, 5 aa, Neisseria
ERYFT

SEQ ID NO: 12462 - protein, 10 aa, Neisseria
LAGTVTGYYE

SEQ ID NO: 12463 - protein, 10 aa, Neisseria
GIPDDFISVP

SEQ ID NO: 12464 - protein, 11 aa, Neisseria
RSGKALVRIRQ

SEQ ID NO: 12465 - protein, 10 aa, Neisseria
SGTIDNTGGT

SEQ ID NO: 12466 - protein, 19 aa, Neisseria
MQGIKSYMRQNPQRLAEVL

SEQ ID NO: 12467 - protein, 14 aa, Neisseria
ALGTPLMGEYAGAV

SEQ ID NO: 12468 - protein, 6 aa, Neisseria
RKALNR

SEQ ID NO: 12469 - protein, 8 aa, Neisseria
CQSKSIQT

SEQ ID NO: 12470 - protein, 5 aa, Neisseria
PQPDT

SEQ ID NO: 12471 - protein, 17 aa, Neisseria
VINGPDRPVGIPDPAGT

SEQ ID NO: 12472 - protein, 5 aa, Neisseria
VGGGG

SEQ ID NO: 12473 - protein, 7 aa, Neisseria
DFAKSLQ

SEQ ID NO: 12474 - protein, 12 aa, Neisseria
GCANLKNRQGWQ

SEQ ID NO: 12475 - protein, 5 aa, Neisseria
YFTPW

SEQ ID NO: 12476 - protein, 12 aa, Neisseria
PVLKGDDRRTAQ

SEQ ID NO: 12477 - protein, 6 aa, Neisseria
IPDDFI

SEQ ID NO: 12478 - protein, 29 aa, Neisseria
AGLRSGKALVRIRQTGKNSGTIDNTGGTH

SEQ ID NO: 12479 - protein, 31 aa, Neisseria
TAIKGRFEGSRFLPYHTRNQINGGALDGKAP

SEQ ID NO: 12480 - protein, 6 aa, Neisseria
AEDPVE

SEQ ID NO: 12481 - protein, 15 aa, Neisseria
QGSGRLKTPSGKYIR

SEQ ID NO: 12482 - protein, 9 aa, Neisseria
GYADKNEHP

SEQ ID NO: 12483 - protein, 12 aa, Neisseria
YMADKGYLKLGQ

SEQ ID NO: 12484 - protein, 16 aa, Neisseria
QGIKSYMRQNPQRLAE

SEQ ID NO: 12485 - protein, 5 aa, Neisseria
GQNPS

SEQ ID NO: 12486 - protein, 10 aa, Neisseria
LAGSSNDGPV

SEQ ID NO: 12487 - protein, 7 aa, Neisseria
GAVDRHY

SEQ ID NO: 12488 - protein, 8 aa, Neisseria
PVTRKALN

SEQ ID NO: 12489 - protein, 11 aa, Neisseria
DTGSAIKGAVR

SEQ ID NO: 12490 - protein, 16 aa, Neisseria
GYGDEAGELAGKQKTT

SEQ ID NO: 12491 - protein, 11 aa, Neisseria
LPNGMKPEYRP

SEQ ID NO: 12492 - protein, 8 aa, Neisseria
NGPDRPVG

SEQ ID NO: 12493 - protein, 8 aa, Neisseria
NLKNRQGW

SEQ ID NO: 12494 - protein, 11 aa, Neisseria
VLKGDDRRTAQ

SEQ ID NO: 12495 - protein, 24 aa, Neisseria
LRSGKALVRIRQTGKNSGTIDNTG

SEQ ID NO: 12496 - protein, 9 aa, Neisseria
TAIKGRFEG

SEQ ID NO: 12497 - protein, 6 aa, Neisseria
ALDGKA

SEQ ID NO: 12498 - protein, 5 aa, Neisseria
AEDPV

SEQ ID NO: 12499 - protein, 7 aa, Neisseria
GRLKTPS

SEQ ID NO: 12500 - protein, 7 aa, Neisseria
YADKNEH

SEQ ID NO: 12501 - protein, 7 aa, Neisseria
NPQRLAE

SEQ ID NO: 12502 - protein, 9 aa, Neisseria
LAGSSNDGP

SEQ ID NO: 12503 - protein, 7 aa, Neisseria
VTRKALN

SEQ ID NO: 12504 - protein, 6 aa, Neisseria
DTGSAI

SEQ ID NO: 12505 - protein, 12 aa, Neisseria
DEAGELAGKQKT

SEQ ID NO: 12506 - protein, 8 aa, Neisseria
GMKPEYRP

SEQ ID NO: 12507 - protein, 10 aa, Neisseria
GEFPELEPIA

SEQ ID NO: 12508 - protein, 7 aa, Neisseria
GIKEMPD

SEQ ID NO: 12509 - protein, 6 aa, Neisseria
KNIVNV

SEQ ID NO: 12510 - protein, 6 aa, Neisseria
LDNPAN

SEQ ID NO: 12511 - protein, 16 aa, Neisseria
TVTATFDGFDTSDRSK

SEQ ID NO: 12512 - protein, 7 aa, Neisseria
QAFSDST

SEQ ID NO: 12513 - protein, 8 aa, Neisseria
LGYGEFPE

SEQ ID NO: 12514 - protein, 8 aa, Neisseria
EPIAKDRL

SEQ ID NO: 12515 - protein, 10 aa, Neisseria
VTEKGKENMI

SEQ ID NO: 12516 - protein, 19 aa, Neisseria
RGTYNYQYRSNRPVKDGSY

SEQ ID NO: 12517 - protein, 10 aa, Neisseria
TFWSKNKAGW

SEQ ID NO: 12518 - protein, 32 aa, Neisseria
AGIKEMPDASYCEQTRMFGKNIVNVGHESADT

SEQ ID NO: 12519 - protein, 8 aa, Neisseria
KPVGQNLE

SEQ ID NO: 12520 - protein, 6 aa, Neisseria
PLDNPA

SEQ ID NO: 12521 - protein, 5 aa, Neisseria
ERFKV

SEQ ID NO: 12522 - protein, 9 aa, Neisseria
FRGEPLPNA

SEQ ID NO: 12523 - protein, 18 aa, Neisseria
TFDGFDTSDRSKTHKTEA

SEQ ID NO: 12524 - protein, 13 aa, Neisseria
AFSDSTDDKGEVD

SEQ ID NO: 12525 - protein, 21 aa, Neisseria
NVEHKTDFPDQSVCQKQANYS

SEQ ID NO: 12526 - protein, 8 aa, Neisseria
EPIAKDRL

SEQ ID NO: 12527 - protein, 10 aa, Neisseria
VTEKGKENMI

SEQ ID NO: 12528 - protein, 10 aa, Neisseria
RSNRPVKDGS

SEQ ID NO: 12529 - protein, 7 aa, Neisseria
SKNKAGW

SEQ ID NO: 12530 - protein, 8 aa, Neisseria
AGIKEMPD

SEQ ID NO: 12531 - protein, 7 aa, Neisseria
EQTRMFG

SEQ ID NO: 12532 - protein, 5 aa, Neisseria
HESAD

SEQ ID NO: 12533 - protein, 5 aa, Neisseria
ERFKV

SEQ ID NO: 12534 - protein, 16 aa, Neisseria
DGFDTSDRSKTHKTEA

SEQ ID NO: 12535 - protein, 13 aa, Neisseria
AFSDSTDDKGEVD

SEQ ID NO: 12536 - protein, 10 aa, Neisseria
NVEHKTDFPD

SEQ ID NO: 12537 - protein, 5 aa, Neisseria
SVCQK

SEQ ID NO: 12538 - protein, 20 aa, Neisseria
AVLSGCQSIYVPTLTEIPVN

SEQ ID NO: 12539 - protein, 6 aa, Neisseria
INTVKT

SEQ ID NO: 12540 - protein, 11 aa, Neisseria
HWTDVAKISDE

SEQ ID NO: 12541 - protein, 17 aa, Neisseria
GKMTKVQAAQYLNNFRK

SEQ ID NO: 12542 - protein, 9 aa, Neisseria
DSMYEIYLR

SEQ ID NO: 12543 - protein, 10 aa, Neisseria
QNALRGWQQR

SEQ ID NO: 12544 - protein, 11 aa, Neisseria
VKTEAPAKGFR

SEQ ID NO: 12545 - protein, 9 aa, Neisseria
AKISDEATR

SEQ ID NO: 12546 - protein, 5 aa, Neisseria
GKMTK

SEQ ID NO: 12547 - protein, 17 aa, Neisseria
NNFRKRLVGRNAVDDSM

SEQ ID NO: 12548 - protein, 15 aa, Neisseria
AIDSQRGAINTEQSK

SEQ ID NO: 12549 - protein, 20 aa, Neisseria
ALRGWQQRWKNMDVKPNNPA

SEQ ID NO: 12550 - protein, 11 aa, Neisseria
VKTEAPAKGFR

SEQ ID NO: 12551 - protein, 9 aa, Neisseria
AKISDEATR

SEQ ID NO: 12552 - protein, 7 aa, Neisseria
FRKRLVG

SEQ ID NO: 12553 - protein, 7 aa, Neisseria
NAVDDSM

SEQ ID NO: 12554 - protein, 15 aa, Neisseria
AIDSQRGAINTEQSK

SEQ ID NO: 12555 - protein, 10 aa, Neisseria
WKNMDVKPNN

SEQ ID NO: 12556 - protein, 5 aa, Neisseria
LSACT

SEQ ID NO: 12557 - protein, 8 aa, Neisseria
RANEAQAP

SEQ ID NO: 12558 - protein, 6 aa, Neisseria
AVEMKK

SEQ ID NO: 12559 - protein, 7 aa, Neisseria
VRRFVDD

SEQ ID NO: 12560 - protein, 8 aa, Neisseria
EWQDFFDK

SEQ ID NO: 12561 - protein, 5 aa, Neisseria
VKIMH

SEQ ID NO: 12562 - protein, 5 aa, Neisseria
DDVAQ

SEQ ID NO: 12563 - protein, 9 aa, Neisseria
GSFRVADAL

SEQ ID NO: 12564 - protein, 10 aa, Neisseria
KELVELLKLA

SEQ ID NO: 12565 - protein, 5 aa, Neisseria
AMGMP

SEQ ID NO: 12566 - protein, 22 aa, Neisseria
HRDIWGNVGDVAASVANYMKQH

SEQ ID NO: 12567 - protein, 9 aa, Neisseria
RTVADLKAY

SEQ ID NO: 12568 - protein, 9 aa, Neisseria
YLGLNNFYT

SEQ ID NO: 12569 - protein, 7 aa, Neisseria
MKKRKIL

SEQ ID NO: 12570 - protein, 27 aa, Neisseria
MEARPPRANEAQAPRAVEMKKESRPAF

SEQ ID NO: 12571 - protein, 6 aa, Neisseria
VSDSGF

SEQ ID NO: 12572 - protein, 21 aa, Neisseria
ANVRRFVDDEVGKGDFSRAEW

SEQ ID NO: 12573 - protein, 9 aa, Neisseria
MHRPSTSRP

SEQ ID NO: 12574 - protein, 24 aa, Neisseria
RTGNSGKAKFRGARRFYAENRALI

SEQ ID NO: 12575 - protein, 8 aa, Neisseria
DVAQKYGV

SEQ ID NO: 12576 - protein, 11 aa, Neisseria
IETNYGKNTGS

SEQ ID NO: 12577 - protein, 9 aa, Neisseria
DYPRRAGFF

SEQ ID NO: 12578 - protein, 9 aa, Neisseria
KLAKEEGGD

SEQ ID NO: 12579 - protein, 20 aa, Neisseria
MPSSYRKWAVDYDGDGHRDI

SEQ ID NO: 12580 - protein, 9 aa, Neisseria
HGWRTGGKM

SEQ ID NO: 12581 - protein, 5 aa, Neisseria
APGAD

SEQ ID NO: 12582 - protein, 7 aa, Neisseria
IGEKTAL

SEQ ID NO: 12583 - protein, 12 aa, Neisseria
PGEELADDEKAV

SEQ ID NO: 12584 - protein, 5 aa, Neisseria
ETAPG

SEQ ID NO: 12585 - protein, 13 aa, Neisseria
VRDIANSLGGPGL

SEQ ID NO: 12586 - protein, 7 aa, Neisseria
MKKRKIL

SEQ ID NO: 12587 - protein, 27 aa, Neisseria
MEARPPRANEAQAPRAVEMKKESRPAF

SEQ ID NO: 12588 - protein, 21 aa, Neisseria
ANVRRFVDDEVGKGDFSRAEW

SEQ ID NO: 12589 - protein, 22 aa, Neisseria
GNSGKAKFRGARRFYAENRALI

SEQ ID NO: 12590 - protein, 7 aa, Neisseria
NYGKNTG

SEQ ID NO: 12591 - protein, 8 aa, Neisseria
YPRRAGFF

SEQ ID NO: 12592 - protein, 9 aa, Neisseria
KLAKEEGGD

SEQ ID NO: 12593 - protein, 9 aa, Neisseria
YDGDGHRDI

SEQ ID NO: 12594 - protein, 7 aa, Neisseria
IGEKTAL

SEQ ID NO: 12595 - protein, 12 aa, Neisseria
PGEELADDEKAV

SEQ ID NO: 12596 - protein, 5 aa, Neisseria
VRDIA

SEQ ID NO: 12597 - protein, 8 aa, Neisseria
LMACAAFL

SEQ ID NO: 12598 - protein, 12 aa, Neisseria
LGACYAILSLYA

SEQ ID NO: 12599 - protein, 11 aa, Neisseria
PALLGGWVGAY

SEQ ID NO: 12600 - protein, 18 aa, Neisseria
GVASPCRTICTVCGFVAL

SEQ ID NO: 12601 - protein, 18 aa, Neisseria
IDKRCAIRGQRRIPEHRL

SEQ ID NO: 12602 - protein, 10 aa, Neisseria
FKHKTAKKRF

SEQ ID NO: 12603 - protein, 18 aa, Neisseria
IDKRCAIRGQRRIPEHRL

SEQ ID NO: 12604 - protein, 10 aa, Neisseria
FKHKTAKKRF

SEQ ID NO: 12605 - protein, 7 aa, Neisseria
VGVVAVL

SEQ ID NO: 12606 - protein, 12 aa, Neisseria
KCGQTAQAYRDA

SEQ ID NO: 12607 - protein, 10 aa, Neisseria
QHLAAIEQLK

SEQ ID NO: 12608 - protein, 5 aa, Neisseria
FDELE

SEQ ID NO: 12609 - protein, 33 aa, Neisseria
AGCGKDAGGYEGYWREKSDKKEGMIAVKKEKGN

SEQ ID NO: 12610 - protein, 15 aa, Neisseria
TGKEESLLLSEKDGA

SEQ ID NO: 12611 - protein, 5 aa, Neisseria
NTGIG

SEQ ID NO: 12612 - protein, 40 aa, Neisseria
IPIKLSDDGKELYVERRQYVKTDAAMKDKIIAHQKKCGQT

SEQ ID NO: 12613 - protein, 15 aa, Neisseria
AYRDARNALPSNQTY

SEQ ID NO: 12614 - protein, 26 aa, Neisseria
EQLKRRFEAEFDELEKEIKCNGRSPA

SEQ ID NO: 12615 - protein, 7 aa, Neisseria
CGKDAGG

SEQ ID NO: 12616 - protein, 20 aa, Neisseria
YWREKSDKKEGMIAVKKEKG

SEQ ID NO: 12617 - protein, 15 aa, Neisseria
TGKEESLLLSEKDGA

SEQ ID NO: 12618 - protein, 39 aa, Neisseria
IPIKLSDDGKELYVERRQYVKTDAAMKDKIIAHQKKCGQ

SEQ ID NO: 12619 - protein, 9 aa, Neisseria
AYRDARNAL

SEQ ID NO: 12620 - protein, 24 aa, Neisseria
EQLKRRFEAEFDELEKEIKCNGRS

SEQ ID NO: 12621 - protein, 8 aa, Neisseria
PSEHISSF

SEQ ID NO: 12622 - protein, 7 aa, Neisseria
LGSTLGQ

SEQ ID NO: 12623 - protein, 10 aa, Neisseria
AESAEELSRQ

SEQ ID NO: 12624 - protein, 12 aa, Neisseria
AGAPYRILPDGI

SEQ ID NO: 12625 - protein, 7 aa, Neisseria
ADSGGQV

SEQ ID NO: 12626 - protein, 16 aa, Neisseria
LPQNNENLWQPSEHIS

SEQ ID NO: 12627 - protein, 17 aa, Neisseria
AAEGRLAVKAEGKGSYA

SEQ ID NO: 12628 - protein, 5 aa, Neisseria
TPLGS

SEQ ID NO: 12629 - protein, 9 aa, Neisseria
LCQDRDGAL

SEQ ID NO: 12630 - protein, 8 aa, Neisseria
VDGKGNVY

SEQ ID NO: 12631 - protein, 8 aa, Neisseria
ESAEELSR

SEQ ID NO: 12632 - protein, 8 aa, Neisseria
WADGRRVA

SEQ ID NO: 12633 - protein, 7 aa, Neisseria
ILPDGIL

SEQ ID NO: 12634 - protein, 9 aa, Neisseria
GRTADSGGQ

SEQ ID NO: 12635 - protein, 17 aa, Neisseria
GMPSETETPERCAARTR

SEQ ID NO: 12636 - protein, 15 aa, Neisseria
AAEGRLAVKAEGKGS

SEQ ID NO: 12637 - protein, 8 aa, Neisseria
CQDRDGAL

SEQ ID NO: 12638 - protein, 5 aa, Neisseria
VDGKG

SEQ ID NO: 12639 - protein, 8 aa, Neisseria
ESAEELSR

SEQ ID NO: 12640 - protein, 6 aa, Neisseria
DGRRVA

SEQ ID NO: 12641 - protein, 8 aa, Neisseria
RTADSGGQ

SEQ ID NO: 12642 - protein, 14 aa, Neisseria
SETETPERCAARTR

SEQ ID NO: 12643 - protein, 5 aa, Neisseria
LLTAC

SEQ ID NO: 12644 - protein, 11 aa, Neisseria
SYDVARDFYKE

SEQ ID NO: 12645 - protein, 8 aa, Neisseria
KGWQQALP

SEQ ID NO: 12646 - protein, 15 aa, Neisseria
NPKQIRDWNDLAKDG

SEQ ID NO: 12647 - protein, 7 aa, Neisseria
KLVASIL

SEQ ID NO: 12648 - protein, 7 aa, Neisseria
RNIGDVL

SEQ ID NO: 12649 - protein, 7 aa, Neisseria
TQKTARA

SEQ ID NO: 12650 - protein, 12 aa, Neisseria
LEYLWSEPAQEL

SEQ ID NO: 12651 - protein, 12 aa, Neisseria
KKFGGWDNIMKT

SEQ ID NO: 12652 - protein, 26 aa, Neisseria
SPAADSNHPSGQNAPANTESDGKNIT

SEQ ID NO: 12653 - protein, 14 aa, Neisseria
SYDVARDFYKEYNP

SEQ ID NO: 12654 - protein, 9 aa, Neisseria
YQSEHPGTS

SEQ ID NO: 12655 - protein, 11 aa, Neisseria
QQSHGGSSKQA

SEQ ID NO: 12656 - protein, 15 aa, Neisseria
NQSSDIDLLEKKGLV

SEQ ID NO: 12657 - protein, 10 aa, Neisseria
ALPDHAAPYT

SEQ ID NO: 12658 - protein, 19 aa, Neisseria
RKNNPKQIRDWNDLAKDGV

SEQ ID NO: 12659 - protein, 9 aa, Neisseria
NPKTSGNGR

SEQ ID NO: 12660 - protein, 13 aa, Neisseria
LKTTNGNEQEAQK

SEQ ID NO: 12661 - protein, 15 aa, Neisseria
LKNTPVFENGGRAAT

SEQ ID NO: 12662 - protein, 8 aa, Neisseria
FTQRNIGD

SEQ ID NO: 12663 - protein, 10 aa, Neisseria
YVSKKLTQGQ

SEQ ID NO: 12664 - protein, 12 aa, Neisseria
VAKKGTQKTARA

SEQ ID NO: 12665 - protein, 31 aa, Neisseria
LRPRNPEVLARHKADFPDLDTFSPEKKFGGW

SEQ ID NO: 12666 - protein, 7 aa, Neisseria
YFADGGI

SEQ ID NO: 12667 - protein, 5 aa, Neisseria
LTAQK

SEQ ID NO: 12668 - protein, 9 aa, Neisseria
PAADSNHPS

SEQ ID NO: 12669 - protein, 9 aa, Neisseria
ANTESDGKN

SEQ ID NO: 12670 - protein, 8 aa, Neisseria
DVARDFYK

SEQ ID NO: 12671 - protein, 7 aa, Neisseria
YQSEHPG

SEQ ID NO: 12672 - protein, 8 aa, Neisseria
HGGSSKQA

SEQ ID NO: 12673 - protein, 14 aa, Neisseria
QSSDIDLLEKKGLV

SEQ ID NO: 12674 - protein, 19 aa, Neisseria
RKNNPKQIRDWNDLAKDGV

SEQ ID NO: 12675 - protein, 7 aa, Neisseria
PKTSGNG

SEQ ID NO: 12676 - protein, 11 aa, Neisseria
TTNGNEQEAQK

SEQ ID NO: 12677 - protein, 6 aa, Neisseria
NGGRAA

SEQ ID NO: 12678 - protein, 7 aa, Neisseria
YVSKKLT

SEQ ID NO: 12679 - protein, 12 aa, Neisseria
VAKKGTQKTARA

SEQ ID NO: 12680 - protein, 18 aa, Neisseria
LRPRNPEVLARHKADFPD

SEQ ID NO: 12681 - protein, 11 aa, Neisseria
DTFSPEKKFGG

SEQ ID NO: 12682 - protein, 5 aa, Neisseria
LTAQK

SEQ ID NO: 12683 - protein, 6 aa, Neisseria
VPDGVK

SEQ ID NO: 12684 - protein, 15 aa, Neisseria
WTLLAMFVGVIAAII

SEQ ID NO: 12685 - protein, 11 aa, Neisseria
GAAMSDALSAF

SEQ ID NO: 12686 - protein, 17 aa, Neisseria
HPIMQSIAGSYGSNPAK

SEQ ID NO: 12687 - protein, 5 aa, Neisseria
YLALV

SEQ ID NO: 12688 - protein, 12 aa, Neisseria
PLIVNLIAENLG

SEQ ID NO: 12689 - protein, 6 aa, Neisseria
GVIAFF

SEQ ID NO: 12690 - protein, 9 aa, Neisseria
RLREMGKMS

SEQ ID NO: 12691 - protein, 6 aa, Neisseria
AVIFGI

SEQ ID NO: 12692 - protein, 18 aa, Neisseria
LGLIKWFSGVLAESVGGL

SEQ ID NO: 12693 - protein, 13 aa, Neisseria
TAHITAMFGAFFA

SEQ ID NO: 12694 - protein, 8 aa, Neisseria
YTTMGEWW

SEQ ID NO: 12695 - protein, 8 aa, Neisseria
VPDGVKPQ

SEQ ID NO: 12696 - protein, 9 aa, Neisseria
TADKPGAAM

SEQ ID NO: 12697 - protein, 7 aa, Neisseria
GRKTLGI

SEQ ID NO: 12698 - protein, 10 aa, Neisseria
TPSNTARGGG

SEQ ID NO: 12699 - protein, 17 aa, Neisseria
GSYGSNPAKGTEGKMGK

SEQ ID NO: 12700 - protein, 6 aa, Neisseria
HSNPIS

SEQ ID NO: 12701 - protein, 6 aa, Neisseria
NLGSSF

SEQ ID NO: 12702 - protein, 10 aa, Neisseria
YPPEIKETPN

SEQ ID NO: 12703 - protein, 17 aa, Neisseria
FAKDRLREMGKMSADEI

SEQ ID NO: 12704 - protein, 9 aa, Neisseria
DVLKEKSAW

SEQ ID NO: 12705 - protein, 9 aa, Neisseria
TADKPGAAM

SEQ ID NO: 12706 - protein, 5 aa, Neisseria
NTARG

SEQ ID NO: 12707 - protein, 12 aa, Neisseria
NPAKGTEGKMGK

SEQ ID NO: 12708 - protein, 8 aa, Neisseria
PEIKETPN

SEQ ID NO: 12709 - protein, 17 aa, Neisseria
FAKDRLREMGKMSADEI

SEQ ID NO: 12710 - protein, 9 aa, Neisseria
DVLKEKSAW

SEQ ID NO: 12711 - protein, 5 aa, Neisseria
LPNIR

SEQ ID NO: 12712 - protein, 11 aa, Neisseria
NTGETVNQLMG

SEQ ID NO: 12713 - protein, 12 aa, Neisseria
LHAGNINQIMSL

SEQ ID NO: 12714 - protein, 5 aa, Neisseria
ILAAP

SEQ ID NO: 12715 - protein, 9 aa, Neisseria
PSYLRSIRI

SEQ ID NO: 12716 - protein, 7 aa, Neisseria
DLLNLRD

SEQ ID NO: 12717 - protein, 12 aa, Neisseria
EQGLENLKRLPT

SEQ ID NO: 12718 - protein, 5 aa, Neisseria
SDMFY

SEQ ID NO: 12719 - protein, 9 aa, Neisseria
GRSIGGTPD

SEQ ID NO: 12720 - protein, 14 aa, Neisseria
RYHQAVSGLSEVYD

SEQ ID NO: 12721 - protein, 5 aa, Neisseria
WLAEL

SEQ ID NO: 12722 - protein, 15 aa, Neisseria
MKDALRAPEEAFGEG

SEQ ID NO: 12723 - protein, 6 aa, Neisseria
HAQWNK

SEQ ID NO: 12724 - protein, 42 aa, Neisseria
SPNPAEIRMQQDIQQRQREEQLRQTMQPESDVRLHQKNTGET

SEQ ID NO: 12725 - protein, 8 aa, Neisseria
LMGDDSSQ

SEQ ID NO: 12726 - protein, 8 aa, Neisseria
VLEGEHHA

SEQ ID NO: 12727 - protein, 7 aa, Neisseria
RALRETG

SEQ ID NO: 12728 - protein, 8 aa, Neisseria
GKCLHAGN

SEQ ID NO: 12729 - protein, 9 aa, Neisseria
PQDLNSGKL

SEQ ID NO: 12730 - protein, 12 aa, Neisseria
IRIDRSNDDQTH

SEQ ID NO: 12731 - protein, 12 aa, Neisseria
NKFPTRSNDLLN

SEQ ID NO: 12732 - protein, 20 aa, Neisseria
RDLEQGLENLKRLPTAEADL

SEQ ID NO: 12733 - protein, 10 aa, Neisseria
VEGEPNQSDV

SEQ ID NO: 12734 - protein, 6 aa, Neisseria
RQRLLP

SEQ ID NO: 12735 - protein, 16 aa, Neisseria
VGMDNSGSEATGKYQG

SEQ ID NO: 12736 - protein, 7 aa, Neisseria
ADNPLGL

SEQ ID NO: 12737 - protein, 24 aa, Neisseria
YGRSIGGTPDEESFDGHRKEGGSN

SEQ ID NO: 12738 - protein, 5 aa, Neisseria
HNGYR

SEQ ID NO: 12739 - protein, 16 aa, Neisseria
EVYDYNGKSYNTDFGF

SEQ ID NO: 12740 - protein, 9 aa, Neisseria
LYRDAKRKT

SEQ ID NO: 12741 - protein, 22 aa, Neisseria
WMRETKSYIDDAELTVQRRKTA

SEQ ID NO: 12742 - protein, 37 aa, Neisseria
EYIGRSTADFKLKYKRGTGMKDALRAPEEAFGEGTSR

SEQ ID NO: 12743 - protein, 7 aa, Neisseria
SADVNTP

SEQ ID NO: 12744 - protein, 14 aa, Neisseria
QWNKTPLTSQDKLA

SEQ ID NO: 12745 - protein, 10 aa, Neisseria
HTVRGFDGEM

SEQ ID NO: 12746 - protein, 21 aa, Neisseria
LSAERGWYWRNDLSWQFKPGH

SEQ ID NO: 12747 - protein, 6 aa, Neisseria
SGQSAK

SEQ ID NO: 12748 - protein, 17 aa, Neisseria
RALKKPEFFQSRKWASG

SEQ ID NO: 12749 - protein, 22 aa, Neisseria
NPAEIRMQQDIQQRQREEQLRQ

SEQ ID NO: 12750 - protein, 17 aa, Neisseria
MQPESDVRLHQKNTGET

SEQ ID NO: 12751 - protein, 7 aa, Neisseria
MGDDSSQ

SEQ ID NO: 12752 - protein, 8 aa, Neisseria
VLEGEHHA

SEQ ID NO: 12753 - protein, 7 aa, Neisseria
RALRETG

SEQ ID NO: 12754 - protein, 7 aa, Neisseria
QDLNSGK

SEQ ID NO: 12755 - protein, 12 aa, Neisseria
IRIDRSNDDQTH

SEQ ID NO: 12756 - protein, 7 aa, Neisseria
FPTRSND

SEQ ID NO: 12757 - protein, 20 aa, Neisseria
RDLEQGLENLKRLPTAEADL

SEQ ID NO: 12758 - protein, 8 aa, Neisseria
VEGEPNQS

SEQ ID NO: 12759 - protein, 10 aa, Neisseria
MDNSGSEATG

SEQ ID NO: 12760 - protein, 19 aa, Neisseria
IGGTPDEESFDGHRKEGGS

SEQ ID NO: 12761 - protein, 5 aa, Neisseria
YDYNG

SEQ ID NO: 12762 - protein, 9 aa, Neisseria
LYRDAKRKT

SEQ ID NO: 12763 - protein, 21 aa, Neisseria
WMRETKSYIDDAELTVQRRKT

SEQ ID NO: 12764 - protein, 27 aa, Neisseria
STADFKLKYKRGTGMKDALRAPEEAFG

SEQ ID NO: 12765 - protein, 9 aa, Neisseria
PLTSQDKLA

SEQ ID NO: 12766 - protein, 7 aa, Neisseria
RGFDGEM

SEQ ID NO: 12767 - protein, 5 aa, Neisseria
LSAER

SEQ ID NO: 12768 - protein, 10 aa, Neisseria
RALKKPEFFQ

SEQ ID NO: 12769 - protein, 15 aa, Neisseria
KAPKTVANFVRYARK

SEQ ID NO: 12770 - protein, 7 aa, Neisseria
FHRVIDG

SEQ ID NO: 12771 - protein, 10 aa, Neisseria
EDLAQKASDK

SEQ ID NO: 12772 - protein, 10 aa, Neisseria
NESGNGLKNT

SEQ ID NO: 12773 - protein, 26 aa, Neisseria
TVFGRVESGMNTVSKIARVKTATRGF

SEQ ID NO: 12774 - protein, 5 aa, Neisseria
MKPKF

SEQ ID NO: 12775 - protein, 5 aa, Neisseria
TDMGN

SEQ ID NO: 12776 - protein, 10 aa, Neisseria
VLDESKAPKT

SEQ ID NO: 12777 - protein, 13 aa, Neisseria
RYARKGFYDDTVF

SEQ ID NO: 12778 - protein, 29 aa, Neisseria
GGGLTEDLAQKASDKAVANESGNGLKNTA

SEQ ID NO: 12779 - protein, 10 aa, Neisseria
ARTTAPDSAT

SEQ ID NO: 12780 - protein, 12 aa, Neisseria
DNASLDYKNGQY

SEQ ID NO: 12781 - protein, 10 aa, Neisseria
GRVESGMNTV

SEQ ID NO: 12782 - protein, 12 aa, Neisseria
KIARVKTATRGF

SEQ ID NO: 12783 - protein, 5 aa, Neisseria
VKIRR

SEQ ID NO: 12784 - protein, 5 aa, Neisseria
MKPKF

SEQ ID NO: 12785 - protein, 5 aa, Neisseria
TDMGN

SEQ ID NO: 12786 - protein, 10 aa, Neisseria
VLDESKAPKT

SEQ ID NO: 12787 - protein, 27 aa, Neisseria
GLTEDLAQKASDKAVANESGNGLKNTA

SEQ ID NO: 12788 - protein, 7 aa, Neisseria
TAPDSAT

SEQ ID NO: 12789 - protein, 7 aa, Neisseria
ASLDYKN

SEQ ID NO: 12790 - protein, 7 aa, Neisseria
GRVESGM

SEQ ID NO: 12791 - protein, 9 aa, Neisseria
KIARVKTAT

SEQ ID NO: 12792 - protein, 5 aa, Neisseria
VKIRR

SEQ ID NO: 12793 - protein, 10 aa, Neisseria
DAASFWELKN

SEQ ID NO: 12794 - protein, 5 aa, Neisseria
ANPYP

SEQ ID NO: 12795 - protein, 9 aa, Neisseria
SAALDQYPS

SEQ ID NO: 12796 - protein, 8 aa, Neisseria
QLKDMQEC

SEQ ID NO: 12797 - protein, 10 aa, Neisseria
FGGFKPNPWD

SEQ ID NO: 12798 - protein, 11 aa, Neisseria
LKNYANPYPGS

SEQ ID NO: 12799 - protein, 63 aa, Neisseria
DQYPSKARRRQLKDMQECGYDPIDGGKSEADACLRKKGWCRKGFDPYPENKKYEWPREEGKTK

SEQ ID NO: 12800 - protein, 38 aa, Neisseria
YPSKARRRQLKDMQECGYDPIDGGKSEADACLRKKGWC

SEQ ID NO: 12801 - protein, 22 aa, Neisseria
KGFDPYPENKKYEWPREEGKTK

SEQ ID NO: 12802 - protein, 5 aa, Neisseria
KTSEY

SEQ ID NO: 12803 - protein, 10 aa, Neisseria
QFENINNSKK

SEQ ID NO: 12804 - protein, 6 aa, Neisseria
GFARGL

SEQ ID NO: 12805 - protein, 14 aa, Neisseria
TEEQIRKYFKECFN

SEQ ID NO: 12806 - protein, 8 aa, Neisseria
RDYSTCQA

SEQ ID NO: 12807 - protein, 38 aa, Neisseria
SVGNYTEWANQVIHHIENYVSFAAHLYSGLDPFHYIEV

SEQ ID NO: 12808 - protein, 19 aa, Neisseria
ENPIDDLKSLDGHQIIKVN

SEQ ID NO: 12809 - protein, 5 aa, Neisseria
GFFTK

SEQ ID NO: 12810 - protein, 10 aa, Neisseria
WLRVIDGHSN

SEQ ID NO: 12811 - protein, 8 aa, Neisseria
PVEGYRKG

SEQ ID NO: 12812 - protein, 8 aa, Neisseria
AGVYATWH

SEQ ID NO: 12813 - protein, 5 aa, Neisseria
WMQYQ

SEQ ID NO: 12814 - protein, 6 aa, Neisseria
GTERFT

SEQ ID NO: 12815 - protein, 6 aa, Neisseria
KGITAS

SEQ ID NO: 12816 - protein, 7 aa, Neisseria
GYNALLA

SEQ ID NO: 12817 - protein, 8 aa, Neisseria
LYKNIAIE

SEQ ID NO: 12818 - protein, 5 aa, Neisseria
FAAVN

SEQ ID NO: 12819 - protein, 6 aa, Neisseria
FNRQTG

SEQ ID NO: 12820 - protein, 15 aa, Neisseria
KKLRDKTSEYWKKET

SEQ ID NO: 12821 - protein, 9 aa, Neisseria
TEDNPKVPP

SEQ ID NO: 12822 - protein, 6 aa, Neisseria
YPRTYQ

SEQ ID NO: 12823 - protein, 10 aa, Neisseria
ENINNSKKIS

SEQ ID NO: 12824 - protein, 9 aa, Neisseria
YDQEYTEGY

SEQ ID NO: 12825 - protein, 18 aa, Neisseria
GVAKRNGDTEEQIRKYFK

SEQ ID NO: 12826 - protein, 23 aa, Neisseria
CFNSNTKIRDYSTCQAEKFGSHP

SEQ ID NO: 12827 - protein, 14 aa, Neisseria
LGPKIKNSHINSEI

SEQ ID NO: 12828 - protein, 6 aa, Neisseria
YSGLDP

SEQ ID NO: 12829 - protein, 7 aa, Neisseria
EVTDNSH

SEQ ID NO: 12830 - protein, 60 aa, Neisseria
DEFRLENSLWEPRWDSNVGKLKTTNADIRFNTKSESLLVKEDYAGGARFRFAYDPKEAKN

SEQ ID NO: 12831 - protein, 8 aa, Neisseria
EKNVTGTS

SEQ ID NO: 12832 - protein, 18 aa, Neisseria
IFENPIDDLKSLDGHQII

SEQ ID NO: 12833 - protein, 19 aa, Neisseria
VNGTADKHAFRLSGKHQKG

SEQ ID NO: 12834 - protein, 8 aa, Neisseria
LQQRPEGF

SEQ ID NO: 12835 - protein, 8 aa, Neisseria
KVQERDDM

SEQ ID NO: 12836 - protein, 19 aa, Neisseria
RLNNKNSDIFDRTLPRKGL

SEQ ID NO: 12837 - protein, 23 aa, Neisseria
IDGHSNQWVQGKTAPVEGYRKGV

SEQ ID NO: 12838 - protein, 7 aa, Neisseria
QNESNQL

SEQ ID NO: 12839 - protein, 20 aa, Neisseria
MGGQAEQRSTFHNPDTDNLT

SEQ ID NO: 12840 - protein, 5 aa, Neisseria
GNVKG

SEQ ID NO: 12841 - protein, 12 aa, Neisseria
LQDKQTGAYADS

SEQ ID NO: 12842 - protein, 23 aa, Neisseria
QRFRHRINTEDGTERFTSKGITA

SEQ ID NO: 12843 - protein, 9 aa, Neisseria
HFTKKGNSL

SEQ ID NO: 12844 - protein, 11 aa, Neisseria
VNGKFSDSENA

SEQ ID NO: 12845 - protein, 8 aa, Neisseria
LGSRQLQT

SEQ ID NO: 12846 - protein, 22 aa, Neisseria
KPFGVEMDGERRVINNKTAIES

SEQ ID NO: 12847 - protein, 5 aa, Neisseria
VKIKS

SEQ ID NO: 12848 - protein, 15 aa, Neisseria
TFNRQTGKHHQAKQG

SEQ ID NO: 12849 - protein, 15 aa, Neisseria
KKLRDKTSEYWKKET

SEQ ID NO: 12850 - protein, 5 aa, Neisseria
EDNPK

SEQ ID NO: 12851 - protein, 7 aa, Neisseria
NNSKKIS

SEQ ID NO: 12852 - protein, 18 aa, Neisseria
GVAKRNGDTEEQIRKYFK

SEQ ID NO: 12853 - protein, 7 aa, Neisseria
TKIRDYS

SEQ ID NO: 12854 - protein, 6 aa, Neisseria
QAEKFG

SEQ ID NO: 12855 - protein, 5 aa, Neisseria
PKIKN

SEQ ID NO: 12856 - protein, 6 aa, Neisseria
DEFRLE

SEQ ID NO: 12857 - protein, 34 aa, Neisseria
PRWDSNVGKLKTTNADIRFNTKSESLLVKEDYAG

SEQ ID NO: 12858 - protein, 8 aa, Neisseria
YDPKEAKN

SEQ ID NO: 12859 - protein, 5 aa, Neisseria
KNVTG

SEQ ID NO: 12860 - protein, 10 aa, Neisseria
NPIDDLKSLD

SEQ ID NO: 12861 - protein, 8 aa, Neisseria
GTADKHAF

SEQ ID NO: 12862 - protein, 7 aa, Neisseria
LSGKHQK

SEQ ID NO: 12863 - protein, 7 aa, Neisseria
QQRPEGF

SEQ ID NO: 12864 - protein, 7 aa, Neisseria
VQERDDM

SEQ ID NO: 12865 - protein, 10 aa, Neisseria
LNNKNSDIFD

SEQ ID NO: 12866 - protein, 7 aa, Neisseria
EGYRKGV

SEQ ID NO: 12867 - protein, 5 aa, Neisseria
NESNQ

SEQ ID NO: 12868 - protein, 9 aa, Neisseria
QAEQRSTFH

SEQ ID NO: 12869 - protein, 7 aa, Neisseria
PDTDNLT

SEQ ID NO: 12870 - protein, 6 aa, Neisseria
LQDKQT

SEQ ID NO: 12871 - protein, 18 aa, Neisseria
QRFRHRINTEDGTERFTS

SEQ ID NO: 12872 - protein, 8 aa, Neisseria
HFTKKGNS

SEQ ID NO: 12873 - protein, 8 aa, Neisseria
KFSDSENA

SEQ ID NO: 12874 - protein, 13 aa, Neisseria
FGVEMDGERRVIN

SEQ ID NO: 12875 - protein, 5 aa, Neisseria
VKIKS

SEQ ID NO: 12876 - protein, 12 aa, Neisseria
RQTGKHHQAKQG

SEQ ID NO: 12877 - protein, 6 aa, Neisseria
VSDKWA

SEQ ID NO: 12878 - protein, 5 aa, Neisseria
APRVV

SEQ ID NO: 12879 - protein, 7 aa, Neisseria
LEHSLRD

SEQ ID NO: 12880 - protein, 12 aa, Neisseria
LIASLADLYAKL

SEQ ID NO: 12881 - protein, 19 aa, Neisseria
ALLAKLAGRPAEAVARYRE

SEQ ID NO: 12882 - protein, 6 aa, Neisseria
ERHFAE

SEQ ID NO: 12883 - protein, 14 aa, Neisseria
PVLENVGRFRKKTE

SEQ ID NO: 12884 - protein, 16 aa, Neisseria
KRLGESATVFGGWQFV

SEQ ID NO: 12885 - protein, 13 aa, Neisseria
AGWAQEWRQLGGL

SEQ ID NO: 12886 - protein, 12 aa, Neisseria
YARRNYKGIAAF

SEQ ID NO: 12887 - protein, 8 aa, Neisseria
AILDDKAL

SEQ ID NO: 12888 - protein, 26 aa, Neisseria
RSVSDKWAESDWKVENDAPRVVDGDF

SEQ ID NO: 12889 - protein, 15 aa, Neisseria
KMLEHSLRDALNGNQ

SEQ ID NO: 12890 - protein, 7 aa, Neisseria
KLPDYDA

SEQ ID NO: 12891 - protein, 5 aa, Neisseria
RARAL

SEQ ID NO: 12892 - protein, 26 aa, Neisseria
LAGRPAEAVARYRELHGENAADERIL

SEQ ID NO: 12893 - protein, 25 aa, Neisseria
AAAEFDDFRLKSAERHFAEAAKLDL

SEQ ID NO: 12894 - protein, 11 aa, Neisseria
NVGRFRKKTEG

SEQ ID NO: 12895 - protein, 5 aa, Neisseria
FSGGI

SEQ ID NO: 12896 - protein, 10 aa, Neisseria
AVNRNANNAA

SEQ ID NO: 12897 - protein, 10 aa, Neisseria
QYCRQNGGRQ

SEQ ID NO: 12898 - protein, 7 aa, Neisseria
SRAERAA

SEQ ID NO: 12899 - protein, 11 aa, Neisseria
IEAEKLTPLAD

SEQ ID NO: 12900 - protein, 9 aa, Neisseria
RSNIGGTSY

SEQ ID NO: 12901 - protein, 13 aa, Neisseria
FSKKSAYDDGFGR

SEQ ID NO: 12902 - protein, 10 aa, Neisseria
GWQYKNARQT

SEQ ID NO: 12903 - protein, 21 aa, Neisseria
SGSDGFDAKTKRVNNRRLPPY

SEQ ID NO: 12904 - protein, 9 aa, Neisseria
HTYRPNPGW

SEQ ID NO: 12905 - protein, 24 aa, Neisseria
EHYRQRYREQDRAEYNNGRQDGFY

SEQ ID NO: 12906 - protein, 7 aa, Neisseria
SAKRLGE

SEQ ID NO: 12907 - protein, 8 aa, Neisseria
FVPKRETV

SEQ ID NO: 12908 - protein, 11 aa, Neisseria
AAYRRNGVYAG

SEQ ID NO: 12909 - protein, 18 aa, Neisseria
GGLNSRVSASYARRNYKG

SEQ ID NO: 12910 - protein, 10 aa, Neisseria
TEAQRNREWN

SEQ ID NO: 12911 - protein, 9 aa, Neisseria
SHDKLSYKG

SEQ ID NO: 12912 - protein, 17 aa, Neisseria
FGRTESNVPYAKRRNSE

SEQ ID NO: 12913 - protein, 5 aa, Neisseria
ADWRF

SEQ ID NO: 12914 - protein, 8 aa, Neisseria
AILDDKAL

SEQ ID NO: 12915 - protein, 23 aa, Neisseria
RSVSDKWAESDWKVENDAPRVVD

SEQ ID NO: 12916 - protein, 12 aa, Neisseria
KMLEHSLRDALN

SEQ ID NO: 12917 - protein, 5 aa, Neisseria
RARAL

SEQ ID NO: 12918 - protein, 17 aa, Neisseria
LAGRPAEAVARYRELHG

SEQ ID NO: 12919 - protein, 8 aa, Neisseria
NAADERIL

SEQ ID NO: 12920 - protein, 25 aa, Neisseria
AAAEFDDFRLKSAERHFAEAAKLDL

SEQ ID NO: 12921 - protein, 11 aa, Neisseria
NVGRFRKKTEG

SEQ ID NO: 12922 - protein, 6 aa, Neisseria
VNRNAN

SEQ ID NO: 12923 - protein, 8 aa, Neisseria
CRQNGGRQ

SEQ ID NO: 12924 - protein, 7 aa, Neisseria
SRAERAA

SEQ ID NO: 12925 - protein, 8 aa, Neisseria
IEAEKLTP

SEQ ID NO: 12926 - protein, 10 aa, Neisseria
KKSAYDDGFG

SEQ ID NO: 12927 - protein, 6 aa, Neisseria
KNARQT

SEQ ID NO: 12928 - protein, 16 aa, Neisseria
DGFDAKTKRVNNRRLP

SEQ ID NO: 12929 - protein, 20 aa, Neisseria
HYRQRYREQDRAEYNNGRQD

SEQ ID NO: 12930 - protein, 7 aa, Neisseria
SAKRLGE

SEQ ID NO: 12931 - protein, 7 aa, Neisseria
VPKRETV

SEQ ID NO: 12932 - protein, 6 aa, Neisseria
AYRRNG

SEQ ID NO: 12933 - protein, 7 aa, Neisseria
YARRNYK

SEQ ID NO: 12934 - protein, 8 aa, Neisseria
EAQRNREW

SEQ ID NO: 12935 - protein, 7 aa, Neisseria
SHDKLSY

SEQ ID NO: 12936 - protein, 6 aa, Neisseria
FGRTES

SEQ ID NO: 12937 - protein, 8 aa, Neisseria
YAKRRNSE

SEQ ID NO: 12938 - protein, 6 aa, Neisseria
TLIAAI

SEQ ID NO: 12939 - protein, 6 aa, Neisseria
GCVSAV

SEQ ID NO: 12940 - protein, 6 aa, Neisseria
QFVGQI

SEQ ID NO: 12941 - protein, 23 aa, Neisseria
AEGVYNYITVASLPRTAGDIAGD

SEQ ID NO: 12942 - protein, 8 aa, Neisseria
MKPKPHTV

SEQ ID NO: 12943 - protein, 21 aa, Neisseria
VGAKSAVDRRTTGAQTDDNVM

SEQ ID NO: 12944 - protein, 19 aa, Neisseria
RIETTARSYLRQNNQTKGY

SEQ ID NO: 12945 - protein, 8 aa, Neisseria
ATEGEKQF

SEQ ID NO: 12946 - protein, 7 aa, Neisseria
ARSEQAA

SEQ ID NO: 12947 - protein, 20 aa, Neisseria
LPRTAGDIAGDTWNTSKVRA

SEQ ID NO: 12948 - protein, 9 aa, Neisseria
SPATQARVK

SEQ ID NO: 12949 - protein, 9 aa, Neisseria
TPEEQAQIT

SEQ ID NO: 12950 - protein, 7 aa, Neisseria
MKPKPHT

SEQ ID NO: 12951 - protein, 17 aa, Neisseria
SAVDRRTTGAQTDDNVM

SEQ ID NO: 12952 - protein, 6 aa, Neisseria
RIETTA

SEQ ID NO: 12953 - protein, 7 aa, Neisseria
NNQTKGY

SEQ ID NO: 12954 - protein, 8 aa, Neisseria
ATEGEKQF

SEQ ID NO: 12955 - protein, 7 aa, Neisseria
ARSEQAA

SEQ ID NO: 12956 - protein, 5 aa, Neisseria
PRTAG

SEQ ID NO: 12957 - protein, 6 aa, Neisseria
TQARVK

SEQ ID NO: 12958 - protein, 8 aa, Neisseria
TPEEQAQI

SEQ ID NO: 12959 - protein, 12 aa, Neisseria
LPALPAILPLST

SEQ ID NO: 12960 - protein, 7 aa, Neisseria
NGSKTLS

SEQ ID NO: 12961 - protein, 13 aa, Neisseria
DIMTDKGKWKLET

SEQ ID NO: 12962 - protein, 10 aa, Neisseria
LNSENNRAEL

SEQ ID NO: 12963 - protein, 10 aa, Neisseria
EIQENGSNTD

SEQ ID NO: 12964 - protein, 10 aa, Neisseria
GNTDIYGSGS

SEQ ID NO: 12965 - protein, 19 aa, Neisseria
HEERKLDGNSKTRNKRMSD

SEQ ID NO: 12966 - protein, 9 aa, Neisseria
FLKDDKNPA

SEQ ID NO: 12967 - protein, 15 aa, Neisseria
TVYEKSRNKASSGKS

SEQ ID NO: 12968 - protein, 20 aa, Neisseria
YRINGSKTLSDGIRYKSGNY

SEQ ID NO: 12969 - protein, 10 aa, Neisseria
ANDRISLTGG

SEQ ID NO: 12970 - protein, 19 aa, Neisseria
GRQPDRTDGKRESSRNTST

SEQ ID NO: 12971 - protein, 11 aa, Neisseria
VSGQSSSELKF

SEQ ID NO: 12972 - protein, 11 aa, Neisseria
DIMTDKGKWKL

SEQ ID NO: 12973 - protein, 7 aa, Neisseria
ENNRAEL

SEQ ID NO: 12974 - protein, 9 aa, Neisseria
EIQENGSNT

SEQ ID NO: 12975 - protein, 19 aa, Neisseria
HEERKLDGNSKTRNKRMSD

SEQ ID NO: 12976 - protein, 8 aa, Neisseria
FLKDDKNP

SEQ ID NO: 12977 - protein, 12 aa, Neisseria
TVYEKSRNKASS

SEQ ID NO: 12978 - protein, 11 aa, Neisseria
KTLSDGIRYKS

SEQ ID NO: 12979 - protein, 6 aa, Neisseria
ANDRIS

SEQ ID NO: 12980 - protein, 16 aa, Neisseria
RQPDRTDGKRESSRNT

SEQ ID NO: 12981 - protein, 7 aa, Neisseria
SSSELKF

SEQ ID NO: 12982 - protein, 5 aa, Neisseria
ATVCA

SEQ ID NO: 12983 - protein, 5 aa, Neisseria
DQDIL

SEQ ID NO: 12984 - protein, 5 aa, Neisseria
KIYRG

SEQ ID NO: 12985 - protein, 6 aa, Neisseria
CMSCHG

SEQ ID NO: 12986 - protein, 11 aa, Neisseria
SEIQAYPRLGG

SEQ ID NO: 12987 - protein, 7 aa, Neisseria
EQMNAYK

SEQ ID NO: 12988 - protein, 8 aa, Neisseria
EDIANRMS

SEQ ID NO: 12989 - protein, 13 aa, Neisseria
ASPKADVEKGKQV

SEQ ID NO: 12990 - protein, 8 aa, Neisseria
AADGNSGI

SEQ ID NO: 12991 - protein, 15 aa, Neisseria
IGIRDGKRTHGSAAV

SEQ ID NO: 12992 - protein, 6 aa, Neisseria
LSDQDI

SEQ ID NO: 12993 - protein, 18 aa, Neisseria
KQQPKSGEANPKENPELG

SEQ ID NO: 12994 - protein, 12 aa, Neisseria
IYRGGLSDKKVP

SEQ ID NO: 12995 - protein, 17 aa, Neisseria
HGPSGAGMPGGGSEIQA

SEQ ID NO: 12996 - protein, 8 aa, Neisseria
PRLGGQHQ

SEQ ID NO: 12997 - protein, 27 aa, Neisseria
NAYKSGQRKNTIMEDIANRMSEEDLKA

SEQ ID NO: 12998 - protein, 13 aa, Neisseria
ASPKADVEKGKQV

SEQ ID NO: 12999 - protein, 6 aa, Neisseria
AADGNS

SEQ ID NO: 13000 - protein, 10 aa, Neisseria
GIRDGKRTHG

SEQ ID NO: 13001 - protein, 5 aa, Neisseria
SDQDI

SEQ ID NO: 13002 - protein, 17 aa, Neisseria
QQPKSGEANPKENPELG

SEQ ID NO: 13003 - protein, 8 aa, Neisseria
GLSDKKVP

SEQ ID NO: 13004 - protein, 24 aa, Neisseria
KSGQRKNTIMEDIANRMSEEDLKA

SEQ ID NO: 13005 - protein, 8 aa, Neisseria
GVHKSAHG

SEQ ID NO: 13006 - protein, 12 aa, Neisseria
ATVKKTHKHTKA

SEQ ID NO: 13007 - protein, 5 aa, Neisseria
MNKNI

SEQ ID NO: 13008 - protein, 80 aa, Neisseria; identical to SEQ ID NO: 10274

SEQ ID NO: 13009 - protein, 7 aa, Neisseria
AANKPAS

SEQ ID NO: 13010 - protein, 7 aa, Neisseria
GVHKSAH

SEQ ID NO: 13011 - protein, 10 aa, Neisseria
GASKSAEGSC

SEQ ID NO: 13012 - protein, 15 aa, Neisseria
AGSKAGEGKCGEGKC

SEQ ID NO: 13013 - protein, 32 aa, Neisseria; identical to SEQ ID NO: 10279

SEQ ID NO: 13014 - protein, 8 aa, Neisseria
KMLTVLTA

SEQ ID NO: 13015 - protein, 18 aa, Neisseria
DMKQPKEVGKVFRKQQRY

SEQ ID NO: 13016 - protein, 6 aa, Neisseria
VGERVN

SEQ ID NO: 13017 - protein, 10 aa, Neisseria
WRQIEPIPGK

SEQ ID NO: 13018 - protein, 10 aa, Neisseria
HLDGLEEVLA

SEQ ID NO: 13019 - protein, 10 aa, Neisseria
AQKASKAVRR

SEQ ID NO: 13020 - protein, 7 aa, Neisseria
EHLPEAA

SEQ ID NO: 13021 - protein, 9 aa, Neisseria
GALQRLAKL

SEQ ID NO: 13022 - protein, 11 aa, Neisseria
KYPEILDGFFE

SEQ ID NO: 13023 - protein, 15 aa, Neisseria
MEIMNLVSLHRLDDA

SEQ ID NO: 13024 - protein, 8 aa, Neisseria
VIDGYAEK

SEQ ID NO: 13025 - protein, 6 aa, Neisseria
YGRGTE

SEQ ID NO: 13026 - protein, 6 aa, Neisseria
VRQWLK

SEQ ID NO: 13027 - protein, 15 aa, Neisseria
ALRQIGRVRKLPEQQ

SEQ ID NO: 13028 - protein, 6 aa, Neisseria
DNLSKI

SEQ ID NO: 13029 - protein, 5 aa, Neisseria
MLALS

SEQ ID NO: 13030 - protein, 12 aa, Neisseria
EALRGLDKIIEK

SEQ ID NO: 13031 - protein, 8 aa, Neisseria
SDLERAFR

SEQ ID NO: 13032 - protein, 5 aa, Neisseria
NLGYS

SEQ ID NO: 13033 - protein, 5 aa, Neisseria
HLGEV

SEQ ID NO: 13034 - protein, 6 aa, Neisseria
DVWTQA

SEQ ID NO: 13035 - protein, 5 aa, Neisseria
WRETL

SEQ ID NO: 13036 - protein, 37 aa, Neisseria
AAGGGAGDMKQPKEVGKVFRKQQRYSEEEIKNERARL

SEQ ID NO: 13037 - protein, 7 aa, Neisseria
AVGERVN

SEQ ID NO: 13038 - protein, 8 aa, Neisseria
TALQKGQA

SEQ ID NO: 13039 - protein, 14 aa, Neisseria
ERTKSPEVAERALE

SEQ ID NO: 13040 - protein, 48 aa, Neisseria
KWRQIEPIPGKAQKRAGWLRNVLRERGNQHLDGLEEVLAQADEGQNRR

SEQ ID NO: 13041 - protein, 20 aa, Neisseria
VQQDGLAQKASKAVRRAALK

SEQ ID NO: 13042 - protein, 9 aa, Neisseria
QGREKEKAI

SEQ ID NO: 13043 - protein, 11 aa, Neisseria
RLAKLDTEILP

SEQ ID NO: 13044 - protein, 21 aa, Neisseria
LTARKYPEILDGFFEQTDTQN

SEQ ID NO: 13045 - protein, 8 aa, Neisseria
HRLDDAYA

SEQ ID NO: 13046 - protein, 8 aa, Neisseria
LERNPNAD

SEQ ID NO: 13047 - protein, 8 aa, Neisseria
ANRKEGAS

SEQ ID NO: 13048 - protein, 18 aa, Neisseria
GYAEKAYGRGTEEQRSRA

SEQ ID NO: 13049 - protein, 9 aa, Neisseria
YADRRDYAK

SEQ ID NO: 13050 - protein, 8 aa, Neisseria
QWLKKVSA

SEQ ID NO: 13051 - protein, 6 aa, Neisseria
LFDKGV

SEQ ID NO: 13052 - protein, 10 aa, Neisseria
VELDGGRAAL

SEQ ID NO: 13053 - protein, 17 aa, Neisseria
QIGRVRKLPEQQGRYFT

SEQ ID NO: 13054 - protein, 29 aa, Neisseria
KLPDKREALRGLDKIIEKPPAGSNTELQA

SEQ ID NO: 13055 - protein, 22 aa, Neisseria
RLGKRKKMISDLERAFRLAPDN

SEQ ID NO: 13056 - protein, 10 aa, Neisseria
TDSKRLDEGF

SEQ ID NO: 13057 - protein, 12 aa, Neisseria
INPDDTAVNDSI

SEQ ID NO: 13058 - protein, 8 aa, Neisseria
LKGDAESA

SEQ ID NO: 13059 - protein, 12 aa, Neisseria
RYSFENDPEPEV

SEQ ID NO: 13060 - protein, 6 aa, Neisseria
GERDQA

SEQ ID NO: 13061 - protein, 29 aa, Neisseria
HLTGDKKIWRETLKRHGIALPQPSRKPRK

SEQ ID NO: 13062 - protein, 33 aa, Neisseria
GAGDMKQPKEVGKVFRKQQRYSEEEIKNERARL

SEQ ID NO: 13063 - protein, 7 aa, Neisseria
AVGERVN

SEQ ID NO: 13064 - protein, 8 aa, Neisseria
TALQKGQA

SEQ ID NO: 13065 - protein, 14 aa, Neisseria
ERTKSPEVAERALE

SEQ ID NO: 13066 - protein, 11 aa, Neisseria
IPGKAQKRAGW

SEQ ID NO: 13067 - protein, 9 aa, Neisseria
VLRERGNQH

SEQ ID NO: 13068 - protein, 17 aa, Neisseria
DGLEEVLAQADEGQNRR

SEQ ID NO: 13069 - protein, 16 aa, Neisseria
GLAQKASKAVRRAALK

SEQ ID NO: 13070 - protein, 9 aa, Neisseria
QGREKEKAI

SEQ ID NO: 13071 - protein, 9 aa, Neisseria
RLAKLDTEI

SEQ ID NO: 13072 - protein, 9 aa, Neisseria
LTARKYPEI

SEQ ID NO: 13073 - protein, 8 aa, Neisseria
FEQTDTQN

SEQ ID NO: 13074 - protein, 8 aa, Neisseria
HRLDDAYA

SEQ ID NO: 13075 - protein, 6 aa, Neisseria
LERNPN

SEQ ID NO: 13076 - protein, 8 aa, Neisseria
ANRKEGAS

SEQ ID NO: 13077 - protein, 17 aa, Neisseria
YAEKAYGRGTEEQRSRA

SEQ ID NO: 13078 - protein, 9 aa, Neisseria
YADRRDYAK

SEQ ID NO: 13079 - protein, 10 aa, Neisseria
VELDGGRAAL

SEQ ID NO: 13080 - protein, 13 aa, Neisseria
QIGRVRKLPEQQG

SEQ ID NO: 13081 - protein, 21 aa, Neisseria
KLPDKREALRGLDKIIEKPPA

SEQ ID NO: 13082 - protein, 7 aa, Neisseria
SNTELQA

SEQ ID NO: 13083 - protein, 22 aa, Neisseria
RLGKRKKMISDLERAFRLAPDN

SEQ ID NO: 13084 - protein, 8 aa, Neisseria
TDSKRLDE

SEQ ID NO: 13085 - protein, 7 aa, Neisseria
NPDDTAV

SEQ ID NO: 13086 - protein, 5 aa, Neisseria
GDAES

SEQ ID NO: 13087 - protein, 9 aa, Neisseria
FENDPEPEV

SEQ ID NO: 13088 - protein, 6 aa, Neisseria
GERDQA

SEQ ID NO: 13089 - protein, 15 aa, Neisseria
TGDKKIWRETLKRHG

SEQ ID NO: 13090 - protein, 8 aa, Neisseria
QPSRKPRK

SEQ ID NO: 13091 - protein, 12 aa, Neisseria
SVATLLNNFYGQ

SEQ ID NO: 13092 - protein, 6 aa, Neisseria
VLKKLD

SEQ ID NO: 13093 - protein, 7 aa, Neisseria
FEDMRRI

SEQ ID NO: 13094 - protein, 6 aa, Neisseria
EQLAQL

SEQ ID NO: 13095 - protein, 7 aa, Neisseria
SVLRGID

SEQ ID NO: 13096 - protein, 6 aa, Neisseria
AQFLDA

SEQ ID NO: 13097 - protein, 5 aa, Neisseria
KILAV

SEQ ID NO: 13098 - protein, 20 aa, Neisseria
QSWKARRDFNIVKQDLDFSC

SEQ ID NO: 13099 - protein, 33 aa, Neisseria
NFYGQTLTEEEVLKKLDKEQMRASFEDMRRIMP

SEQ ID NO: 13100 - protein, 8 aa, Neisseria
LGFEAKGY

SEQ ID NO: 13101 - protein, 10 aa, Neisseria
LKYRKDDHFS

SEQ ID NO: 13102 - protein, 7 aa, Neisseria
RGIDGNT

SEQ ID NO: 13103 - protein, 9 aa, Neisseria
WQTREGNLA

SEQ ID NO: 13104 - protein, 9 aa, Neisseria
IPKKAETIS

SEQ ID NO: 13105 - protein, 8 aa, Neisseria
QHPKRQTE

SEQ ID NO: 13106 - protein, 6 aa, Neisseria
RQARAE

SEQ ID NO: 13107 - protein, 17 aa, Neisseria
SWKARRDFNIVKQDLDF

SEQ ID NO: 13108 - protein, 27 aa, Neisseria
LTEEEVLKKLDKEQMRASFEDMRRIMP

SEQ ID NO: 13109 - protein, 7 aa, Neisseria
LGFEAKG

SEQ ID NO: 13110 - protein, 9 aa, Neisseria
KYRKDDHFS

SEQ ID NO: 13111 - protein, 8 aa, Neisseria
WQTREGNL

SEQ ID NO: 13112 - protein, 9 aa, Neisseria
IPKKAETIS

SEQ ID NO: 13113 - protein, 7 aa, Neisseria
HPKRQTE

SEQ ID NO: 13114 - protein, 6 aa, Neisseria
RQARAE

SEQ ID NO: 13115 - protein, 13 aa, Neisseria
NTSTNVGGFYGLT

SEQ ID NO: 13116 - protein, 21 aa, Neisseria
QSGSQHFTDHLKSADIFDAAQ

SEQ ID NO: 13117 - protein, 6 aa, Neisseria
GDFSTT

SEQ ID NO: 13118 - protein, 8 aa, Neisseria
YKVDEYHA

SEQ ID NO: 13119 - protein, 7 aa, Neisseria
FNTSTNV

SEQ ID NO: 13120 - protein, 14 aa, Neisseria
VEFDQAKRDGKIDI

SEQ ID NO: 13121 - protein, 5 aa, Neisseria
DHLKS

SEQ ID NO: 13122 - protein, 9 aa, Neisseria
QYPDIRFVS

SEQ ID NO: 13123 - protein, 11 aa, Neisseria
KFNFNGKKLVS

SEQ ID NO: 13124 - protein, 14 aa, Neisseria
MHGKTAPVKLKAEK

SEQ ID NO: 13125 - protein, 16 aa, Neisseria
NCYQSPMEKTEVCGGD

SEQ ID NO: 13126 - protein, 10 aa, Neisseria
STTIDRTKWG

SEQ ID NO: 13127 - protein, 5 aa, Neisseria
KSVRI

SEQ ID NO: 13128 - protein, 8 aa, Neisseria
IQIEAAKQ

SEQ ID NO: 13129 - protein, 8 aa, Neisseria
YKVDEYHA

SEQ ID NO: 13130 - protein, 14 aa, Neisseria
VEFDQAKRDGKIDI

SEQ ID NO: 13131 - protein, 5 aa, Neisseria
DHLKS

SEQ ID NO: 13132 - protein, 8 aa, Neisseria
FNGKKLVS

SEQ ID NO: 13133 - protein, 11 aa, Neisseria
KTAPVKLKAEK

SEQ ID NO: 13134 - protein, 9 aa, Neisseria
PMEKTEVCG

SEQ ID NO: 13135 - protein, 8 aa, Neisseria
TTIDRTKW

SEQ ID NO: 13136 - protein, 5 aa, Neisseria
KSVRI

SEQ ID NO: 13137 - protein, 8 aa, Neisseria
IQIEAAKQ

SEQ ID NO: 13138 - protein, 6 aa, Neisseria
RAARFR

SEQ ID NO: 13139 - protein, 13 aa, Neisseria
QGLGGDFERFLKG

SEQ ID NO: 13140 - protein, 11 aa, Neisseria
QENLAKYRENI

SEQ ID NO: 13141 - protein, 8 aa, Neisseria
PYRVCKQA

SEQ ID NO: 13142 - protein, 16 aa, Neisseria
YQNYRKSMQECRKTIT

SEQ ID NO: 13143 - protein, 11 aa, Neisseria
GQEQSQKADAE

SEQ ID NO: 13144 - protein, 8 aa, Neisseria
YQFADEKQ

SEQ ID NO: 13145 - protein, 27 aa, Neisseria
GLGGDFERFLKGEIPNQENLAKYRENI

SEQ ID NO: 13146 - protein, 14 aa, Neisseria
ADTNGDDDPYRVCK

SEQ ID NO: 13147 - protein, 9 aa, Neisseria
AAQDAEILM

SEQ ID NO: 13148 - protein, 40 aa, Neisseria
VTSGGGGTTDLDKESYQNYRKSMQECRKTITEAEANLPKK

SEQ ID NO: 13149 - protein, 11 aa, Neisseria
GQEQSQKADAE

SEQ ID NO: 13150 - protein, 7 aa, Neisseria
QFADEKQ

SEQ ID NO: 13151 - protein, 8 aa, Neisseria
GDFERFLK

SEQ ID NO: 13152 - protein, 15 aa, Neisseria
EIPNQENLAKYRENI

SEQ ID NO: 13153 - protein, 12 aa, Neisseria
TNGDDDPYRVCK

SEQ ID NO: 13154 - protein, 9 aa, Neisseria
AAQDAEILM

SEQ ID NO: 13155 - protein, 34 aa, Neisseria
GTTDLDKESYQNYRKSMQECRKTITEAEANLPKK

SEQ ID NO: 13156 - protein, 8 aa, Neisseria
SFFALVFA

SEQ ID NO: 13157 - protein, 8 aa, Neisseria
ATEVPKNP

SEQ ID NO: 13158 - protein, 13 aa, Neisseria
AFVAKLARLFRNA

SEQ ID NO: 13159 - protein, 8 aa, Neisseria
NLAGTVDD

SEQ ID NO: 13160 - protein, 13 aa, Neisseria
EDVYEHCLGCYQM

SEQ ID NO: 13161 - protein, 8 aa, Neisseria
YRDVANDE

SEQ ID NO: 13162 - protein, 6 aa, Neisseria
SNRIAS

SEQ ID NO: 13163 - protein, 9 aa, Neisseria
QNMRELMPR

SEQ ID NO: 13164 - protein, 13 aa, Neisseria
EKEVRRYAEAAAR

SEQ ID NO: 13165 - protein, 5 aa, Neisseria
INPRW

SEQ ID NO: 13166 - protein, 13 aa, Neisseria
LSDTATEVPKNPN

SEQ ID NO: 13167 - protein, 7 aa, Neisseria
FRNADRA

SEQ ID NO: 13168 - protein, 24 aa, Neisseria
ESIRTEENLAGTVDDGPLQSEKDY

SEQ ID NO: 13169 - protein, 10 aa, Neisseria
RLSRLKEKAK

SEQ ID NO: 13170 - protein, 7 aa, Neisseria
TEQEHGK

SEQ ID NO: 13171 - protein, 6 aa, Neisseria
HIGEGG

SEQ ID NO: 13172 - protein, 10 aa, Neisseria
LSQRSPEAFV

SEQ ID NO: 13173 - protein, 10 aa, Neisseria
YLYRNDRPFS

SEQ ID NO: 13174 - protein, 14 aa, Neisseria
VHGENYETTGEYRV

SEQ ID NO: 13175 - protein, 6 aa, Neisseria
QPDGSV

SEQ ID NO: 13176 - protein, 12 aa, Neisseria
AAGRGKIGEDVY

SEQ ID NO: 13177 - protein, 47 aa, Neisseria; identical to SEQ ID NO: 10703

SEQ ID NO: 13178 - protein, 10 aa, Neisseria
GYDADGLPQK

SEQ ID NO: 13179 - protein, 19 aa, Neisseria
SFDNGKKRQSFEYYLKNGN

SEQ ID NO: 13180 - protein, 7 aa, Neisseria
LKADGVT

SEQ ID NO: 13181 - protein, 19 aa, Neisseria
LDGGRIVREEKQGDRLPDF

SEQ ID NO: 13182 - protein, 26 aa, Neisseria
ENLEKEVRRYAEAAARRSGGRRDLSH

SEQ ID NO: 13183 - protein, 9 aa, Neisseria
TATEVPKNP

SEQ ID NO: 13184 - protein, 7 aa, Neisseria
FRNADRA

SEQ ID NO: 13185 - protein, 9 aa, Neisseria
ESIRTEENL

SEQ ID NO: 13186 - protein, 13 aa, Neisseria
TVDDGPLQSEKDY

SEQ ID NO: 13187 - protein, 10 aa, Neisseria
RLSRLKEKAK

SEQ ID NO: 13188 - protein, 7 aa, Neisseria
TEQEHGK

SEQ ID NO: 13189 - protein, 7 aa, Neisseria
LSQRSPE

SEQ ID NO: 13190 - protein, 7 aa, Neisseria
YRNDRPF

SEQ ID NO: 13191 - protein, 9 aa, Neisseria
ENYETTGEY

SEQ ID NO: 13192 - protein, 12 aa, Neisseria
AAGRGKIGEDVY

SEQ ID NO: 13193 - protein, 28 aa, Neisseria
KYRDVANDEQKVWDFRKESNRIASDSRN

SEQ ID NO: 13194 - protein, 11 aa, Neisseria
NMRELMPRGMK

SEQ ID NO: 13195 - protein, 7 aa, Neisseria
YDADGLP

SEQ ID NO: 13196 - protein, 8 aa, Neisseria
DNGKKRQS

SEQ ID NO: 13197 - protein, 7 aa, Neisseria
LKADGVT

SEQ ID NO: 13198 - protein, 15 aa, Neisseria
GGRIVREEKQGDRLP

SEQ ID NO: 13199 - protein, 26 aa, Neisseria
ENLEKEVRRYAEAAARRSGGRRDLSH

SEQ ID NO: 13200 - protein, 17 aa, Neisseria
DNPTAGESVRSVSEPIQ

SEQ ID NO: 13201 - protein, 10 aa, Neisseria
PEDYTRIVAD

SEQ ID NO: 13202 - protein, 6 aa, Neisseria
YDQSGD

SEQ ID NO: 13203 - protein, 13 aa, Neisseria
GRRLQSVSRTAEM

SEQ ID NO: 13204 - protein, 6 aa, Neisseria
ISDTLQ

SEQ ID NO: 13205 - protein, 7 aa, Neisseria
YYSLNRF

SEQ ID NO: 13206 - protein, 7 aa, Neisseria
SQEARRV

SEQ ID NO: 13207 - protein, 5 aa, Neisseria
TLPIV

SEQ ID NO: 13208 - protein, 11 aa, Neisseria
GEVLQTLEPRL

SEQ ID NO: 13209 - protein, 8 aa, Neisseria
QNDLPNFD

SEQ ID NO: 13210 - protein, 12 aa, Neisseria
NTANSLSAAVQS

SEQ ID NO: 13211 - protein, 5 aa, Neisseria
VGKKP

SEQ ID NO: 13212 - protein, 5 aa, Neisseria
DKLSQ

SEQ ID NO: 13213 - protein, 5 aa, Neisseria
KKPIE

SEQ ID NO: 13214 - protein, 9 aa, Neisseria
DLSSVGRNP

SEQ ID NO: 13215 - protein, 23 aa, Neisseria
VAAEETDNPTAGESVRSVSEPIQ

SEQ ID NO: 13216 - protein, 5 aa, Neisseria
SLGST

SEQ ID NO: 13217 - protein, 47 aa, Neisseria
CSNESGSPERTEAAVQGSGEASIPEDYTRIVADRMEGQSQVQVRAEG

SEQ ID NO: 13218 - protein, 11 aa, Neisseria
VVVERNRTTLN

SEQ ID NO: 13219 - protein, 32 aa, Neisseria
DWADYDQSGDTVTAGDRFALQQDGTLIRGETL

SEQ ID NO: 13220 - protein, 54 aa, Neisseria
LEQQTGEAHNVRMEIEQGGRRLQSVSRTAEMLGEGHYKLTETQFNTCSAGDAGW

SEQ ID NO: 13221 - protein, 12 aa, Neisseria
ASVEADREKGIG

SEQ ID NO: 13222 - protein, 11 aa, Neisseria
FPLDGNRKSGL

SEQ ID NO: 13223 - protein, 7 aa, Neisseria
SAGSDGV

SEQ ID NO: 13224 - protein, 25 aa, Neisseria
VIGERGAVFDGQVRYLRPDYAGQSD

SEQ ID NO: 13225 - protein, 15 aa, Neisseria
LPHDKKSGRNNRYQA

SEQ ID NO: 13226 - protein, 11 aa, Neisseria
WQHRHDISDTL

SEQ ID NO: 13227 - protein, 31 aa, Neisseria
DFNQVSDSGYYRDFYGNKEIAGNVNLNRRVW

SEQ ID NO: 13228 - protein, 11 aa, Neisseria
DYGGRAAGGSL

SEQ ID NO: 13229 - protein, 11 aa, Neisseria
ANQSGYKDKPY

SEQ ID NO: 13230 - protein, 10 aa, Neisseria
VEWRKNTGRA

SEQ ID NO: 13231 - protein, 12 aa, Neisseria
RFSHDSRQDGSR

SEQ ID NO: 13232 - protein, 12 aa, Neisseria
PDIKWDFSNSWG

SEQ ID NO: 13233 - protein, 13 aa, Neisseria
NRFGSQEARRVSR

SEQ ID NO: 13234 - protein, 14 aa, Neisseria
DSGATFERNTRMFG

SEQ ID NO: 13235 - protein, 18 aa, Neisseria
AKSQNDLPNFDSSESSFG

SEQ ID NO: 13236 - protein, 17 aa, Neisseria
FRENLYYGNDRINTANS

SEQ ID NO: 13237 - protein, 46 aa, Neisseria
VQSRILDGATGEERFRAGIGQKFYFKDDAVMLDGSVGKKPRNRSDW

SEQ ID NO: 13238 - protein, 6 aa, Neisseria
SGSIGS

SEQ ID NO: 13239 - protein, 14 aa, Neisseria
SSIHYNQNDKRAEN

SEQ ID NO: 13240 - protein, 32 aa, Neisseria
ASYRPAQGKVLNARYKYGRNEKIYLKSDGSYF

SEQ ID NO: 13241 - protein, 5 aa, Neisseria
DKLSQ

SEQ ID NO: 13242 - protein, 10 aa, Neisseria
YGFEAKKPIE

SEQ ID NO: 13243 - protein, 10 aa, Neisseria
AEYKSSCGCW

SEQ ID NO: 13244 - protein, 9 aa, Neisseria
VTGENTYKN

SEQ ID NO: 13245 - protein, 18 aa, Neisseria
QLKDLSSVGRNPADRMDV

SEQ ID NO: 13246 - protein, 9 aa, Neisseria
LSAGRNKRP

SEQ ID NO: 13247 - protein, 23 aa, Neisseria
VAAEETDNPTAGESVRSVSEPIQ

SEQ ID NO: 13248 - protein, 13 aa, Neisseria
NESGSPERTEAAV

SEQ ID NO: 13249 - protein, 12 aa, Neisseria
GSGEASIPEDYT

SEQ ID NO: 13250 - protein, 9 aa, Neisseria
VADRMEGQS

SEQ ID NO: 13251 - protein, 7 aa, Neisseria
VQVRAEG

SEQ ID NO: 13252 - protein, 10 aa, Neisseria
VVVERNRTTL

SEQ ID NO: 13253 - protein, 18 aa, Neisseria
ADYDQSGDTVTAGDRFAL

SEQ ID NO: 13254 - protein, 7 aa, Neisseria
TLIRGET

SEQ ID NO: 13255 - protein, 31 aa, Neisseria
QQTGEAHNVRMEIEQGGRRLQSVSRTAEMLG

SEQ ID NO: 13256 - protein, 7 aa, Neisseria
GHYKLTE

SEQ ID NO: 13257 - protein, 12 aa, Neisseria
ASVEADREKGIG

SEQ ID NO: 13258 - protein, 9 aa, Neisseria
PLDGNRKSG

SEQ ID NO: 13259 - protein, 6 aa, Neisseria
AGSDGV

SEQ ID NO: 13260 - protein, 7 aa, Neisseria
IGERGAV

SEQ ID NO: 13261 - protein, 5 aa, Neisseria
VRYLR

SEQ ID NO: 13262 - protein, 13 aa, Neisseria
HDKKSGRNNRYQA

SEQ ID NO: 13263 - protein, 9 aa, Neisseria
WQHRHDISD

SEQ ID NO: 13264 - protein, 8 aa, Neisseria
SGYKDKPY

SEQ ID NO: 13265 - protein, 10 aa, Neisseria
VEWRKNTGRA

SEQ ID NO: 13266 - protein, 11 aa, Neisseria
FSHDSRQDGSR

SEQ ID NO: 13267 - protein, 10 aa, Neisseria
GSQEARRVSR

SEQ ID NO: 13268 - protein, 8 aa, Neisseria
ATFERNTR

SEQ ID NO: 13269 - protein, 5 aa, Neisseria
KSQND

SEQ ID NO: 13270 - protein, 5 aa, Neisseria
DSSES

SEQ ID NO: 13271 - protein, 5 aa, Neisseria
DRINT

SEQ ID NO: 13272 - protein, 9 aa, Neisseria
ATGEERFRA

SEQ ID NO: 13273 - protein, 8 aa, Neisseria
YFKDDAVM

SEQ ID NO: 13274 - protein, 11 aa, Neisseria
SVGKKPRNRSD

SEQ ID NO: 13275 - protein, 8 aa, Neisseria
QNDKRAEN

SEQ ID NO: 13276 - protein, 5 aa, Neisseria
YRPAQ

SEQ ID NO: 13277 - protein, 15 aa, Neisseria
YKYGRNEKIYLKSDG

SEQ ID NO: 13278 - protein, 8 aa, Neisseria
FEAKKPIE

SEQ ID NO: 13279 - protein, 5 aa, Neisseria
AEYKS

SEQ ID NO: 13280 - protein, 18 aa, Neisseria
QLKDLSSVGRNPADRMDV

SEQ ID NO: 13281 - protein, 8 aa, Neisseria
SAGRNKRP

SEQ ID NO: 13282 - protein, 8 aa, Neisseria
AALARVGG

SEQ ID NO: 13283 - protein, 13 aa, Neisseria
AHHDGHGDDDHGH

SEQ ID NO: 13284 - protein, 12 aa, Neisseria
AHQHNKQDKIIS

SEQ ID NO: 13285 - protein, 8 aa, Neisseria
AQAEKAAL

SEQ ID NO: 13286 - protein, 31 aa, Neisseria; identical to SEQ ID NO: 10983

SEQ ID NO: 13287 - protein, 15 aa, Neisseria
VDARTGRVISSRRDD

SEQ ID NO: 13288 - protein, 10 aa, Neisseria
DGHGDDDHGH

SEQ ID NO: 13289 - protein, 10 aa, Neisseria
QHNKQDKIIS

SEQ ID NO: 13290 - protein, 8 aa, Neisseria
AQAEKAAL

SEQ ID NO: 13291 - protein, 19 aa, Neisseria
VGGKITDIDLEHDNGRPHY

SEQ ID NO: 13292 - protein, 9 aa, Neisseria
EIVKNGQEY

SEQ ID NO: 13293 - protein, 7 aa, Neisseria
VDARTGR

SEQ ID NO: 13294 - protein, 7 aa, Neisseria
ISSRRDD

SEQ ID NO: 13295 - protein, 11 aa, Neisseria
APRLLPSFTDP

SEQ ID NO: 13296 - protein, 9 aa, Neisseria
LSAPGGYIV

SEQ ID NO: 13297 - protein, 23 aa, Neisseria
IEKLAKQPEYAYLKQLQVAKNVN

SEQ ID NO: 13298 - protein, 6 aa, Neisseria
FASLAS

SEQ ID NO: 13299 - protein, 14 aa, Neisseria
DVGKTLKELGRSRT

SEQ ID NO: 13300 - protein, 6 aa, Neisseria
LATWSE

SEQ ID NO: 13301 - protein, 10 aa, Neisseria
NILAALVNTA

SEQ ID NO: 13302 - protein, 5 aa, Neisseria
SKIKG

SEQ ID NO: 13303 - protein, 11 aa, Neisseria
HKIAHAVAGCA

SEQ ID NO: 13304 - protein, 12 aa, Neisseria
AIGAAVGEIVGE

SEQ ID NO: 13305 - protein, 6 aa, Neisseria
ITAYAK

SEQ ID NO: 13306 - protein, 6 aa, Neisseria
QTAQNA

SEQ ID NO: 13307 - protein, 10 aa, Neisseria
ENNAVKAVVT

SEQ ID NO: 13308 - protein, 8 aa, Neisseria
VYKVARKG

SEQ ID NO: 13309 - protein, 11 aa, Neisseria
NLADNLTTLFD

SEQ ID NO: 13310 - protein, 16 aa, Neisseria
NRANKGEAAQKVKEVL

SEQ ID NO: 13311 - protein, 6 aa, Neisseria
KQLAQI

SEQ ID NO: 13312 - protein, 11 aa, Neisseria
LYRRGSVKPPL

SEQ ID NO: 13313 - protein, 11 aa, Neisseria
EAPRLLPSFTD

SEQ ID NO: 13314 - protein, 9 aa, Neisseria
VVPKLSAPG

SEQ ID NO: 13315 - protein, 19 aa, Neisseria
DIPKGNLKTEIEKLAKQPE

SEQ ID NO: 13316 - protein, 5 aa, Neisseria
KNVNW

SEQ ID NO: 13317 - protein, 13 aa, Neisseria
AYDKWDYKQEGLT

SEQ ID NO: 13318 - protein, 20 aa, Neisseria
NNKGDVGKTLKELGRSRTVK

SEQ ID NO: 13319 - protein, 7 aa, Neisseria
VSNKLGA

SEQ ID NO: 13320 - protein, 5 aa, Neisseria
SETPW

SEQ ID NO: 13321 - protein, 11 aa, Neisseria
VNGGSLKDNLE

SEQ ID NO: 13322 - protein, 13 aa, Neisseria
AHGEAASKIKGLD

SEQ ID NO: 13323 - protein, 11 aa, Neisseria
AANKGKCQDGA

SEQ ID NO: 13324 - protein, 22 aa, Neisseria
ALVKNTDFSDMTPEQLDLEVKK

SEQ ID NO: 13325 - protein, 7 aa, Neisseria
TGGDVNT

SEQ ID NO: 13326 - protein, 27 aa, Neisseria
VARKGLKNGKINVRDLKQTLKDEGYNL

SEQ ID NO: 13327 - protein, 10 aa, Neisseria
ETLDWNDAKA

SEQ ID NO: 13328 - protein, 33 aa, Neisseria
TELNRANKGEAAQKVKEVLEKNRPYIPNKGAVP

SEQ ID NO: 13329 - protein, 11 aa, Neisseria
TYMKNNPFGKQ

SEQ ID NO: 13330 - protein, 14 aa, Neisseria
ISEKTTLPTQQGQS

SEQ ID NO: 13331 - protein, 23 aa, Neisseria
KRNQGLLKTGDRFYLDGQHKNHL

SEQ ID NO: 13332 - protein, 9 aa, Neisseria
VFDKNGNFK

SEQ ID NO: 13333 - protein, 20 aa, Neisseria
MDGSLNQMKTGAAKGRKLNL

SEQ ID NO: 13334 - protein, 6 aa, Neisseria
RRGSVK

SEQ ID NO: 13335 - protein, 18 aa, Neisseria
IPKGNLKTEIEKLAKQPE

SEQ ID NO: 13336 - protein, 11 aa, Neisseria
DKWDYKQEGLT

SEQ ID NO: 13337 - protein, 20 aa, Neisseria
NNKGDVGKTLKELGRSRTVK

SEQ ID NO: 13338 - protein, 8 aa, Neisseria
GSLKDNLE

SEQ ID NO: 13339 - protein, 13 aa, Neisseria
AHGEAASKIKGLD

SEQ ID NO: 13340 - protein, 9 aa, Neisseria
AANKGKCQD

SEQ ID NO: 13341 - protein, 22 aa, Neisseria
ALVKNTDFSDMTPEQLDLEVKK

SEQ ID NO: 13342 - protein, 26 aa, Neisseria
VARKGLKNGKINVRDLKQTLKDEGYN

SEQ ID NO: 13343 - protein, 10 aa, Neisseria
ETLDWNDAKA

SEQ ID NO: 13344 - protein, 23 aa, Neisseria
ELNRANKGEAAQKVKEVLEKNRP

SEQ ID NO: 13345 - protein, 7 aa, Neisseria
ISEKTTL

SEQ ID NO: 13346 - protein, 5 aa, Neisseria
KRNQG

SEQ ID NO: 13347 - protein, 6 aa, Neisseria
GQHKNH

SEQ ID NO: 13348 - protein, 7 aa, Neisseria
VFDKNGN

SEQ ID NO: 13349 - protein, 5 aa, Neisseria
GSLNQ

SEQ ID NO: 13350 - protein, 12 aa, Neisseria
KTGAAKGRKLNL

SEQ ID NO: 13351 - protein, 5 aa, Neisseria
FPSKV

SEQ ID NO: 13352 - protein, 10 aa, Neisseria
TAILATFCSG

SEQ ID NO: 13353 - protein, 17 aa, Neisseria
NGQEINGFKAGETIYDI

SEQ ID NO: 13354 - protein, 10 aa, Neisseria
KVVTNLTKTV

SEQ ID NO: 13355 - protein, 5 aa, Neisseria
EKLTT

SEQ ID NO: 13356 - protein, 19 aa, Neisseria
LDETTNALNKLGENITTFA

SEQ ID NO: 13357 - protein, 23 aa, Neisseria
LEAVADTVDKHAEAFNDIADSLD

SEQ ID NO: 13358 - protein, 14 aa, Neisseria
EAVKTANEAKQTAE

SEQ ID NO: 13359 - protein, 21 aa, Neisseria
ARIDSLDKNVANLRKETRQGL

SEQ ID NO: 13360 - protein, 9 aa, Neisseria
SGLFQPYNV

SEQ ID NO: 13361 - protein, 10 aa, Neisseria
TSDDDVKKAA

SEQ ID NO: 13362 - protein, 14 aa, Neisseria
NNGQEINGFKAGET

SEQ ID NO: 13363 - protein, 25 aa, Neisseria
YDIGEDGTITQKDATAADVEADDFK

SEQ ID NO: 13364 - protein, 56 aa, Neisseria
TVNENKQNVDAKVKAAESEIEKLTTKLADTDAALADTDAALDETTNALNKLGENIT

SEQ ID NO: 13365 - protein, 83 aa, Neisseria
FAEETKTNIVKIDEKLEAVADTVDKHAEAFNDIADSLDETNTKADEAVKTANEAKQTAEETKQNVDAKVKAAETAAGKAEAAA

SEQ ID NO: 13366 - protein, 13 aa, Neisseria
TANTAADKAEAVA

SEQ ID NO: 13367 - protein, 42 aa, Neisseria
KVTDIKADIATNKADIAKNSARIDSLDKNVANLRKETRQGLA

SEQ ID NO: 13368 - protein, 8 aa, Neisseria
VGGYKSES

SEQ ID NO: 13369 - protein, 5 aa, Neisseria
TGFRF

SEQ ID NO: 13370 - protein, 7 aa, Neisseria
TSSGSSA

SEQ ID NO: 13371 - protein, 10 aa, Neisseria
TSDDDVKKAA

SEQ ID NO: 13372 - protein, 5 aa, Neisseria
KAGET

SEQ ID NO: 13373 - protein, 23 aa, Neisseria
IGEDGTITQKDATAADVEADDFK

SEQ ID NO: 13374 - protein, 47 aa, Neisseria
TVNENKQNVDAKVKAAESEIEKLTTKLADTDAALADTDAALDETTNA

SEQ ID NO: 13375 - protein, 10 aa, Neisseria
TAADKAEAVA

SEQ ID NO: 13376 - protein, 42 aa, Neisseria; identical to SEQ ID NO: 13367

SEQ ID NO: 13377 - protein, 5 aa, Neisseria
YKSES

SEQ ID NO: 13378 - protein, 13 aa, Neisseria
SSERMSEVEYFSH

SEQ ID NO: 13379 - protein, 8 aa, Neisseria
RKLEEILG

SEQ ID NO: 13380 - protein, 12 aa, Neisseria
RGNKFYESMYRL

SEQ ID NO: 13381 - protein, 6 aa, Neisseria
LDDSIR

SEQ ID NO: 13382 - protein, 8 aa, Neisseria
FVRVYEKG

SEQ ID NO: 13383 - protein, 11 aa, Neisseria
ICRKFKNMPVP

SEQ ID NO: 13384 - protein, 9 aa, Neisseria
NAVGKLVNF

SEQ ID NO: 13385 - protein, 8 aa, Neisseria
EIVESLKA

SEQ ID NO: 13386 - protein, 7 aa, Neisseria
GFPKGLE

SEQ ID NO: 13387 - protein, 9 aa, Neisseria
LEMLRDGLK

SEQ ID NO: 13388 - protein, 7 aa, Neisseria
NSDKFDR

SEQ ID NO: 13389 - protein, 21 aa, Neisseria
LTNRGGAKLKTNSKSSERMSE

SEQ ID NO: 13390 - protein, 21 aa, Neisseria
ISDGKGKLLEIPQRRGKQDGV

SEQ ID NO: 13391 - protein, 7 aa, Neisseria
TLLKVSG

SEQ ID NO: 13392 - protein, 5 aa, Neisseria
RKLEE

SEQ ID NO: 13393 - protein, 14 aa, Neisseria
ITRKCKSRGNKFYE

SEQ ID NO: 13394 - protein, 12 aa, Neisseria
MYRLGSDDVDYG

SEQ ID NO: 13395 - protein, 9 aa, Neisseria
HFGGQRNTV

SEQ ID NO: 13396 - protein, 6 aa, Neisseria
LKGTGC

SEQ ID NO: 13397 - protein, 13 aa, Neisseria
QFLDDSIRTRITR

SEQ ID NO: 13398 - protein, 32 aa, Neisseria
FDGEYTPDQALLDHDNGFFDNSNQRPKSETIG

SEQ ID NO: 13399 - protein, 10 aa, Neisseria
AWRNEDGSGK

SEQ ID NO: 13400 - protein, 10 aa, Neisseria
YVGRKKNSRF

SEQ ID NO: 13401 - protein, 17 aa, Neisseria
RVYEKGRQLGDKESKWV

SEQ ID NO: 13402 - protein, 7 aa, Neisseria
NYGDIEI

SEQ ID NO: 13403 - protein, 5 aa, Neisseria
INQGS

SEQ ID NO: 13404 - protein, 21 aa, Neisseria
ICRKFKNMPVPERFDQRKKKL

SEQ ID NO: 13405 - protein, 27 aa, Neisseria
GFDNSEIVESLKADSGFPKGLEPEKYA

SEQ ID NO: 13406 - protein, 7 aa, Neisseria
MLRDGLK

SEQ ID NO: 13407 - protein, 14 aa, Neisseria
HEQPDIDLEIELDE

SEQ ID NO: 13408 - protein, 30 aa, Neisseria
FKNSDKFDREKRLFSPDYDVEKERKYQEYL

SEQ ID NO: 13409 - protein, 6 aa, Neisseria
VDYDYF

SEQ ID NO: 13410 - protein, 21 aa, Neisseria
LTNRGGAKLKTNSKSSERMSE

SEQ ID NO: 13411 - protein, 20 aa, Neisseria
SDGKGKLLEIPQRRGKQDGV

SEQ ID NO: 13412 - protein, 5 aa, Neisseria
RKLEE

SEQ ID NO: 13413 - protein, 13 aa, Neisseria
ITRKCKSRGNKFY

SEQ ID NO: 13414 - protein, 9 aa, Neisseria
LGSDDVDYG

SEQ ID NO: 13415 - protein, 5 aa, Neisseria
LKGTG

SEQ ID NO: 13416 - protein, 13 aa, Neisseria
QFLDDSIRTRITR

SEQ ID NO: 13417 - protein, 9 aa, Neisseria
ALLDHDNGF

SEQ ID NO: 13418 - protein, 10 aa, Neisseria
SNQRPKSETI

SEQ ID NO: 13419 - protein, 8 aa, Neisseria
WRNEDGSG

SEQ ID NO: 13420 - protein, 8 aa, Neisseria
GRKKNSRF

SEQ ID NO: 13421 - protein, 17 aa, Neisseria
RVYEKGRQLGDKESKWV

SEQ ID NO: 13422 - protein, 5 aa, Neisseria
RKFKN

SEQ ID NO: 13423 - protein, 13 aa, Neisseria
PVPERFDQRKKKL

SEQ ID NO: 13424 - protein, 17 aa, Neisseria
GFDNSEIVESLKADSGF

SEQ ID NO: 13425 - protein, 9 aa, Neisseria
KGLEPEKYA

SEQ ID NO: 13426 - protein, 7 aa, Neisseria
MLRDGLK

SEQ ID NO: 13427 - protein, 13 aa, Neisseria
EQPDIDLEIELDE

SEQ ID NO: 13428 - protein, 13 aa, Neisseria
KNSDKFDREKRLF

SEQ ID NO: 13429 - protein, 14 aa, Neisseria
DYDVEKERKYQEYL

SEQ ID NO: 13430 - protein, 24 aa, Neisseria
ERLIARLAREPDSAEDVLNLLRQA

SEQ ID NO: 13431 - protein, 12 aa, Neisseria
DTLLRLEKVLDF

SEQ ID NO: 13432 - protein, 9 aa, Neisseria
DSIERITAY

SEQ ID NO: 13433 - protein, 6 aa, Neisseria
DLLKYM

SEQ ID NO: 13434 - protein, 9 aa, Neisseria
ALLKEFREQ

SEQ ID NO: 13435 - protein, 14 aa, Neisseria
FEDIIEQIVGEIED

SEQ ID NO: 13436 - protein, 5 aa, Neisseria
NIHAV

SEQ ID NO: 13437 - protein, 10 aa, Neisseria
ATEIEDINTF

SEQ ID NO: 13438 - protein, 5 aa, Neisseria
IQELG

SEQ ID NO: 13439 - protein, 10 aa, Neisseria
MDGAQPKTNF

SEQ ID NO: 13440 - protein, 11 aa, Neisseria
LAREPDSAEDV

SEQ ID NO: 13441 - protein, 12 aa, Neisseria
QAHEQEVFDADT

SEQ ID NO: 13442 - protein, 8 aa, Neisseria
LRLEKVLD

SEQ ID NO: 13443 - protein, 26 aa, Neisseria
SDLEVRDAMITRSRMNVLKENDSIER

SEQ ID NO: 13444 - protein, 9 aa, Neisseria
VIGEDKDEV

SEQ ID NO: 13445 - protein, 7 aa, Neisseria
FNPEQFH

SEQ ID NO: 13446 - protein, 5 aa, Neisseria
PEGKS

SEQ ID NO: 13447 - protein, 9 aa, Neisseria
KEFREQRNH

SEQ ID NO: 13448 - protein, 9 aa, Neisseria
IDEYGGTSG

SEQ ID NO: 13449 - protein, 17 aa, Neisseria
IVGEIEDEFDEDDSADN

SEQ ID NO: 13450 - protein, 6 aa, Neisseria
SSERWR

SEQ ID NO: 13451 - protein, 7 aa, Neisseria
TEIEDIN

SEQ ID NO: 13452 - protein, 12 aa, Neisseria
FGTEYSSEEADT

SEQ ID NO: 13453 - protein, 11 aa, Neisseria
GHLPVRGEKVL

SEQ ID NO: 13454 - protein, 9 aa, Neisseria
ARADNRRLH

SEQ ID NO: 13455 - protein, 7 aa, Neisseria
MDGAQPK

SEQ ID NO: 13456 - protein, 11 aa, Neisseria
LAREPDSAEDV

SEQ ID NO: 13457 - protein, 9 aa, Neisseria
QAHEQEVFD

SEQ ID NO: 13458 - protein, 8 aa, Neisseria
LRLEKVLD

SEQ ID NO: 13459 - protein, 26 aa, Neisseria
SDLEVRDAMITRSRMNVLKENDSIER

SEQ ID NO: 13460 - protein, 9 aa, Neisseria
VIGEDKDEV

SEQ ID NO: 13461 - protein, 5 aa, Neisseria
PEGKS

SEQ ID NO: 13462 - protein, 8 aa, Neisseria
KEFREQRN

SEQ ID NO: 13463 - protein, 17 aa, Neisseria
IVGEIEDEFDEDDSADN

SEQ ID NO: 13464 - protein, 6 aa, Neisseria
SSERWR

SEQ ID NO: 13465 - protein, 5 aa, Neisseria
TEIED

SEQ ID NO: 13466 - protein, 8 aa, Neisseria
YSSEEADT

SEQ ID NO: 13467 - protein, 7 aa, Neisseria
VRGEKVL

SEQ ID NO: 13468 - protein, 9 aa, Neisseria
ARADNRRLH

SEQ ID NO: 13469 - protein, 11 aa, Neisseria
ANPDKVYRVAS

SEQ ID NO: 13470 - protein, 7 aa, Neisseria
APFESLD

SEQ ID NO: 13471 - protein, 5 aa, Neisseria
NAMAK

SEQ ID NO: 13472 - protein, 17 aa, Neisseria
KVSSSEDLKNMNKVGVV

SEQ ID NO: 13473 - protein, 6 aa, Neisseria
KIARFE

SEQ ID NO: 13474 - protein, 10 aa, Neisseria
LENGGLDSVV

SEQ ID NO: 13475 - protein, 8 aa, Neisseria
ANYVKNNP

SEQ ID NO: 13476 - protein, 8 aa, Neisseria
GMDFVTLP

SEQ ID NO: 13477 - protein, 17 aa, Neisseria
VKMLNDALEKVRESGEY

SEQ ID NO: 13478 - protein, 10 aa, Neisseria
CGGQGKDTAA

SEQ ID NO: 13479 - protein, 8 aa, Neisseria
ANPDKVYR

SEQ ID NO: 13480 - protein, 13 aa, Neisseria
ESLDSKGNVEGFD

SEQ ID NO: 13481 - protein, 10 aa, Neisseria
IEFKHQPWDS

SEQ ID NO: 13482 - protein, 8 aa, Neisseria
LNNGDADV

SEQ ID NO: 13483 - protein, 16 aa, Neisseria
ITDDRKQSMDFSDPYF

SEQ ID NO: 13484 - protein, 18 aa, Neisseria
VPKGKKVSSSEDLKNMNK

SEQ ID NO: 13485 - protein, 11 aa, Neisseria
LLGNDNPKIAR

SEQ ID NO: 13486 - protein, 16 aa, Neisseria
KELENGGLDSVVSDSA

SEQ ID NO: 13487 - protein, 10 aa, Neisseria
KNNPAKGMDF

SEQ ID NO: 13488 - protein, 5 aa, Neisseria
PDFTT

SEQ ID NO: 13489 - protein, 9 aa, Neisseria
VRKGDEATV

SEQ ID NO: 13490 - protein, 19 aa, Neisseria
MLNDALEKVRESGEYDKIY

SEQ ID NO: 13491 - protein, 10 aa, Neisseria
FAKEDGQAAK

SEQ ID NO: 13492 - protein, 8 aa, Neisseria
GQGKDTAA

SEQ ID NO: 13493 - protein, 8 aa, Neisseria
ANPDKVYR

SEQ ID NO: 13494 - protein, 13 aa, Neisseria
ESLDSKGNVEGFD

SEQ ID NO: 13495 - protein, 7 aa, Neisseria
NNGDADV

SEQ ID NO: 13496 - protein, 12 aa, Neisseria
ITDDRKQSMDFS

SEQ ID NO: 13497 - protein, 16 aa, Neisseria
PKGKKVSSSEDLKNMN

SEQ ID NO: 13498 - protein, 7 aa, Neisseria
DNPKIAR

SEQ ID NO: 13499 - protein, 8 aa, Neisseria
KELENGGL

SEQ ID NO: 13500 - protein, 7 aa, Neisseria
NPAKGMD

SEQ ID NO: 13501 - protein, 9 aa, Neisseria
VRKGDEATV

SEQ ID NO: 13502 - protein, 19 aa, Neisseria
MLNDALEKVRESGEYDKIY

SEQ ID NO: 13503 - protein, 10 aa, Neisseria
FAKEDGQAAK

SEQ ID NO: 13504 - protein, 16 aa, Neisseria
VRQKMVNGVNILANAV

SEQ ID NO: 13505 - protein, 11 aa, Neisseria
AQMVKEVASKT

SEQ ID NO: 13506 - protein, 7 aa, Neisseria
VAEGMKY

SEQ ID NO: 13507 - protein, 35 aa, Neisseria
DLKRGIDKAVAALVDELKNIAKPCDTSKEIAQVGS

SEQ ID NO: 13508 - protein, 11 aa, Neisseria
AIIAEAMEKVG

SEQ ID NO: 13509 - protein, 9 aa, Neisseria
NELDVVEGM

SEQ ID NO: 13510 - protein, 6 aa, Neisseria
EKQIAA

SEQ ID NO: 13511 - protein, 17 aa, Neisseria
ISNIRDLLPVLEQVAKA

SEQ ID NO: 13512 - protein, 11 aa, Neisseria
NNIRGILKTVA

SEQ ID NO: 13513 - protein, 11 aa, Neisseria
TLDDLGQAKRI

SEQ ID NO: 13514 - protein, 10 aa, Neisseria
TIIDGFGDAA

SEQ ID NO: 13515 - protein, 10 aa, Neisseria
ERVAKLAGGV

SEQ ID NO: 13516 - protein, 6 aa, Neisseria
LENLHT

SEQ ID NO: 13517 - protein, 15 aa, Neisseria
LRAVESPLRQIVANA

SEQ ID NO: 13518 - protein, 8 aa, Neisseria
EYGDMIEM

SEQ ID NO: 13519 - protein, 5 aa, Neisseria
TRSAL

SEQ ID NO: 13520 - protein, 8 aa, Neisseria
MAAKDVQF

SEQ ID NO: 13521 - protein, 9 aa, Neisseria
NEVRQKMVN

SEQ ID NO: 13522 - protein, 11 aa, Neisseria
TLGPKGRNVVV

SEQ ID NO: 13523 - protein, 28 aa, Neisseria
AFGGPHITKDGVTVAKEIELKDKFENMG

SEQ ID NO: 13524 - protein, 18 aa, Neisseria
MVKEVASKTNDVAGDGTT

SEQ ID NO: 13525 - protein, 13 aa, Neisseria
NPTDLKRGIDKAV

SEQ ID NO: 13526 - protein, 17 aa, Neisseria
DELKNIAKPCDTSKEIA

SEQ ID NO: 13527 - protein, 9 aa, Neisseria
ISANSDEQV

SEQ ID NO: 13528 - protein, 26 aa, Neisseria
EAMEKVGKEGVITVEDGKSLENELDV

SEQ ID NO: 13529 - protein, 7 aa, Neisseria
MQFDRGY

SEQ ID NO: 13530 - protein, 7 aa, Neisseria
DAEKQIA

SEQ ID NO: 13531 - protein, 10 aa, Neisseria
FDKKISNIRD

SEQ ID NO: 13532 - protein, 7 aa, Neisseria
QVAKASR

SEQ ID NO: 13533 - protein, 7 aa, Neisseria
EDVEGEA

SEQ ID NO: 13534 - protein, 6 aa, Neisseria
NIRGIL

SEQ ID NO: 13535 - protein, 12 aa, Neisseria
APGFGDRRKAML

SEQ ID NO: 13536 - protein, 29 aa, Neisseria
EEVGLSLEKATLDDLGQAKRIEIGKENTT

SEQ ID NO: 13537 - protein, 41 aa, Neisseria
DGFGDAAQIEARVAEIRQQIETATSDYDKEKLQERVAKLAG

SEQ ID NO: 13538 - protein, 17 aa, Neisseria
TEVEMKEKKDRVEDALH

SEQ ID NO: 13539 - protein, 7 aa, Neisseria
AAVEEGV

SEQ ID NO: 13540 - protein, 6 aa, Neisseria
RARAAL

SEQ ID NO: 13541 - protein, 11 aa, Neisseria
HTGNADQDAGV

SEQ ID NO: 13542 - protein, 7 aa, Neisseria
AVESPLR

SEQ ID NO: 13543 - protein, 10 aa, Neisseria
VANAGGEPSV

SEQ ID NO: 13544 - protein, 10 aa, Neisseria
VLEGKGNYGY

SEQ ID NO: 13545 - protein, 11 aa, Neisseria
AGSGEYGDMIE

SEQ ID NO: 13546 - protein, 10 aa, Neisseria
DPAKVTRSAL

SEQ ID NO: 13547 - protein, 14 aa, Neisseria
EIPEDKPAVPDMGG

SEQ ID NO: 13548 - protein, 8 aa, Neisseria
MAAKDVQF

SEQ ID NO: 13549 - protein, 7 aa, Neisseria
NEVRQKM

SEQ ID NO: 13550 - protein, 8 aa, Neisseria
PKGRNVVV

SEQ ID NO: 13551 - protein, 21 aa, Neisseria
HITKDGVTVAKEIELKDKFEN

SEQ ID NO: 13552 - protein, 18 aa, Neisseria
MVKEVASKTNDVAGDGTT

SEQ ID NO: 13553 - protein, 11 aa, Neisseria
TDLKRGIDKAV

SEQ ID NO: 13554 - protein, 17 aa, Neisseria
DELKNIAKPCDTSKEIA

SEQ ID NO: 13555 - protein, 7 aa, Neisseria
ANSDEQV

SEQ ID NO: 13556 - protein, 26 aa, Neisseria
EAMEKVGKEGVITVEDGKSLENELDV

SEQ ID NO: 13557 - protein, 7 aa, Neisseria
DAEKQIA

SEQ ID NO: 13558 - protein, 10 aa, Neisseria
FDKKISNIRD

SEQ ID NO: 13559 - protein, 7 aa, Neisseria
QVAKASR

SEQ ID NO: 13560 - protein, 7 aa, Neisseria
EDVEGEA

SEQ ID NO: 13561 - protein, 10 aa, Neisseria
GFGDRRKAML

SEQ ID NO: 13562 - protein, 29 aa, Neisseria
EEVGLSLEKATLDDLGQAKRIEIGKENTT

SEQ ID NO: 13563 - protein, 32 aa, Neisseria
AQIEARVAEIRQQIETATSDYDKEKLQERVAK

SEQ ID NO: 13564 - protein, 17 aa, Neisseria
TEVEMKEKKDRVEDALH

SEQ ID NO: 13565 - protein, 7 aa, Neisseria
AAVEEGV

SEQ ID NO: 13566 - protein, 6 aa, Neisseria
RARAAL

SEQ ID NO: 13567 - protein, 6 aa, Neisseria
NADQDA

SEQ ID NO: 13568 - protein, 6 aa, Neisseria
AVESPL

SEQ ID NO: 13569 - protein, 5 aa, Neisseria
AGGEP

SEQ ID NO: 13570 - protein, 6 aa, Neisseria
VLEGKG

SEQ ID NO: 13571 - protein, 7 aa, Neisseria
GSGEYGD

SEQ ID NO: 13572 - protein, 7 aa, Neisseria
DPAKVTR

SEQ ID NO: 13573 - protein, 9 aa, Neisseria
EIPEDKPAV

SEQ ID NO: 13574 - protein, 6 aa, Neisseria
QYLALA

SEQ ID NO: 13575 - protein, 8 aa, Neisseria
LAGCDKAG

SEQ ID NO: 13576 - protein, 8 aa, Neisseria
SFVERIEH

SEQ ID NO: 13577 - protein, 8 aa, Neisseria
PDFAQLVQ

SEQ ID NO: 13578 - protein, 17 aa, Neisseria
FYEFFKRLVPNMPEIPQ

SEQ ID NO: 13579 - protein, 6 aa, Neisseria
TGMGSI

SEQ ID NO: 13580 - protein, 8 aa, Neisseria
AKLIGSDV

SEQ ID NO: 13581 - protein, 10 aa, Neisseria
IGNPKDLKPG

SEQ ID NO: 13582 - protein, 6 aa, Neisseria
WVAAIG

SEQ ID NO: 13583 - protein, 10 aa, Neisseria
AEQLKNTGKV

SEQ ID NO: 13584 - protein, 8 aa, Neisseria
AAEHIGAS

SEQ ID NO: 13585 - protein, 7 aa, Neisseria
RKAMDKA

SEQ ID NO: 13586 - protein, 5 aa, Neisseria
VFKKY

SEQ ID NO: 13587 - protein, 6 aa, Neisseria
GCDKAG

SEQ ID NO: 13588 - protein, 22 aa, Neisseria
GADKKEASFVERIEHTKDDGSV

SEQ ID NO: 13589 - protein, 7 aa, Neisseria
VQSEGPA

SEQ ID NO: 13590 - protein, 25 aa, Neisseria
PAPRTQNGSGNAENDSDPIADNDPF

SEQ ID NO: 13591 - protein, 20 aa, Neisseria
KRLVPNMPEIPQEEADDGGL

SEQ ID NO: 13592 - protein, 7 aa, Neisseria
IISKDGY

SEQ ID NO: 13593 - protein, 8 aa, Neisseria
LNDKREYT

SEQ ID NO: 13594 - protein, 10 aa, Neisseria
IGSDVQSDVA

SEQ ID NO: 13595 - protein, 7 aa, Neisseria
DATEELP

SEQ ID NO: 13596 - protein, 11 aa, Neisseria
IGNPKDLKPGE

SEQ ID NO: 13597 - protein, 7 aa, Neisseria
FGFDNSV

SEQ ID NO: 13598 - protein, 13 aa, Neisseria
VSAKGRSLPNESY

SEQ ID NO: 13599 - protein, 8 aa, Neisseria
NPGNSGGP

SEQ ID NO: 13600 - protein, 6 aa, Neisseria
YSRSGG

SEQ ID NO: 13601 - protein, 14 aa, Neisseria
EQLKNTGKVQRGQL

SEQ ID NO: 13602 - protein, 8 aa, Neisseria
FGLDKAGG

SEQ ID NO: 13603 - protein, 15 aa, Neisseria
LPGSPAERAGLQAGD

SEQ ID NO: 13604 - protein, 12 aa, Neisseria
LDGGEIRSSGDL

SEQ ID NO: 13605 - protein, 7 aa, Neisseria
TPGKEVS

SEQ ID NO: 13606 - protein, 9 aa, Neisseria
WRKGEEITI

SEQ ID NO: 13607 - protein, 20 aa, Neisseria
IGASSKTDEAPYTEQQSGTF

SEQ ID NO: 13608 - protein, 8 aa, Neisseria
THTDSSGG

SEQ ID NO: 13609 - protein, 18 aa, Neisseria
RVSDAAERAGLRRGDEIL

SEQ ID NO: 13610 - protein, 19 aa, Neisseria
PVNDEAGFRKAMDKAGKNV

SEQ ID NO: 13611 - protein, 6 aa, Neisseria
MRRGNT

SEQ ID NO: 13612 - protein, 6 aa, Neisseria
GCDKAG

SEQ ID NO: 13613 - protein, 21 aa, Neisseria
GADKKEASFVERIEHTKDDGS

SEQ ID NO: 13614 - protein, 24 aa, Neisseria
PAPRTQNGSGNAENDSDPIADNDP

SEQ ID NO: 13615 - protein, 12 aa, Neisseria
PEIPQEEADDGG

SEQ ID NO: 13616 - protein, 5 aa, Neisseria
ISKDG

SEQ ID NO: 13617 - protein, 8 aa, Neisseria
LNDKREYT

SEQ ID NO: 13618 - protein, 7 aa, Neisseria
DATEELP

SEQ ID NO: 13619 - protein, 8 aa, Neisseria
GNPKDLKP

SEQ ID NO: 13620 - protein, 7 aa, Neisseria
AKGRSLP

SEQ ID NO: 13621 - protein, 13 aa, Neisseria
EQLKNTGKVQRGQ

SEQ ID NO: 13622 - protein, 6 aa, Neisseria
GLDKAG

SEQ ID NO: 13623 - protein, 9 aa, Neisseria
SPAERAGLQ

SEQ ID NO: 13624 - protein, 10 aa, Neisseria
DGGEIRSSGD

SEQ ID NO: 13625 - protein, 7 aa, Neisseria
TPGKEVS

SEQ ID NO: 13626 - protein, 8 aa, Neisseria
RKGEEITI

SEQ ID NO: 13627 - protein, 17 aa, Neisseria
IGASSKTDEAPYTEQQS

SEQ ID NO: 13628 - protein, 6 aa, Neisseria
HTDSSG

SEQ ID NO: 13629 - protein, 18 aa, Neisseria
RVSDAAERAGLRRGDEIL

SEQ ID NO: 13630 - protein, 17 aa, Neisseria
PVNDEAGFRKAMDKAGK

SEQ ID NO: 13631 - protein, 5 aa, Neisseria
CSSWL

SEQ ID NO: 13632 - protein, 15 aa, Neisseria
FNTSKPVRLDNILQI

SEQ ID NO: 13633 - protein, 5 aa, Neisseria
PHEAF

SEQ ID NO: 13634 - protein, 22 aa, Neisseria
NPFVLRKWRALGYLTDFPRLNR

SEQ ID NO: 13635 - protein, 7 aa, Neisseria
GDEYFKV

SEQ ID NO: 13636 - protein, 6 aa, Neisseria
LDILAT

SEQ ID NO: 13637 - protein, 13 aa, Neisseria
VGEVSHDFDRYWA

SEQ ID NO: 13638 - protein, 16 aa, Neisseria
ATRIIRSGDIGKGLQA

SEQ ID NO: 13639 - protein, 9 aa, Neisseria
DDPAKGLDR

SEQ ID NO: 13640 - protein, 10 aa, Neisseria
GRLQDALKQP

SEQ ID NO: 13641 - protein, 11 aa, Neisseria
GTDALAKLVQD

SEQ ID NO: 13642 - protein, 7 aa, Neisseria
QATDVAA

SEQ ID NO: 13643 - protein, 10 aa, Neisseria
KIAEQMERTL

SEQ ID NO: 13644 - protein, 22 aa, Neisseria
PEAKLWKRIAAKILSLLPIEGL

SEQ ID NO: 13645 - protein, 5 aa, Neisseria
MKTRS

SEQ ID NO: 13646 - protein, 19 aa, Neisseria
PLEERTESRHFNTSKPVRL

SEQ ID NO: 13647 - protein, 9 aa, Neisseria
HTPHTNGLS

SEQ ID NO: 13648 - protein, 7 aa, Neisseria
ESAEHSL

SEQ ID NO: 13649 - protein, 9 aa, Neisseria
WRNDISGRL

SEQ ID NO: 13650 - protein, 6 aa, Neisseria
AERGVR

SEQ ID NO: 13651 - protein, 12 aa, Neisseria
LLLDDNNTRGLD

SEQ ID NO: 13652 - protein, 9 aa, Neisseria
SHPNIEVRL

SEQ ID NO: 13653 - protein, 20 aa, Neisseria
DFPRLNRRMHNKSFTADNRA

SEQ ID NO: 13654 - protein, 17 aa, Neisseria
GGRNIGDEYFKVGEDTV

SEQ ID NO: 13655 - protein, 9 aa, Neisseria
VSHDFDRYW

SEQ ID NO: 13656 - protein, 5 aa, Neisseria
HSAHN

SEQ ID NO: 13657 - protein, 12 aa, Neisseria
RIIRSGDIGKGL

SEQ ID NO: 13658 - protein, 8 aa, Neisseria
GYNDETSR

SEQ ID NO: 13659 - protein, 7 aa, Neisseria
RYRETVE

SEQ ID NO: 13660 - protein, 5 aa, Neisseria
SPLYQ

SEQ ID NO: 13661 - protein, 24 aa, Neisseria
SVRTRLISDDPAKGLDRDRRKPPI

SEQ ID NO: 13662 - protein, 12 aa, Neisseria
RLQDALKQPEKS

SEQ ID NO: 13663 - protein, 10 aa, Neisseria
VPTKSGTDAL

SEQ ID NO: 13664 - protein, 7 aa, Neisseria
LVQDGID

SEQ ID NO: 13665 - protein, 8 aa, Neisseria
VKYRKPLL

SEQ ID NO: 13666 - protein, 11 aa, Neisseria
ATKDKGLTGSS

SEQ ID NO: 13667 - protein, 7 aa, Neisseria
VDGKRIF

SEQ ID NO: 13668 - protein, 12 aa, Neisseria
FNLDPRSARLNT

SEQ ID NO: 13669 - protein, 18 aa, Neisseria
ESPKIAEQMERTLADTTP

SEQ ID NO: 13670 - protein, 30 aa, Neisseria
VTLDRHNRLQWHDPATRKTYPNEPEAKLWK

SEQ ID NO: 13671 - protein, 5 aa, Neisseria
MKTRS

SEQ ID NO: 13672 - protein, 12 aa, Neisseria
LEERTESRHFNT

SEQ ID NO: 13673 - protein, 5 aa, Neisseria
KPVRL

SEQ ID NO: 13674 - protein, 7 aa, Neisseria
ESAEHSL

SEQ ID NO: 13675 - protein, 6 aa, Neisseria
AERGVR

SEQ ID NO: 13676 - protein, 12 aa, Neisseria
LLLDDNNTRGLD

SEQ ID NO: 13677 - protein, 9 aa, Neisseria
PRLNRRMHN

SEQ ID NO: 13678 - protein, 7 aa, Neisseria
FTADNRA

SEQ ID NO: 13679 - protein, 10 aa, Neisseria
EYFKVGEDTV

SEQ ID NO: 13680 - protein, 7 aa, Neisseria
VSHDFDR

SEQ ID NO: 13681 - protein, 10 aa, Neisseria
RIIRSGDIGK

SEQ ID NO: 13682 - protein, 7 aa, Neisseria
YNDETSR

SEQ ID NO: 13683 - protein, 7 aa, Neisseria
RYRETVE

SEQ ID NO: 13684 - protein, 24 aa, Neisseria
SVRTRLISDDPAKGLDRDRRKPPI

SEQ ID NO: 13685 - protein, 12 aa, Neisseria
RLQDALKQPEKS

SEQ ID NO: 13686 - protein, 7 aa, Neisseria
KSGTDAL

SEQ ID NO: 13687 - protein, 7 aa, Neisseria
LVQDGID

SEQ ID NO: 13688 - protein, 8 aa, Neisseria
VKYRKPLL

SEQ ID NO: 13689 - protein, 8 aa, Neisseria
ATKDKGLT

SEQ ID NO: 13690 - protein, 10 aa, Neisseria
LDPRSARLNT

SEQ ID NO: 13691 - protein, 14 aa, Neisseria
ESPKIAEQMERTLA

SEQ ID NO: 13692 - protein, 7 aa, Neisseria
TLDRHNR

SEQ ID NO: 13693 - protein, 17 aa, Neisseria
PATRKTYPNEPEAKLWK

SEQ ID NO: 13694 - protein, 8 aa, Neisseria
SKIESLAR

SEQ ID NO: 13695 - protein, 5 aa, Neisseria
QMRGI

SEQ ID NO: 13696 - protein, 10 aa, Neisseria
DIVERAQSKV

SEQ ID NO: 13697 - protein, 12 aa, Neisseria
AKIIEVLGDYAD

SEQ ID NO: 13698 - protein, 14 aa, Neisseria
HQFSEACAKAAKKI

SEQ ID NO: 13699 - protein, 7 aa, Neisseria
TARDFDD

SEQ ID NO: 13700 - protein, 7 aa, Neisseria
EKVGRNY

SEQ ID NO: 13701 - protein, 16 aa, Neisseria
AIADVSHYVRPDDVID

SEQ ID NO: 13702 - protein, 5 aa, Neisseria
NLSNG

SEQ ID NO: 13703 - protein, 14 aa, Neisseria
NQVWKWISDGIDHP

SEQ ID NO: 13704 - protein, 16 aa, Neisseria
KAQIDTLYKLFKILQK

SEQ ID NO: 13705 - protein, 11 aa, Neisseria
LGPTPEKLATL

SEQ ID NO: 13706 - protein, 9 aa, Neisseria
YAALVEQFK

SEQ ID NO: 13707 - protein, 10 aa, Neisseria
VMMLRSMQQA

SEQ ID NO: 13708 - protein, 25 aa, Neisseria
AYAHFTSPIRRYPDLTVHRAIKAVL

SEQ ID NO: 13709 - protein, 12 aa, Neisseria
DDASRDVENWLK

SEQ ID NO: 13710 - protein, 13 aa, Neisseria
ISGMTSFGIFVTL

SEQ ID NO: 13711 - protein, 13 aa, Neisseria
HIDGLVHISDLGE

SEQ ID NO: 13712 - protein, 6 aa, Neisseria
MNKNIK

SEQ ID NO: 13713 - protein, 27 aa, Neisseria
LNLREKDPFLSREKQRYEHPLPSREWI

SEQ ID NO: 13714 - protein, 40 aa, Neisseria
LLERKGVPSKIESLARELSITEDEYVFFERRLKAMARDGQ

SEQ ID NO: 13715 - protein, 7 aa, Neisseria
INRRGAV

SEQ ID NO: 13716 - protein, 19 aa, Neisseria
AADKLDLVKCRVEAHKDGF

SEQ ID NO: 13717 - protein, 8 aa, Neisseria
LTPAKDGD

SEQ ID NO: 13718 - protein, 5 aa, Neisseria
RQMRG

SEQ ID NO: 13719 - protein, 15 aa, Neisseria
RPAGMDRRGRREGTV

SEQ ID NO: 13720 - protein, 10 aa, Neisseria
IVERAQSKVV

SEQ ID NO: 13721 - protein, 7 aa, Neisseria
YMDRGVA

SEQ ID NO: 13722 - protein, 10 aa, Neisseria
LEPEDKRLNQ

SEQ ID NO: 13723 - protein, 15 aa, Neisseria
LEPDGVARFKPESGQ

SEQ ID NO: 13724 - protein, 11 aa, Neisseria
EVYPEQNRPAV

SEQ ID NO: 13725 - protein, 11 aa, Neisseria
LGDYADSGMEI

SEQ ID NO: 13726 - protein, 8 aa, Neisseria
IAVRKHHL

SEQ ID NO: 13727 - protein, 26 aa, Neisseria
ACAKAAKKIPVHVRKSDLKGRVDLRD

SEQ ID NO: 13728 - protein, 12 aa, Neisseria
TIDGETARDFDD

SEQ ID NO: 13729 - protein, 8 aa, Neisseria
EKVGRNYR

SEQ ID NO: 13730 - protein, 19 aa, Neisseria
HYVRPDDVIDADAQERSTS

SEQ ID NO: 13731 - protein, 5 aa, Neisseria
FPRRV

SEQ ID NO: 13732 - protein, 8 aa, Neisseria
LPENLSNG

SEQ ID NO: 13733 - protein, 8 aa, Neisseria
LNPDVERL

SEQ ID NO: 13734 - protein, 9 aa, Neisseria
AGNIKEYRF

SEQ ID NO: 13735 - protein, 13 aa, Neisseria
ISDGIDHPYKAQI

SEQ ID NO: 13736 - protein, 17 aa, Neisseria
LQKKRFERGAVEFESVE

SEQ ID NO: 13737 - protein, 11 aa, Neisseria
MIFDDNGKIEK

SEQ ID NO: 13738 - protein, 10 aa, Neisseria
VRNDAHKLIE

SEQ ID NO: 13739 - protein, 7 aa, Neisseria
LKNKHTA

SEQ ID NO: 13740 - protein, 16 aa, Neisseria
HLGPTPEKLATLREQL

SEQ ID NO: 13741 - protein, 11 aa, Neisseria
GGGDNPSPKDY

SEQ ID NO: 13742 - protein, 10 aa, Neisseria
QFKGRPDAEL

SEQ ID NO: 13743 - protein, 7 aa, Neisseria
EPHCDGH

SEQ ID NO: 13744 - protein, 11 aa, Neisseria
SPIRRYPDLTV

SEQ ID NO: 13745 - protein, 8 aa, Neisseria
TYTPKKSW

SEQ ID NO: 13746 - protein, 15 aa, Neisseria
FCERRADDASRDVEN

SEQ ID NO: 13747 - protein, 16 aa, Neisseria
YMRDKVGEVFEGKISG

SEQ ID NO: 13748 - protein, 12 aa, Neisseria
SDLGEDYFNFRP

SEQ ID NO: 13749 - protein, 33 aa, Neisseria
IMAIEGERSGIRFNMGDRVAVRVARADLDDGKI

SEQ ID NO: 13750 - protein, 70 aa, Neisseria
GGSGRGRKVKSSASAKPAGTAGKGKPKTAAEKKTARGGKVRGRGASAAAESRKKAKKPVPIKVKKRKGKS

SEQ ID NO: 13751 - protein, 6 aa, Neisseria
MNKNIK

SEQ ID NO: 13752 - protein, 19 aa, Neisseria
LNLREKDPFLSREKQRYEH

SEQ ID NO: 13753 - protein, 40 aa, Neisseria; identical to SEQ ID NO: 13714

SEQ ID NO: 13754 - protein, 6 aa, Neisseria
INRRGA

SEQ ID NO: 13755 - protein, 19 aa, Neisseria
AADKLDLVKCRVEAHKDGF

SEQ ID NO: 13756 - protein, 6 aa, Neisseria
PAKDGD

SEQ ID NO: 13757 - protein, 13 aa, Neisseria
AGMDRRGRREGTV

SEQ ID NO: 13758 - protein, 10 aa, Neisseria
IVERAQSKVV

SEQ ID NO: 13759 - protein, 9 aa, Neisseria
LEPEDKRLN

SEQ ID NO: 13760 - protein, 14 aa, Neisseria
LEPDGVARFKPESG

SEQ ID NO: 13761 - protein, 11 aa, Neisseria
EVYPEQNRPAV

SEQ ID NO: 13762 - protein, 8 aa, Neisseria
YADSGMEI

SEQ ID NO: 13763 - protein, 7 aa, Neisseria
IAVRKHH

SEQ ID NO: 13764 - protein, 26 aa, Neisseria
ACAKAAKKIPVHVRKSDLKGRVDLRD

SEQ ID NO: 13765 - protein, 11 aa, Neisseria
IDGETARDFDD

SEQ ID NO: 13766 - protein, 7 aa, Neisseria
EKVGRNY

SEQ ID NO: 13767 - protein, 16 aa, Neisseria
VRPDDVIDADAQERST

SEQ ID NO: 13768 - protein, 5 aa, Neisseria
PDVER

SEQ ID NO: 13769 - protein, 6 aa, Neisseria
NIKEYR

SEQ ID NO: 13770 - protein, 6 aa, Neisseria
GIDHPY

SEQ ID NO: 13771 - protein, 17 aa, Neisseria
LQKKRFERGAVEFESVE

SEQ ID NO: 13772 - protein, 11 aa, Neisseria
MIFDDNGKIEK

SEQ ID NO: 13773 - protein, 10 aa, Neisseria
VRNDAHKLIE

SEQ ID NO: 13774 - protein, 13 aa, Neisseria
PTPEKLATLREQL

SEQ ID NO: 13775 - protein, 10 aa, Neisseria
GGDNPSPKDY

SEQ ID NO: 13776 - protein, 10 aa, Neisseria
QFKGRPDAEL

SEQ ID NO: 13777 - protein, 7 aa, Neisseria
PIRRYPD

SEQ ID NO: 13778 - protein, 7 aa, Neisseria
YTPKKSW

SEQ ID NO: 13779 - protein, 15 aa, Neisseria
FCERRADDASRDVEN

SEQ ID NO: 13780 - protein, 14 aa, Neisseria
YMRDKVGEVFEGKI

SEQ ID NO: 13781 - protein, 11 aa, Neisseria
IMAIEGERSGI

SEQ ID NO: 13782 - protein, 20 aa, Neisseria
NMGDRVAVRVARADLDDGKI

SEQ ID NO: 13783 - protein, 69 aa, Neisseria
GSGRGRKVKSSASAKPAGTAGKGKPKTAAEKKTARGGKVRGRGASAAAESRKKAKKPVPIKVKKRKGKS

SEQ ID NO: 13784 - protein, 6 aa, Neisseria
AGLTKL

SEQ ID NO: 13785 - protein, 5 aa, Neisseria
SATDF

SEQ ID NO: 13786 - protein, 6 aa, Neisseria
KSGKIT

SEQ ID NO: 13787 - protein, 6 aa, Neisseria
PHIYGA

SEQ ID NO: 13788 - protein, 7 aa, Neisseria
ELRKYAD

SEQ ID NO: 13789 - protein, 8 aa, Neisseria
KPNGVAEA

SEQ ID NO: 13790 - protein, 5 aa, Neisseria
AMWST

SEQ ID NO: 13791 - protein, 9 aa, Neisseria
SVHGMYKVS

SEQ ID NO: 13792 - protein, 6 aa, Neisseria
WTRHSR

SEQ ID NO: 13793 - protein, 8 aa, Neisseria
SYQISEPL

SEQ ID NO: 13794 - protein, 6 aa, Neisseria
FKNHAD

SEQ ID NO: 13795 - protein, 6 aa, Neisseria
EAADAS

SEQ ID NO: 13796 - protein, 12 aa, Neisseria
PAGLTKLDSSQI

SEQ ID NO: 13797 - protein, 10 aa, Neisseria
YEADSATDFT

SEQ ID NO: 13798 - protein, 12 aa, Neisseria
QGSKSGKITKTT

SEQ ID NO: 13799 - protein, 7 aa, Neisseria
KVNDNLT

SEQ ID NO: 13800 - protein, 12 aa, Neisseria
GSATEYEKDSVL

SEQ ID NO: 13801 - protein, 6 aa, Neisseria
NINKLG

SEQ ID NO: 13802 - protein, 9 aa, Neisseria
KLNDRHSFG

SEQ ID NO: 13803 - protein, 9 aa, Neisseria
TSAELRKYA

SEQ ID NO: 13804 - protein, 39 aa, Neisseria
GIKSKAEILTAKPPKPNGVAEAAKIQADGHADVKGSDWG

SEQ ID NO: 13805 - protein, 28 aa, Neisseria
DINDRARVGVNYRSKVSHTLKGDAEWAA

SEQ ID NO: 13806 - protein, 15 aa, Neisseria
TANEKARVKIVTPES

SEQ ID NO: 13807 - protein, 9 aa, Neisseria
YKVSDKADL

SEQ ID NO: 13808 - protein, 31 aa, Neisseria
TWTRHSRFDKAELVFEKEKTVVKGKSDRTTI

SEQ ID NO: 13809 - protein, 8 aa, Neisseria
PNWRNTYK

SEQ ID NO: 13810 - protein, 7 aa, Neisseria
GSYQISE

SEQ ID NO: 13811 - protein, 22 aa, Neisseria
IAFDKSPVRNADYRMNSLPDGN

SEQ ID NO: 13812 - protein, 7 aa, Neisseria
HIGKNHV

SEQ ID NO: 13813 - protein, 29 aa, Neisseria
NDTSYRTAKASGNDVDSKGASSARFKNHA

SEQ ID NO: 13814 - protein, 7 aa, Neisseria
TKLDSSQ

SEQ ID NO: 13815 - protein, 7 aa, Neisseria
YEADSAT

SEQ ID NO: 13816 - protein, 10 aa, Neisseria
QGSKSGKITK

SEQ ID NO: 13817 - protein, 9 aa, Neisseria
TEYEKDSVL

SEQ ID NO: 13818 - protein, 7 aa, Neisseria
KLNDRHS

SEQ ID NO: 13819 - protein, 9 aa, Neisseria
TSAELRKYA

SEQ ID NO: 13820 - protein, 10 aa, Neisseria
GIKSKAEILT

SEQ ID NO: 13821 - protein, 16 aa, Neisseria
KPPKPNGVAEAAKIQA

SEQ ID NO: 13822 - protein, 9 aa, Neisseria
GHADVKGSD

SEQ ID NO: 13823 - protein, 7 aa, Neisseria
INDRARV

SEQ ID NO: 13824 - protein, 5 aa, Neisseria
YRSKV

SEQ ID NO: 13825 - protein, 9 aa, Neisseria
LKGDAEWAA

SEQ ID NO: 13826 - protein, 12 aa, Neisseria
TANEKARVKIVT

SEQ ID NO: 13827 - protein, 8 aa, Neisseria
KVSDKADL

SEQ ID NO: 13828 - protein, 26 aa, Neisseria
SRFDKAELVFEKEKTVVKGKSDRTTI

SEQ ID NO: 13829 - protein, 15 aa, Neisseria
IAFDKSPVRNADYRM

SEQ ID NO: 13830 - protein, 6 aa, Neisseria
SLPDGN

SEQ ID NO: 13831 - protein, 27 aa, Neisseria
TSYRTAKASGNDVDSKGASSARFKNHA

SEQ ID NO: 13832 - protein, 9 aa, Neisseria
KSQLQDLYK

SEQ ID NO: 13833 - protein, 10 aa, Neisseria
TMPDLINKLV

SEQ ID NO: 13834 - protein, 7 aa, Neisseria
TSLNNIF

SEQ ID NO: 13835 - protein, 13 aa, Neisseria
RRHSDIHTLETSD

SEQ ID NO: 13836 - protein, 9 aa, Neisseria
PENLKTLDG

SEQ ID NO: 13837 - protein, 8 aa, Neisseria
YELLLKQC

SEQ ID NO: 13838 - protein, 8 aa, Neisseria
ADGWRKGV

SEQ ID NO: 13839 - protein, 10 aa, Neisseria
GYGGGVYAAW

SEQ ID NO: 13840 - protein, 9 aa, Neisseria
AYLDGWLQY

SEQ ID NO: 13841 - protein, 11 aa, Neisseria
TASVEGGYNAL

SEQ ID NO: 13842 - protein, 11 aa, Neisseria
QPFAAFNVLHR

SEQ ID NO: 13843 - protein, 26 aa, Neisseria
LGSNTRSTKIGDDADFSFSDKPKPGT

SEQ ID NO: 13844 - protein, 29 aa, Neisseria
FSSGKTDQNSSEYGYDEINIQGKNYNSGI

SEQ ID NO: 13845 - protein, 14 aa, Neisseria
YITEKYGADLKQAV

SEQ ID NO: 13846 - protein, 25 aa, Neisseria
SQLQDLYKTRPEAWAENKKRTEEAY

SEQ ID NO: 13847 - protein, 11 aa, Neisseria
TKFSTLKQTMP

SEQ ID NO: 13848 - protein, 8 aa, Neisseria
HSNTSQTS

SEQ ID NO: 13849 - protein, 15 aa, Neisseria
FNKKLHVKIENKSHV

SEQ ID NO: 13850 - protein, 49 aa, Neisseria
TKMTLKDSLWEPRRHSDIHTLETSDNARIRLNTKDEKLTVHKDYAGGAD

SEQ ID NO: 13851 - protein, 42 aa, Neisseria
YDVRESDEPALTFEDKVSGQSGVVLERRPENLKTLDGRKLIA

SEQ ID NO: 13852 - protein, 18 aa, Neisseria
KTADSGSFAFKQNYRQGL

SEQ ID NO: 13853 - protein, 7 aa, Neisseria
KQCEGGF

SEQ ID NO: 13854 - protein, 6 aa, Neisseria
AIPEAE

SEQ ID NO: 13855 - protein, 19 aa, Neisseria
RAADRGDDVYAADPSRQKL

SEQ ID NO: 13856 - protein, 22 aa, Neisseria
IGGRSHQNIRGGAAADGWRKGV

SEQ ID NO: 13857 - protein, 12 aa, Neisseria
VFVRQNEGSRLA

SEQ ID NO: 13858 - protein, 7 aa, Neisseria
MGGRAGQ

SEQ ID NO: 13859 - protein, 14 aa, Neisseria
ASVNGKGGAAGSDL

SEQ ID NO: 13860 - protein, 9 aa, Neisseria
LRDKQTGAY

SEQ ID NO: 13861 - protein, 21 aa, Neisseria
RFKHRINDENRAERYKTKGWT

SEQ ID NO: 13862 - protein, 5 aa, Neisseria
VEGGY

SEQ ID NO: 13863 - protein, 9 aa, Neisseria
IVGKGNNVR

SEQ ID NO: 13864 - protein, 11 aa, Neisseria
NGGFTDSEGTA

SEQ ID NO: 13865 - protein, 24 aa, Neisseria
GSGQWQSRAGIRAKTRFALRNGVN

SEQ ID NO: 13866 - protein, 18 aa, Neisseria
HRSKSFGVEMDGEKQTLA

SEQ ID NO: 13867 - protein, 9 aa, Neisseria
TALEGRFGI

SEQ ID NO: 13868 - protein, 7 aa, Neisseria
AGWKGHM

SEQ ID NO: 13869 - protein, 14 aa, Neisseria
GYGKRTDGDKEAAL

SEQ ID NO: 13870 - protein, 24 aa, Neisseria
SNTRSTKIGDDADFSFSDKPKPGT

SEQ ID NO: 13871 - protein, 8 aa, Neisseria
GKTDQNSS

SEQ ID NO: 13872 - protein, 10 aa, Neisseria
KYGADLKQAV

SEQ ID NO: 13873 - protein, 19 aa, Neisseria
YKTRPEAWAENKKRTEEAY

SEQ ID NO: 13874 - protein, 11 aa, Neisseria
LHVKIENKSHV

SEQ ID NO: 13875 - protein, 6 aa, Neisseria
TKMTLK

SEQ ID NO: 13876 - protein, 10 aa, Neisseria
SLWEPRRHSD

SEQ ID NO: 13877 - protein, 19 aa, Neisseria
ETSDNARIRLNTKDEKLTV

SEQ ID NO: 13878 - protein, 5 aa, Neisseria
KDYAG

SEQ ID NO: 13879 - protein, 18 aa, Neisseria
DVRESDEPALTFEDKVSG

SEQ ID NO: 13880 - protein, 19 aa, Neisseria
VLERRPENLKTLDGRKLIA

SEQ ID NO: 13881 - protein, 6 aa, Neisseria
KTADSG

SEQ ID NO: 13882 - protein, 6 aa, Neisseria
AIPEAE

SEQ ID NO: 13883 - protein, 11 aa, Neisseria
RAADRGDDVYA

SEQ ID NO: 13884 - protein, 5 aa, Neisseria
DPSRQ

SEQ ID NO: 13885 - protein, 8 aa, Neisseria
RSHQNIRG

SEQ ID NO: 13886 - protein, 5 aa, Neisseria
DGWRK

SEQ ID NO: 13887 - protein, 10 aa, Neisseria
VFVRQNEGSR

SEQ ID NO: 13888 - protein, 9 aa, Neisseria
VNGKGGAAG

SEQ ID NO: 13889 - protein, 6 aa, Neisseria
LRDKQT

SEQ ID NO: 13890 - protein, 17 aa, Neisseria
RFKHRINDENRAERYKT

SEQ ID NO: 13891 - protein, 7 aa, Neisseria
FTDSEGT

SEQ ID NO: 13892 - protein, 11 aa, Neisseria
AGIRAKTRFAL

SEQ ID NO: 13893 - protein, 18 aa, Neisseria
HRSKSFGVEMDGEKQTLA

SEQ ID NO: 13894 - protein, 5 aa, Neisseria
TALEG

SEQ ID NO: 13895 - protein, 14 aa, Neisseria
GYGKRTDGDKEAAL

SEQ ID NO: 13896 - protein, 14 aa, Neisseria
RHLKNMQIKKIMKW

SEQ ID NO: 13897 - protein, 9 aa, Neisseria
LSLLGALGY

SEQ ID NO: 13898 - protein, 9 aa, Neisseria
AVLDVLGAA

SEQ ID NO: 13899 - protein, 11 aa, Neisseria
HRYTGTVSKVY

SEQ ID NO: 13900 - protein, 5 aa, Neisseria
QVQDG

SEQ ID NO: 13901 - protein, 5 aa, Neisseria
DFADY

SEQ ID NO: 13902 - protein, 9 aa, Neisseria
MFRRHRHLK

SEQ ID NO: 13903 - protein, 8 aa, Neisseria
GYGSEAVR

SEQ ID NO: 13904 - protein, 24 aa, Neisseria
AAGDAGSDAPARRRASAKSGHRYT

SEQ ID NO: 13905 - protein, 8 aa, Neisseria
SKVYDGDT

SEQ ID NO: 13906 - protein, 10 aa, Neisseria
IDGDGAKHKI

SEQ ID NO: 13907 - protein, 27 aa, Neisseria
DAPEMKQAYGTRSRDNLRAAAEGRKVS

SEQ ID NO: 13908 - protein, 12 aa, Neisseria
VFDTDRYQREVA

SEQ ID NO: 13909 - protein, 8 aa, Neisseria
SVGKTDLN

SEQ ID NO: 13910 - protein, 13 aa, Neisseria
KSYAKEQQDKADF

SEQ ID NO: 13911 - protein, 20 aa, Neisseria
QIQAERERKGLWKAKNPQAP

SEQ ID NO: 13912 - protein, 17 aa, Neisseria
AYRRAGRSGGGNKDWMD

SEQ ID NO: 13913 - protein, 9 aa, Neisseria
MFRRHRHLK

SEQ ID NO: 13914 - protein, 20 aa, Neisseria
GDAGSDAPARRRASAKSGHR

SEQ ID NO: 13915 - protein, 10 aa, Neisseria
IDGDGAKHKI

SEQ ID NO: 13916 - protein, 7 aa, Neisseria
DAPEMKQ

SEQ ID NO: 13917 - protein, 19 aa, Neisseria
YGTRSRDNLRAAAEGRKVS

SEQ ID NO: 13918 - protein, 12 aa, Neisseria
VFDTDRYQREVA

SEQ ID NO: 13919 - protein, 7 aa, Neisseria
SVGKTDL

SEQ ID NO: 13920 - protein, 12 aa, Neisseria
SYAKEQQDKADF

SEQ ID NO: 13921 - protein, 17 aa, Neisseria
QIQAERERKGLWKAKNP

SEQ ID NO: 13922 - protein, 13 aa, Neisseria
RAGRSGGGNKDWM

SEQ ID NO: 13923 - protein, 11 aa, Neisseria
GSFQGPLDLLL

SEQ ID NO: 13924 - protein, 11 aa, Neisseria
TEQYLHYIAQI

SEQ ID NO: 13925 - protein, 8 aa, Neisseria
GLDALPRA

SEQ ID NO: 13926 - protein, 10 aa, Neisseria
ITDLTQAWLG

SEQ ID NO: 13927 - protein, 8 aa, Neisseria
HTRSHEVI

SEQ ID NO: 13928 - protein, 21 aa, Neisseria
MTAILRRLNGHGICRFHDLFN

SEQ ID NO: 13929 - protein, 7 aa, Neisseria
VNFIALL

SEQ ID NO: 13930 - protein, 7 aa, Neisseria
GLVRIVQ

SEQ ID NO: 13931 - protein, 6 aa, Neisseria
RKQNID

SEQ ID NO: 13932 - protein, 22 aa, Neisseria
LLLPRTETVEDEEADPRAELVR

SEQ ID NO: 13933 - protein, 9 aa, Neisseria
ALPRAGRDF

SEQ ID NO: 13934 - protein, 17 aa, Neisseria
SRAKHTRSHEVIKETIS

SEQ ID NO: 13935 - protein, 10 aa, Neisseria
ILRRLNGHGI

SEQ ID NO: 13936 - protein, 9 aa, Neisseria
DLFNPKQGA

SEQ ID NO: 13937 - protein, 6 aa, Neisseria
LAKEGL

SEQ ID NO: 13938 - protein, 11 aa, Neisseria
VQEDGFGEIRI

SEQ ID NO: 13939 - protein, 21 aa, Neisseria
LNHEGAHSDGISGTRGGRDVF

SEQ ID NO: 13940 - protein, 6 aa, Neisseria
RKQNID

SEQ ID NO: 13941 - protein, 22 aa, Neisseria
LLLPRTETVEDEEADPRAELVR

SEQ ID NO: 13942 - protein, 7 aa, Neisseria
ALPRAGR

SEQ ID NO: 13943 - protein, 17 aa, Neisseria
SRAKHTRSHEVIKETIS

SEQ ID NO: 13944 - protein, 6 aa, Neisseria
LAKEGL

SEQ ID NO: 13945 - protein, 7 aa, Neisseria
VQEDGFG

SEQ ID NO: 13946 - protein, 17 aa, Neisseria
GAHSDGISGTRGGRDVF

SEQ ID NO: 13947 - protein, 10 aa, Neisseria
KSARTHAKIP

SEQ ID NO: 13948 - protein, 16 aa, Neisseria
PGESYPAQLQKLTGWN

SEQ ID NO: 13949 - protein, 11 aa, Neisseria
TSAQALSRLPA

SEQ ID NO: 13950 - protein, 7 aa, Neisseria
LRKVPKE

SEQ ID NO: 13951 - protein, 11 aa, Neisseria
NIAKIIETVQK

SEQ ID NO: 13952 - protein, 10 aa, Neisseria
LGALFGHLSD

SEQ ID NO: 13953 - protein, 5 aa, Neisseria
GAWAE

SEQ ID NO: 13954 - protein, 21 aa, Neisseria
NGKGYRKFAEDLNQFLRKQGF

SEQ ID NO: 13955 - protein, 6 aa, Neisseria
MNRRTF

SEQ ID NO: 13956 - protein, 17 aa, Neisseria
CGRKSARTHAKIPEGST

SEQ ID NO: 13957 - protein, 10 aa, Neisseria
YGANPGESYP

SEQ ID NO: 13958 - protein, 9 aa, Neisseria
GGVSGDTSA

SEQ ID NO: 13959 - protein, 6 aa, Neisseria
LARKPK

SEQ ID NO: 13960 - protein, 18 aa, Neisseria
GGNDFLRKVPKEQTRANI

SEQ ID NO: 13961 - protein, 9 aa, Neisseria
ETVQKENIP

SEQ ID NO: 13962 - protein, 14 aa, Neisseria
SDHPLYEDLSEEYG

SEQ ID NO: 13963 - protein, 35 aa, Neisseria
LGDNNLKSDQIHANGKGYRKFAEDLNQFLRKQGFR

SEQ ID NO: 13964 - protein, 14 aa, Neisseria
CGRKSARTHAKIPE

SEQ ID NO: 13965 - protein, 6 aa, Neisseria
NPGESY

SEQ ID NO: 13966 - protein, 7 aa, Neisseria
VSGDTSA

SEQ ID NO: 13967 - protein, 6 aa, Neisseria
LARKPK

SEQ ID NO: 13968 - protein, 15 aa, Neisseria
DFLRKVPKEQTRANI

SEQ ID NO: 13969 - protein, 8 aa, Neisseria
ETVQKENI

SEQ ID NO: 13970 - protein, 8 aa, Neisseria
EDLSEEYG

SEQ ID NO: 13971 - protein, 11 aa, Neisseria
NNLKSDQIHAN

SEQ ID NO: 13972 - protein, 15 aa, Neisseria
KGYRKFAEDLNQFLR

SEQ ID NO: 13973 - protein, 8 aa, Neisseria
WAGLSAAV

SEQ ID NO: 13974 - protein, 12 aa, Neisseria
YRGVLRLMKTIG

SEQ ID NO: 13975 - protein, 8 aa, Neisseria
PLPAPLHI

SEQ ID NO: 13976 - protein, 15 aa, Neisseria
LLADMSDLQKSARLG

SEQ ID NO: 13977 - protein, 13 aa, Neisseria
AAVMQFWQPLVWG

SEQ ID NO: 13978 - protein, 8 aa, Neisseria
VLCNVLSD

SEQ ID NO: 13979 - protein, 7 aa, Neisseria
ALADLQR

SEQ ID NO: 13980 - protein, 6 aa, Neisseria
RLNTLP

SEQ ID NO: 13981 - protein, 10 aa, Neisseria
EGTPEHVQTA

SEQ ID NO: 13982 - protein, 17 aa, Neisseria
YAEPVRLPAPLTGLADG

SEQ ID NO: 13983 - protein, 13 aa, Neisseria
KAHADLKRILPHL

SEQ ID NO: 13984 - protein, 5 aa, Neisseria
EPEAV

SEQ ID NO: 13985 - protein, 9 aa, Neisseria
NTPHPRPKI

SEQ ID NO: 13986 - protein, 21 aa, Neisseria
EAGRQAGGRARTLAGNTDGFG

SEQ ID NO: 13987 - protein, 10 aa, Neisseria
KTIGSDPRAA

SEQ ID NO: 13988 - protein, 5 aa, Neisseria
RRAPT

SEQ ID NO: 13989 - protein, 20 aa, Neisseria
LLADMSDLQKSARLGQPDTT

SEQ ID NO: 13990 - protein, 8 aa, Neisseria
LKQRNVPR

SEQ ID NO: 13991 - protein, 7 aa, Neisseria
TPLETAS

SEQ ID NO: 13992 - protein, 18 aa, Neisseria
GVLTKKSGSDYLLPKQDL

SEQ ID NO: 13993 - protein, 17 aa, Neisseria
DLQRLGADIRLETRVCR

SEQ ID NO: 13994 - protein, 8 aa, Neisseria
NTLPDGKV

SEQ ID NO: 13995 - protein, 9 aa, Neisseria
LPEGTPEHV

SEQ ID NO: 13996 - protein, 6 aa, Neisseria
GLADGT

SEQ ID NO: 13997 - protein, 12 aa, Neisseria
CRGRLGLPENEV

SEQ ID NO: 13998 - protein, 7 aa, Neisseria
VSDRVGA

SEQ ID NO: 13999 - protein, 14 aa, Neisseria
AWADKAHADLKRIL

SEQ ID NO: 14000 - protein, 26 aa, Neisseria
LGEPEAVRVITEKRATTAADAPPPDL

SEQ ID NO: 14001 - protein, 12 aa, Neisseria
PAGDYLHPDYPA

SEQ ID NO: 14002 - protein, 7 aa, Neisseria
PHPRPKI

SEQ ID NO: 14003 - protein, 16 aa, Neisseria
EAGRQAGGRARTLAGN

SEQ ID NO: 14004 - protein, 8 aa, Neisseria
IGSDPRAA

SEQ ID NO: 14005 - protein, 5 aa, Neisseria
RRAPT

SEQ ID NO: 14006 - protein, 20 aa, Neisseria
LLADMSDLQKSARLGQPDTT

SEQ ID NO: 14007 - protein, 8 aa, Neisseria
VLTKKSGS

SEQ ID NO: 14008 - protein, 7 aa, Neisseria
LLPKQDL

SEQ ID NO: 14009 - protein, 17 aa, Neisseria
DLQRLGADIRLETRVCR

SEQ ID NO: 14010 - protein, 5 aa, Neisseria
PDGKV

SEQ ID NO: 14011 - protein, 6 aa, Neisseria
GTPEHV

SEQ ID NO: 14012 - protein, 10 aa, Neisseria
GRLGLPENEV

SEQ ID NO: 14013 - protein, 6 aa, Neisseria
VSDRVG

SEQ ID NO: 14014 - protein, 14 aa, Neisseria
AWADKAHADLKRIL

SEQ ID NO: 14015 - protein, 23 aa, Neisseria
GEPEAVRVITEKRATTAADAPPP

SEQ ID NO: 14016 - protein, 9 aa, Neisseria
LISAICVSI

SEQ ID NO: 14017 - protein, 9 aa, Neisseria
EPVQSIQAA

SEQ ID NO: 14018 - protein, 20 aa, Neisseria
GQNLVNNAINGLHSIQAVLS

SEQ ID NO: 14019 - protein, 5 aa, Neisseria
TTTDK

SEQ ID NO: 14020 - protein, 13 aa, Neisseria
QLFTALTEVVKES

SEQ ID NO: 14021 - protein, 7 aa, Neisseria
MNMKKLI

SEQ ID NO: 14022 - protein, 16 aa, Neisseria
ACNQQSKTAQAEEPVQ

SEQ ID NO: 14023 - protein, 7 aa, Neisseria
APMDITV

SEQ ID NO: 14024 - protein, 9 aa, Neisseria
QAFKTQNVS

SEQ ID NO: 14025 - protein, 14 aa, Neisseria
KIHNKNIVKTDCGY

SEQ ID NO: 14026 - protein, 10 aa, Neisseria
KLDEQQKIRA

SEQ ID NO: 14027 - protein, 10 aa, Neisseria
KTDGEKGQNL

SEQ ID NO: 14028 - protein, 13 aa, Neisseria
TTTDKLGESEAGK

SEQ ID NO: 14029 - protein, 10 aa, Neisseria
EVVKESNQTG

SEQ ID NO: 14030 - protein, 10 aa, Neisseria
TAQKDVPADG

SEQ ID NO: 14031 - protein, 7 aa, Neisseria
FEKETNT

SEQ ID NO: 14032 - protein, 6 aa, Neisseria
IGRKQP

SEQ ID NO: 14033 - protein, 7 aa, Neisseria
MNMKKLI

SEQ ID NO: 14034 - protein, 13 aa, Neisseria
QQSKTAQAEEPVQ

SEQ ID NO: 14035 - protein, 9 aa, Neisseria
NIVKTDCGY

SEQ ID NO: 14036 - protein, 10 aa, Neisseria
KLDEQQKIRA

SEQ ID NO: 14037 - protein, 8 aa, Neisseria
TDGEKGQN

SEQ ID NO: 14038 - protein, 12 aa, Neisseria
TTDKLGESEAGK

SEQ ID NO: 14039 - protein, 8 aa, Neisseria
EVVKESNQ

SEQ ID NO: 14040 - protein, 8 aa, Neisseria
TAQKDVPA

SEQ ID NO: 14041 - protein, 6 aa, Neisseria
FEKETN

SEQ ID NO: 14042 - protein, 6 aa, Neisseria
IGRKQP

SEQ ID NO: 14043 - protein, 5 aa, Neisseria
AARRM

SEQ ID NO: 14044 - protein, 10 aa, Neisseria
FFGSACNSAA

SEQ ID NO: 14045 - protein, 15 aa, Neisseria
PQGKAARRMSANEVC

SEQ ID NO: 14046 - protein, 13 aa, Neisseria
TLPKRDTLNGSGT

SEQ ID NO: 14047 - protein, 9 aa, Neisseria
PRSLRSKST

SEQ ID NO: 14048 - protein, 22 aa, Neisseria
RFFGSACNSAARRSSCPSPKIG

SEQ ID NO: 14049 - protein, 17 aa, Neisseria
VPSEPILRKSSGEKHSV

SEQ ID NO: 14050 - protein, 14 aa, Neisseria
ADCPCASGRWDKTA

SEQ ID NO: 14051 - protein, 9 aa, Neisseria
GKAARRMSA

SEQ ID NO: 14052 - protein, 8 aa, Neisseria
LPKRDTLN

SEQ ID NO: 14053 - protein, 7 aa, Neisseria
RSLRSKS

SEQ ID NO: 14054 - protein, 12 aa, Neisseria
SAARRSSCPSPK

SEQ ID NO: 14055 - protein, 13 aa, Neisseria
PILRKSSGEKHSV

SEQ ID NO: 14056 - protein, 7 aa, Neisseria
GRWDKTA

SEQ ID NO: 14057 - protein, 5 aa, Neisseria
NQVVL

SEQ ID NO: 14058 - protein, 7 aa, Neisseria
IVEVFQR

SEQ ID NO: 14059 - protein, 28 aa, Neisseria
RINDAEEILQDVVAEFVGIVGHFDGFGV

SEQ ID NO: 14060 - protein, 8 aa, Neisseria
FIARIFRV

SEQ ID NO: 14061 - protein, 6 aa, Neisseria
FNNEGQ

SEQ ID NO: 14062 - protein, 9 aa, Neisseria
FEGGGDDGF

SEQ ID NO: 14063 - protein, 10 aa, Neisseria
GRINDAEEIL

SEQ ID NO: 14064 - protein, 15 aa, Neisseria
PEAAAGEVDGARVHD

SEQ ID NO: 14065 - protein, 7 aa, Neisseria
GGGDDGF

SEQ ID NO: 14066 - protein, 10 aa, Neisseria
GRINDAEEIL

SEQ ID NO: 14067 - protein, 14 aa, Neisseria
EAAAGEVDGARVHD

SEQ ID NO: 14068 - protein, 7 aa, Neisseria
IQSMWKE

SEQ ID NO: 14069 - protein, 11 aa, Neisseria
LELLTVFGAIA

SEQ ID NO: 14070 - protein, 8 aa, Neisseria
LTDFSENY

SEQ ID NO: 14071 - protein, 11 aa, Neisseria
RLKEGGEKSSE

SEQ ID NO: 14072 - protein, 6 aa, Neisseria
QLRRLR

SEQ ID NO: 14073 - protein, 21 aa, Neisseria
AIVGSVGVVAEVPNIHRLLKK

SEQ ID NO: 14074 - protein, 5 aa, Neisseria
FKRTV

SEQ ID NO: 14075 - protein, 7 aa, Neisseria
THQLFKQ

SEQ ID NO: 14076 - protein, 9 aa, Neisseria
LNLIDEIST

SEQ ID NO: 14077 - protein, 6 aa, Neisseria
LLLKAF

SEQ ID NO: 14078 - protein, 11 aa, Neisseria
MPEQEEIQSMW

SEQ ID NO: 14079 - protein, 10 aa, Neisseria
QSKKQSESGS

SEQ ID NO: 14080 - protein, 13 aa, Neisseria
DFSENYKKQRQSF

SEQ ID NO: 14081 - protein, 41 aa, Neisseria
SGEEAKHQEKEEKKKEKAEAKAEKKRLKEGGEKSSETQKSR

SEQ ID NO: 14082 - protein, 7 aa, Neisseria
ESLRHEI

SEQ ID NO: 14083 - protein, 9 aa, Neisseria
AKPEDEVLL

SEQ ID NO: 14084 - protein, 7 aa, Neisseria
LESPGGV

SEQ ID NO: 14085 - protein, 10 aa, Neisseria
QLRRLRERNI

SEQ ID NO: 14086 - protein, 7 aa, Neisseria
AVDKVAA

SEQ ID NO: 14087 - protein, 10 aa, Neisseria
RLLKKHDIDV

SEQ ID NO: 14088 - protein, 6 aa, Neisseria
GEFKRT

SEQ ID NO: 14089 - protein, 19 aa, Neisseria
ENTEKGKQKFRQELEETHQ

SEQ ID NO: 14090 - protein, 16 aa, Neisseria
FVSENRPQLDIEEVAT

SEQ ID NO: 14091 - protein, 10 aa, Neisseria
DEISTSDDLL

SEQ ID NO: 14092 - protein, 7 aa, Neisseria
FENKQVI

SEQ ID NO: 14093 - protein, 8 aa, Neisseria
KYQEKQSL

SEQ ID NO: 14094 - protein, 7 aa, Neisseria
ASVEKLF

SEQ ID NO: 14095 - protein, 7 aa, Neisseria
VNRRADV

SEQ ID NO: 14096 - protein, 11 aa, Neisseria
MPEQEEIQSMW

SEQ ID NO: 14097 - protein, 9 aa, Neisseria
QSKKQSESG

SEQ ID NO: 14098 - protein, 13 aa, Neisseria
DFSENYKKQRQSF

SEQ ID NO: 14099 - protein, 40 aa, Neisseria
GEEAKHQEKEEKKKEKAEAKAEKKRLKEGGEKSSETQKSR

SEQ ID NO: 14100 - protein, 7 aa, Neisseria
ESLRHEI

SEQ ID NO: 14101 - protein, 9 aa, Neisseria
AKPEDEVLL

SEQ ID NO: 14102 - protein, 5 aa, Neisseria
LESPG

SEQ ID NO: 14103 - protein, 10 aa, Neisseria
QLRRLRERNI

SEQ ID NO: 14104 - protein, 7 aa, Neisseria
AVDKVAA

SEQ ID NO: 14105 - protein, 10 aa, Neisseria
RLLKKHDIDV

SEQ ID NO: 14106 - protein, 5 aa, Neisseria
GEFKR

SEQ ID NO: 14107 - protein, 19 aa, Neisseria
ENTEKGKQKFRQELEETHQ

SEQ ID NO: 14108 - protein, 16 aa, Neisseria
FVSENRPQLDIEEVAT

SEQ ID NO: 14109 - protein, 10 aa, Neisseria
DEISTSDDLL

SEQ ID NO: 14110 - protein, 7 aa, Neisseria
FENKQVI

SEQ ID NO: 14111 - protein, 8 aa, Neisseria
KYQEKQSL

SEQ ID NO: 14112 - protein, 7 aa, Neisseria
ASVEKLF

SEQ ID NO: 14113 - protein, 7 aa, Neisseria
VNRRADV

SEQ ID NO: 14114 - protein, 13 aa, Neisseria
QAWQALLYALVVL

SEQ ID NO: 14115 - protein, 15 aa, Neisseria
RRIADTRTFTRIYTE

SEQ ID NO: 14116 - protein, 7 aa, Neisseria
EFVSFFE

SEQ ID NO: 14117 - protein, 14 aa, Neisseria
TSVVSIFGACIMLL

SEQ ID NO: 14118 - protein, 6 aa, Neisseria
GDERQL

SEQ ID NO: 14119 - protein, 9 aa, Neisseria
RHYGLLARL

SEQ ID NO: 14120 - protein, 10 aa, Neisseria
GYSSAGHVYS

SEQ ID NO: 14121 - protein, 17 aa, Neisseria
LDDVPRLVEQYSNLKDI

SEQ ID NO: 14122 - protein, 8 aa, Neisseria
SQNHRKRL

SEQ ID NO: 14123 - protein, 12 aa, Neisseria
AARRIADTRTFT

SEQ ID NO: 14124 - protein, 11 aa, Neisseria
LEQRQRQVPHS

SEQ ID NO: 14125 - protein, 26 aa, Neisseria
FRLKNSLERDNHFIRKGDERQLDRHY

SEQ ID NO: 14126 - protein, 7 aa, Neisseria
ISNREAF

SEQ ID NO: 14127 - protein, 5 aa, Neisseria
KGYSS

SEQ ID NO: 14128 - protein, 19 aa, Neisseria
LDDVPRLVEQYSNLKDIGQ

SEQ ID NO: 14129 - protein, 12 aa, Neisseria
IEWSKRNIKAGT

SEQ ID NO: 14130 - protein, 8 aa, Neisseria
SQNHRKRL

SEQ ID NO: 14131 - protein, 11 aa, Neisseria
AARRIADTRTF

SEQ ID NO: 14132 - protein, 9 aa, Neisseria
LEQRQRQVP

SEQ ID NO: 14133 - protein, 21 aa, Neisseria
KNSLERDNHFIRKGDERQLDR

SEQ ID NO: 14134 - protein, 6 aa, Neisseria
ISNREA

SEQ ID NO: 14135 - protein, 9 aa, Neisseria
LDDVPRLVE

SEQ ID NO: 14136 - protein, 8 aa, Neisseria
SNLKDIGQ

SEQ ID NO: 14137 - protein, 12 aa, Neisseria
IEWSKRNIKAGT

SEQ ID NO: 14138 - protein, 8 aa, Neisseria
HSMVKGIN

SEQ ID NO: 14139 - protein, 14 aa, Neisseria
VATYIMNAFDNGGG

SEQ ID NO: 14140 - protein, 6 aa, Neisseria
MNTTRL

SEQ ID NO: 14141 - protein, 19 aa, Neisseria
SAADNSIMTKGQKVYESNC

SEQ ID NO: 14142 - protein, 11 aa, Neisseria
CHGKKGEGRGT

SEQ ID NO: 14143 - protein, 13 aa, Neisseria
PLYRSDFIMKKPQ

SEQ ID NO: 14144 - protein, 8 aa, Neisseria
VNGKTYNG

SEQ ID NO: 14145 - protein, 5 aa, Neisseria
SDADI

SEQ ID NO: 14146 - protein, 21 aa, Neisseria
AFDNGGGSVTEKDVKQAKNKK

SEQ ID NO: 14147 - protein, 10 aa, Neisseria
IMTKGQKVYE

SEQ ID NO: 14148 - protein, 9 aa, Neisseria
HGKKGEGRG

SEQ ID NO: 14149 - protein, 7 aa, Neisseria
FIMKKPQ

SEQ ID NO: 14150 - protein, 5 aa, Neisseria
SDADI

SEQ ID NO: 14151 - protein, 14 aa, Neisseria
SVTEKDVKQAKNKK

SEQ ID NO: 14152 - protein, 16 aa, Neisseria
LENPAQQVRAALDTLS

SEQ ID NO: 14153 - protein, 8 aa, Neisseria
QPDFVNAV

SEQ ID NO: 14154 - protein, 11 aa, Neisseria
DGIALLAELNR

SEQ ID NO: 14155 - protein, 5 aa, Neisseria
FRNAP

SEQ ID NO: 14156 - protein, 9 aa, Neisseria
RPLAEILPD

SEQ ID NO: 14157 - protein, 11 aa, Neisseria
GKVAELSKRLG

SEQ ID NO: 14158 - protein, 5 aa, Neisseria
MNNRH

SEQ ID NO: 14159 - protein, 11 aa, Neisseria
GSNLENPAQQV

SEQ ID NO: 14160 - protein, 14 aa, Neisseria
LSSHPDIRLKQASS

SEQ ID NO: 14161 - protein, 9 aa, Neisseria
VGYDNQPDF

SEQ ID NO: 14162 - protein, 52 aa, Neisseria
ELNRIEADFGRERSFRNAPRTLDLDIIDFDGISSDDPRLTLPHPRAHERSFV

SEQ ID NO: 14163 - protein, 19 aa, Neisseria
LGKHGKVAELSKRLGNQGI

SEQ ID NO: 14164 - protein, 5 aa, Neisseria
LLPDK

SEQ ID NO: 14165 - protein, 9 aa, Neisseria
NLENPAQQV

SEQ ID NO: 14166 - protein, 7 aa, Neisseria
PDIRLKQ

SEQ ID NO: 14167 - protein, 23 aa, Neisseria
ELNRIEADFGRERSFRNAPRTLD

SEQ ID NO: 14168 - protein, 10 aa, Neisseria
DGISSDDPRL

SEQ ID NO: 14169 - protein, 8 aa, Neisseria
RAHERSFV

SEQ ID NO: 14170 - protein, 13 aa, Neisseria
KHGKVAELSKRLG

SEQ ID NO: 14171 - protein, 5 aa, Neisseria
LLPDK

SEQ ID NO: 14172 - protein, 26 aa, Neisseria
VAFERHHHKSKAEQNTHRRADAEIAE

SEQ ID NO: 14173 - protein, 10 aa, Neisseria
NQHTQARKQS

SEQ ID NO: 14174 - protein, 5 aa, Neisseria
FSDKV

SEQ ID NO: 14175 - protein, 10 aa, Neisseria
ADGGKTWQKP

SEQ ID NO: 14176 - protein, 26 aa, Neisseria
VAFERHHHKSKAEQNTHRRADAEIAE

SEQ ID NO: 14177 - protein, 7 aa, Neisseria
TQARKQS

SEQ ID NO: 14178 - protein, 7 aa, Neisseria
DGGKTWQ

SEQ ID NO: 14179 - protein, 5 aa, Neisseria
SASLG

SEQ ID NO: 14180 - protein, 6 aa, Neisseria
YDTVKG

SEQ ID NO: 14181 - protein, 8 aa, Neisseria
YQRPFGGH

SEQ ID NO: 14182 - protein, 7 aa, Neisseria
EHGKRAV

SEQ ID NO: 14183 - protein, 6 aa, Neisseria
LHTLYQ

SEQ ID NO: 14184 - protein, 5 aa, Neisseria
ASSTN

SEQ ID NO: 14185 - protein, 7 aa, Neisseria
YMNTGDG

SEQ ID NO: 14186 - protein, 7 aa, Neisseria
RYAPTVK

SEQ ID NO: 14187 - protein, 9 aa, Neisseria
IMEKLPGIR

SEQ ID NO: 14188 - protein, 10 aa, Neisseria
GIDPIKDPIP

SEQ ID NO: 14189 - protein, 8 aa, Neisseria
GGIPTNYH

SEQ ID NO: 14190 - protein, 16 aa, Neisseria
AAGDSMIKFIKEQSDW

SEQ ID NO: 14191 - protein, 6 aa, Neisseria
LDNQTD

SEQ ID NO: 14192 - protein, 10 aa, Neisseria
ENVDALRREL

SEQ ID NO: 14193 - protein, 13 aa, Neisseria
LSKGVREVMAIAE

SEQ ID NO: 14194 - protein, 5 aa, Neisseria
WNTAR

SEQ ID NO: 14195 - protein, 10 aa, Neisseria
ELDNLIEVAK

SEQ ID NO: 14196 - protein, 7 aa, Neisseria
GGGGAGL

SEQ ID NO: 14197 - protein, 6 aa, Neisseria
LSKSGL

SEQ ID NO: 14198 - protein, 7 aa, Neisseria
FPTRSHT

SEQ ID NO: 14199 - protein, 8 aa, Neisseria
NVQEDRWD

SEQ ID NO: 14200 - protein, 15 aa, Neisseria
DTVKGSDWLGDQDAI

SEQ ID NO: 14201 - protein, 17 aa, Neisseria
MPFDRVESGKIYQRPFG

SEQ ID NO: 14202 - protein, 20 aa, Neisseria
TAEHGKRAVERACAVADRTG

SEQ ID NO: 14203 - protein, 8 aa, Neisseria
QNVRANTQ

SEQ ID NO: 14204 - protein, 10 aa, Neisseria
DLIRDENGDV

SEQ ID NO: 14205 - protein, 7 aa, Neisseria
MEMETGE

SEQ ID NO: 14206 - protein, 7 aa, Neisseria
TGGGGRI

SEQ ID NO: 14207 - protein, 5 aa, Neisseria
SSTNA

SEQ ID NO: 14208 - protein, 6 aa, Neisseria
NTGDGL

SEQ ID NO: 14209 - protein, 7 aa, Neisseria
IPLEDME

SEQ ID NO: 14210 - protein, 9 aa, Neisseria
EGVRGEGGI

SEQ ID NO: 14211 - protein, 9 aa, Neisseria
NADGERFME

SEQ ID NO: 14212 - protein, 15 aa, Neisseria
YAPTVKDLASRDVVS

SEQ ID NO: 14213 - protein, 14 aa, Neisseria
IYEGRGCGKNKDHV

SEQ ID NO: 14214 - protein, 19 aa, Neisseria
DHIGAEKIMEKLPGIREIS

SEQ ID NO: 14215 - protein, 9 aa, Neisseria
GIDPIKDPI

SEQ ID NO: 14216 - protein, 12 aa, Neisseria
VVPQGDEYEVPV

SEQ ID NO: 14217 - protein, 10 aa, Neisseria
GANRLGTNSL

SEQ ID NO: 14218 - protein, 6 aa, Neisseria
AAGDSM

SEQ ID NO: 14219 - protein, 45 aa, Neisseria
FIKEQSDWKPLPANAGELTRQRIERLDNQTDGENVDALRRELQRS

SEQ ID NO: 14220 - protein, 13 aa, Neisseria
FRTDEILSKGVRE

SEQ ID NO: 14221 - protein, 18 aa, Neisseria
MAIAERVKRTEIKDKSKV

SEQ ID NO: 14222 - protein, 8 aa, Neisseria
ARIEALEL

SEQ ID NO: 14223 - protein, 25 aa, Neisseria
AEARKESRGAHASDDHPERDDENWM

SEQ ID NO: 14224 - protein, 19 aa, Neisseria
YHSDANTLSYKPVHTKPLS

SEQ ID NO: 14225 - protein, 7 aa, Neisseria
KPAKRVY

SEQ ID NO: 14226 - protein, 6 aa, Neisseria
LSKSGL

SEQ ID NO: 14227 - protein, 8 aa, Neisseria
NVQEDRWD

SEQ ID NO: 14228 - protein, 5 aa, Neisseria
DTVKG

SEQ ID NO: 14229 - protein, 9 aa, Neisseria
DWLGDQDAI

SEQ ID NO: 14230 - protein, 11 aa, Neisseria
PFDRVESGKIY

SEQ ID NO: 14231 - protein, 20 aa, Neisseria
TAEHGKRAVERACAVADRTG

SEQ ID NO: 14232 - protein, 9 aa, Neisseria
DLIRDENGD

SEQ ID NO: 14233 - protein, 7 aa, Neisseria
MEMETGE

SEQ ID NO: 14234 - protein, 7 aa, Neisseria
IPLEDME

SEQ ID NO: 14235 - protein, 7 aa, Neisseria
EGVRGEG

SEQ ID NO: 14236 - protein, 8 aa, Neisseria
ADGERFME

SEQ ID NO: 14237 - protein, 15 aa, Neisseria
YAPTVKDLASRDVVS

SEQ ID NO: 14238 - protein, 14 aa, Neisseria
IYEGRGCGKNKDHV

SEQ ID NO: 14239 - protein, 19 aa, Neisseria
DHIGAEKIMEKLPGIREIS

SEQ ID NO: 14240 - protein, 7 aa, Neisseria
DPIKDPI

SEQ ID NO: 14241 - protein, 9 aa, Neisseria
QGDEYEVPV

SEQ ID NO: 14242 - protein, 10 aa, Neisseria
FIKEQSDWKP

SEQ ID NO: 14243 - protein, 31 aa, Neisseria
NAGELTRQRIERLDNQTDGENVDALRRELQR

SEQ ID NO: 14244 - protein, 13 aa, Neisseria
FRTDEILSKGVRE

SEQ ID NO: 14245 - protein, 18 aa, Neisseria
MAIAERVKRTEIKDKSKV

SEQ ID NO: 14246 - protein, 8 aa, Neisseria
ARIEALEL

SEQ ID NO: 14247 - protein, 25 aa, Neisseria
AEARKESRGAHASDDHPERDDENWM

SEQ ID NO: 14248 - protein, 7 aa, Neisseria
KPAKRVY

SEQ ID NO: 14249 - protein, 7 aa, Neisseria
IRLINAA

SEQ ID NO: 14250 - protein, 5 aa, Neisseria
AILTK

SEQ ID NO: 14251 - protein, 14 aa, Neisseria
EVLHRYLPQMLSAG

SEQ ID NO: 14252 - protein, 10 aa, Neisseria
  VARIANT (1)...(10): Xaa is any amino acid
MAXMGKVMGV

SEQ ID NO: 14253 - protein, 9 aa, Neisseria
MRTHRKTCS

SEQ ID NO: 14254 - protein, 17 aa, Neisseria
TASKPAVSIRHPSENIM

SEQ ID NO: 14255 - protein, 17 aa, Neisseria
IRLTEDMKTAMRAKDQV

SEQ ID NO: 14256 - protein, 16 aa, Neisseria
KQFEVDERTEADDAKI

SEQ ID NO: 14257 - protein, 11 aa, Neisseria
MVKQRKDSVKI

SEQ ID NO: 14258 - protein, 16 aa, Neisseria
TEAGRQDLADKENAEI

SEQ ID NO: 14259 - protein, 9 aa, Neisseria
SAGEIRTAV

SEQ ID NO: 14260 - protein, 18 aa, Neisseria
  VARIANT (1)...(18): Xaa is any amino acid
XKTRLAGKADMGEVNKIL

SEQ ID NO: 14261 - protein, 8 aa, Neisseria
MRTHRKTC

SEQ ID NO: 14262 - protein, 17 aa, Neisseria
IRLTEDMKTAMRAKDQV

SEQ ID NO: 14263 - protein, 16 aa, Neisseria
KQFEVDERTEADDAKI

SEQ ID NO: 14264 - protein, 11 aa, Neisseria
MVKQRKDSVKI

SEQ ID NO: 14265 - protein, 16 aa, Neisseria
TEAGRQDLADKENAEI

SEQ ID NO: 14266 - protein, 7 aa, Neisseria
GEIRTAV

SEQ ID NO: 14267 - protein, 18 aa, Neisseria
  VARIANT (1)...(18): Xaa is any amino acid
XKTRLAGKADMGEVNKIL

SEQ ID NO: 14268 - protein, 23 aa, Neisseria
KLLEQLMRFLQFLSEFLFALFRI

SEQ ID NO: 14269 - protein, 8 aa, Neisseria
RALKFARR

SEQ ID NO: 14270 - protein, 7 aa, Neisseria
NNFIRHT

SEQ ID NO: 14271 - protein, 6 aa, Neisseria
QGFYGV

SEQ ID NO: 14272 - protein, 16 aa, Neisseria
GFLRFGRFLPTLLQTL

SEQ ID NO: 14273 - protein, 16 aa, Neisseria
FTHKSNRALKFARRHH

SEQ ID NO: 14274 - protein, 20 aa, Neisseria
RYFRYNTHRTDNRKRSGNNF

SEQ ID NO: 14275 - protein, 6 aa, Neisseria
RHTRHH

SEQ ID NO: 14276 - protein, 14 aa, Neisseria
TARRHLIDGDGQRN

SEQ ID NO: 14277 - protein, 9 aa, Neisseria
QTPKLRSRQ

SEQ ID NO: 14278 - protein, 8 aa, Neisseria
TFQSKQNL

SEQ ID NO: 14279 - protein, 14 aa, Neisseria
RLGNQKHRRNLMTQ

SEQ ID NO: 14280 - protein, 7 aa, Neisseria
IQHKKAG

SEQ ID NO: 14281 - protein, 13 aa, Neisseria
KSNRALKFARRHH

SEQ ID NO: 14282 - protein, 12 aa, Neisseria
NTHRTDNRKRSG

SEQ ID NO: 14283 - protein, 13 aa, Neisseria
TARRHLIDGDGQR

SEQ ID NO: 14284 - protein, 7 aa, Neisseria
PKLRSRQ

SEQ ID NO: 14285 - protein, 9 aa, Neisseria
GNQKHRRNL

SEQ ID NO: 14286 - protein, 7 aa, Neisseria
IQHKKAG

SEQ ID NO: 14287 - protein, 21 aa, Neisseria
  VARIANT (1)...(21): Xaa is any amino acid
VFXLWKNPEKPLAGFWKALPH

SEQ ID NO: 14288 - protein, 6 aa, Neisseria
MCCLTC

SEQ ID NO: 14289 - protein, 8 aa, Neisseria
WKNPEKPL

SEQ ID NO: 14290 - protein, 9 aa, Neisseria
MRARPRSTK

SEQ ID NO: 14291 - protein, 7 aa, Neisseria
KNPEKPL

SEQ ID NO: 14292 - protein, 9 aa, Neisseria
MRARPRSTK

SEQ ID NO: 14293 - protein, 5 aa, Neisseria
IQHLR

SEQ ID NO: 14294 - protein, 5 aa, Neisseria
DGAAA

SEQ ID NO: 14295 - protein, 6 aa, Neisseria
RIGNGY

SEQ ID NO: 14296 - protein, 7 aa, Neisseria
MVERHIQ

SEQ ID NO: 14297 - protein, 5 aa, Neisseria
LRNGH

SEQ ID NO: 14298 - protein, 6 aa, Neisseria
PSQQVR

SEQ ID NO: 14299 - protein, 14 aa, Neisseria
FGGRTYDFCADEAA

SEQ ID NO: 14300 - protein, 7 aa, Neisseria
YFADDKF

SEQ ID NO: 14301 - protein, 6 aa, Neisseria
LRGNLR

SEQ ID NO: 14302 - protein, 19 aa, Neisseria
FQTDKADLRTGEHYADGAA

SEQ ID NO: 14303 - protein, 5 aa, Neisseria
ADIRV

SEQ ID NO: 14304 - protein, 22 aa, Neisseria
RVARNKDMRNTGLHSQRIGNGY

SEQ ID NO: 14305 - protein, 7 aa, Neisseria
MVERHIQ

SEQ ID NO: 14306 - protein, 6 aa, Neisseria
CADEAA

SEQ ID NO: 14307 - protein, 7 aa, Neisseria
YFADDKF

SEQ ID NO: 14308 - protein, 15 aa, Neisseria
FQTDKADLRTGEHYA

SEQ ID NO: 14309 - protein, 5 aa, Neisseria
ADIRV

SEQ ID NO: 14310 - protein, 10 aa, Neisseria
RVARNKDMRN

SEQ ID NO: 14311 - protein, 6 aa, Neisseria
PADNIE

SEQ ID NO: 14312 - protein, 16 aa, Neisseria
GKTLADYGGYPSALDA

SEQ ID NO: 14313 - protein, 9 aa, Neisseria
AAYLENAGD

SEQ ID NO: 14314 - protein, 13 aa, Neisseria
AMAENVRNEWLKS

SEQ ID NO: 14315 - protein, 25 aa, Neisseria
AAELVKNTGKLPSGCTKLLEQAAAS

SEQ ID NO: 14316 - protein, 7 aa, Neisseria
DAWRRVR

SEQ ID NO: 14317 - protein, 15 aa, Neisseria
LAAALGSPFDGGTQG

SEQ ID NO: 14318 - protein, 10 aa, Neisseria
NVIGKEARKS

SEQ ID NO: 14319 - protein, 6 aa, Neisseria
ALLSEM

SEQ ID NO: 14320 - protein, 10 aa, Neisseria
NVPAALDYYG

SEQ ID NO: 14321 - protein, 19 aa, Neisseria
RRWDELASVISHMPEKLQK

SEQ ID NO: 14322 - protein, 10 aa, Neisseria
QEAEKLYKQA

SEQ ID NO: 14323 - protein, 5 aa, Neisseria
RYISP

SEQ ID NO: 14324 - protein, 7 aa, Neisseria
QGLMQVM

SEQ ID NO: 14325 - protein, 8 aa, Neisseria
RDYVKKVM

SEQ ID NO: 14326 - protein, 5 aa, Neisseria
PPSLK

SEQ ID NO: 14327 - protein, 46 aa, Neisseria
SSTNTLSADKTPADNIETADLSASVPTRPAEPEGKTLADYGGYPSA

SEQ ID NO: 14328 - protein, 9 aa, Neisseria
DAVKQKNDA

SEQ ID NO: 14329 - protein, 7 aa, Neisseria
NAGDSAM

SEQ ID NO: 14330 - protein, 6 aa, Neisseria
LGARRQ

SEQ ID NO: 14331 - protein, 42 aa, Neisseria; identical to SEQ ID NO: 74

SEQ ID NO: 14332 - protein, 14 aa, Neisseria
GLLDGNDAWRRVRG

SEQ ID NO: 14333 - protein, 11 aa, Neisseria
LAGRQTTDARN

SEQ ID NO: 14334 - protein, 13 aa, Neisseria
SPFDGGTQGSREY

SEQ ID NO: 14335 - protein, 10 aa, Neisseria
IGKEARKSPN

SEQ ID NO: 14336 - protein, 13 aa, Neisseria
SEMESGLSLEQRS

SEQ ID NO: 14337 - protein, 5 aa, Neisseria
QSQNL

SEQ ID NO: 14338 - protein, 16 aa, Neisseria
YYGKVADRRQLTDDQI

SEQ ID NO: 14339 - protein, 10 aa, Neisseria
AALRARRWDE

SEQ ID NO: 14340 - protein, 10 aa, Neisseria
MPEKLQKSPT

SEQ ID NO: 14341 - protein, 17 aa, Neisseria
RSRAATGNTQEAEKLYK

SEQ ID NO: 14342 - protein, 6 aa, Neisseria
AATGRN

SEQ ID NO: 14343 - protein, 23 aa, Neisseria
AGEELGRKIDTRNNVPDAGKNSV

SEQ ID NO: 14344 - protein, 9 aa, Neisseria
RMAEDGAIK

SEQ ID NO: 14345 - protein, 17 aa, Neisseria
RNSRTAGDAKMRRQAQA

SEQ ID NO: 14346 - protein, 12 aa, Neisseria
FATRGFDEDKLL

SEQ ID NO: 14347 - protein, 11 aa, Neisseria
SAERTDRKLNY

SEQ ID NO: 14348 - protein, 8 aa, Neisseria
SPFKDTVI

SEQ ID NO: 14349 - protein, 9 aa, Neisseria
AQNVNVDPA

SEQ ID NO: 14350 - protein, 7 aa, Neisseria
IRQESRF

SEQ ID NO: 14351 - protein, 7 aa, Neisseria
AQSRVGA

SEQ ID NO: 14352 - protein, 7 aa, Neisseria
TAREIAG

SEQ ID NO: 14353 - protein, 10 aa, Neisseria
YTADGNIRMG

SEQ ID NO: 14354 - protein, 11 aa, Neisseria
DTKRRLQNNEV

SEQ ID NO: 14355 - protein, 19 aa, Neisseria
GYNAGPGRARRWQADTPLE

SEQ ID NO: 14356 - protein, 8 aa, Neisseria
SETRDYVK

SEQ ID NO: 14357 - protein, 5 aa, Neisseria
LKQRM

SEQ ID NO: 14358 - protein, 16 aa, Neisseria
LSADKTPADNIETADL

SEQ ID NO: 14359 - protein, 14 aa, Neisseria
VPTRPAEPEGKTLA

SEQ ID NO: 14360 - protein, 9 aa, Neisseria
DAVKQKNDA

SEQ ID NO: 14361 - protein, 7 aa, Neisseria
NAGDSAM

SEQ ID NO: 14362 - protein, 6 aa, Neisseria
LGARRQ

SEQ ID NO: 14363 - protein, 42 aa, Neisseria; identical to SEQ ID NO: 74

SEQ ID NO: 14364 - protein, 11 aa, Neisseria
DGNDAWRRVRG

SEQ ID NO: 14365 - protein, 8 aa, Neisseria
RQTTDARN

SEQ ID NO: 14366 - protein, 10 aa, Neisseria
FDGGTQGSRE

SEQ ID NO: 14367 - protein, 10 aa, Neisseria
IGKEARKSPN

SEQ ID NO: 14368 - protein, 5 aa, Neisseria
SEMES

SEQ ID NO: 14369 - protein, 7 aa, Neisseria
LSLEQRS

SEQ ID NO: 14370 - protein, 12 aa, Neisseria
VADRRQLTDDQI

SEQ ID NO: 14371 - protein, 10 aa, Neisseria
AALRARRWDE

SEQ ID NO: 14372 - protein, 7 aa, Neisseria
MPEKLQK

SEQ ID NO: 14373 - protein, 6 aa, Neisseria
RSRAAT

SEQ ID NO: 14374 - protein, 10 aa, Neisseria
NTQEAEKLYK

SEQ ID NO: 14375 - protein, 20 aa, Neisseria
AGEELGRKIDTRNNVPDAGK

SEQ ID NO: 14376 - protein, 9 aa, Neisseria
RMAEDGAIK

SEQ ID NO: 14377 - protein, 17 aa, Neisseria
RNSRTAGDAKMRRQAQA

SEQ ID NO: 14378 - protein, 10 aa, Neisseria
TRGFDEDKLL

SEQ ID NO: 14379 - protein, 9 aa, Neisseria
SAERTDRKL

SEQ ID NO: 14380 - protein, 7 aa, Neisseria
IRQESRF

SEQ ID NO: 14381 - protein, 6 aa, Neisseria
AQSRVG

SEQ ID NO: 14382 - protein, 7 aa, Neisseria
TAREIAG

SEQ ID NO: 14383 - protein, 8 aa, Neisseria
DTKRRLQN

SEQ ID NO: 14384 - protein, 10 aa, Neisseria
GPGRARRWQA

SEQ ID NO: 14385 - protein, 8 aa, Neisseria
SETRDYVK

SEQ ID NO: 14386 - protein, 5 aa, Neisseria
LKQRM

SEQ ID NO: 14387 - protein, 33 aa, Neisseria; identical to SEQ ID NO: 127

SEQ ID NO: 14388 - protein, 5 aa, Neisseria
  VARIANT (1)...(5): Xaa is any amino acid
YXKPF

SEQ ID NO: 14389 - protein, 7 aa, Neisseria
MVERKLT

SEQ ID NO: 14390 - protein, 5 aa, Neisseria
PKEYS

SEQ ID NO: 14391 - protein, 8 aa, Neisseria
  VARIANT (1)...(8): Xaa is any amino acid
DYXKPFGV

SEQ ID NO: 14392 - protein, 7 aa, Neisseria
MVERKLT

SEQ ID NO: 14393 - protein, 11 aa, Neisseria
AAQLGGCPTQH

SEQ ID NO: 14394 - protein, 18 aa, Neisseria
MQTVPSAPVYNPYGATPY

SEQ ID NO: 14395 - protein, 12 aa, Neisseria
DTVYKISKCYHI

SEQ ID NO: 14396 - protein, 10 aa, Neisseria
DFRAWNGMTD

SEQ ID NO: 14397 - protein, 7 aa, Neisseria
IGQIVKV

SEQ ID NO: 14398 - protein, 10 aa, Neisseria
DFRAWNGMTD

SEQ ID NO: 14399 - protein, 7 aa, Neisseria
IGQIVKV

SEQ ID NO: 14400 - protein, 10 aa, Neisseria
AVQTPVKPAA

SEQ ID NO: 14401 - protein, 7 aa, Neisseria
VQSAPQP

SEQ ID NO: 14402 - protein, 5 aa, Neisseria
SGTRS

SEQ ID NO: 14403 - protein, 6 aa, Neisseria
KVVADF

SEQ ID NO: 14404 - protein, 7 aa, Neisseria
GLRGYGN

SEQ ID NO: 14405 - protein, 5 aa, Neisseria
PTQHP

SEQ ID NO: 14406 - protein, 6 aa, Neisseria
NSGMQT

SEQ ID NO: 14407 - protein, 6 aa, Neisseria
AANDAP

SEQ ID NO: 14408 - protein, 11 aa, Neisseria
VRGDTVYKISK

SEQ ID NO: 14409 - protein, 10 aa, Neisseria
YHISQDDFRA

SEQ ID NO: 14410 - protein, 8 aa, Neisseria
NGMTDNTL

SEQ ID NO: 14411 - protein, 7 aa, Neisseria
VKVKPAG

SEQ ID NO: 14412 - protein, 8 aa, Neisseria
AAVKSRPA

SEQ ID NO: 14413 - protein, 5 aa, Neisseria
VRGDT

SEQ ID NO: 14414 - protein, 15 aa, Neisseria
NISKRYHISQDDFRA

SEQ ID NO: 14415 - protein, 8 aa, Neisseria
NGMTDNTL

SEQ ID NO: 14416 - protein, 7 aa, Neisseria
VKVKPAG

SEQ ID NO: 14417 - protein, 8 aa, Neisseria
AAVKSRPA

SEQ ID NO: 14418 - protein, 16 aa, Neisseria
PVKPAAQPPVQSAPQP

SEQ ID NO: 14419 - protein, 8 aa, Neisseria
PAAENKAV

SEQ ID NO: 14420 - protein, 17 aa, Neisseria
PAPQSPAASPSGTRSVG

SEQ ID NO: 14421 - protein, 19 aa, Neisseria
RPTQGKVVADFGGNNKGVD

SEQ ID NO: 14422 - protein, 5 aa, Neisseria
ADGKV

SEQ ID NO: 14423 - protein, 7 aa, Neisseria
SGLRGYG

SEQ ID NO: 14424 - protein, 5 aa, Neisseria
YGHNQ

SEQ ID NO: 14425 - protein, 13 aa, Neisseria
LVGEGQQVKRGQQ

SEQ ID NO: 14426 - protein, 10 aa, Neisseria
GNTEASRTQL

SEQ ID NO: 14427 - protein, 14 aa, Neisseria
FEVRQNGKPVNPNS

SEQ ID NO: 14428 - protein, 5 aa, Neisseria
VRGDT

SEQ ID NO: 14429 - protein, 6 aa, Neisseria
SQDDFR

SEQ ID NO: 14430 - protein, 5 aa, Neisseria
VKVKP

SEQ ID NO: 14431 - protein, 8 aa, Neisseria
AAVKSRPA

SEQ ID NO: 14432 - protein, 5 aa, Neisseria
VRGDT

SEQ ID NO: 14433 - protein, 9 aa, Neisseria
YHISQDDFR

SEQ ID NO: 14434 - protein, 5 aa, Neisseria
VKVKP

SEQ ID NO: 14435 - protein, 8 aa, Neisseria
AAVKSRPA

SEQ ID NO: 14436 - protein, 5 aa, Neisseria
VKPAA

SEQ ID NO: 14437 - protein, 8 aa, Neisseria
PAAENKAV

SEQ ID NO: 14438 - protein, 5 aa, Neisseria
SGTRS

SEQ ID NO: 14439 - protein, 8 aa, Neisseria
GGNNKGVD

SEQ ID NO: 14440 - protein, 5 aa, Neisseria
ADGKV

SEQ ID NO: 14441 - protein, 9 aa, Neisseria
EGQQVKRGQ

SEQ ID NO: 14442 - protein, 6 aa, Neisseria
TEASRT

SEQ ID NO: 14443 - protein, 9 aa, Neisseria
VRQNGKPVN

SEQ ID NO: 14444 - protein, 7 aa, Neisseria
LRRPLRQ

SEQ ID NO: 14445 - protein, 10 aa, Neisseria
SFAGNVYPRL

SEQ ID NO: 14446 - protein, 14 aa, Neisseria
VHGQIQHPVQPFLR

SEQ ID NO: 14447 - protein, 9 aa, Neisseria
LGLLRRFDV

SEQ ID NO: 14448 - protein, 5 aa, Neisseria
MRRNV

SEQ ID NO: 14449 - protein, 7 aa, Neisseria
VLRRPLR

SEQ ID NO: 14450 - protein, 10 aa, Neisseria
RAVPAGKQGF

SEQ ID NO: 14451 - protein, 7 aa, Neisseria
CRLTQRQ

SEQ ID NO: 14452 - protein, 7 aa, Neisseria
AGQRNLP

SEQ ID NO: 14453 - protein, 8 aa, Neisseria
VIAHRQRV

SEQ ID NO: 14454 - protein, 11 aa, Neisseria
RRFDVGGRVGM

SEQ ID NO: 14455 - protein, 8 aa, Neisseria
TAFDQPGA

SEQ ID NO: 14456 - protein, 30 aa, Neisseria
LPPRRQLARQRPRIQTALRQPPQRRRKIAL

SEQ ID NO: 14457 - protein, 8 aa, Neisseria
HLCQQRKQ

SEQ ID NO: 14458 - protein, 21 aa, Neisseria
VKMRRKPVQNHNRPTQISKKQ

SEQ ID NO: 14459 - protein, 5 aa, Neisseria
MRRNV

SEQ ID NO: 14460 - protein, 7 aa, Neisseria
VLRRPLR

SEQ ID NO: 14461 - protein, 7 aa, Neisseria
RAVPAGK

SEQ ID NO: 14462 - protein, 5 aa, Neisseria
CRLTQ

SEQ ID NO: 14463 - protein, 8 aa, Neisseria
VIAHRQRV

SEQ ID NO: 14464 - protein, 7 aa, Neisseria
RRFDVGG

SEQ ID NO: 14465 - protein, 13 aa, Neisseria
PPRRQLARQRPRI

SEQ ID NO: 14466 - protein, 13 aa, Neisseria
LRQPPQRRRKIAL

SEQ ID NO: 14467 - protein, 8 aa, Neisseria
HLCQQRKQ

SEQ ID NO: 14468 - protein, 21 aa, Neisseria
VKMRRKPVQNHNRPTQISKKQ

SEQ ID NO: 14469 - protein, 15 aa, Neisseria
QYGGLAGFPKRCESE

SEQ ID NO: 14470 - protein, 9 aa, Neisseria
GQAFEALNC

SEQ ID NO: 14471 - protein, 23 aa, Neisseria
VGALPKYLASNVVRDMHGLLSTV

SEQ ID NO: 14472 - protein, 14 aa, Neisseria
QTGKVLDKIPGAME

SEQ ID NO: 14473 - protein, 6 aa, Neisseria
IKTLAE

SEQ ID NO: 14474 - protein, 6 aa, Neisseria
SLFENF

SEQ ID NO: 14475 - protein, 21 aa, Neisseria
GPVDGHNVENLVDVLEDLRGR

SEQ ID NO: 14476 - protein, 5 aa, Neisseria
AENDP

SEQ ID NO: 14477 - protein, 14 aa, Neisseria
KYHAVANLPKESAA

SEQ ID NO: 14478 - protein, 7 aa, Neisseria
YTQVFGK

SEQ ID NO: 14479 - protein, 8 aa, Neisseria
FPDRYFDV

SEQ ID NO: 14480 - protein, 8 aa, Neisseria
KPVVAIYS

SEQ ID NO: 14481 - protein, 9 aa, Neisseria
FLQRAYDQL

SEQ ID NO: 14482 - protein, 13 aa, Neisseria
DLSFLRCIPNMIV

SEQ ID NO: 14483 - protein, 9 aa, Neisseria
APAAVRYPR

SEQ ID NO: 14484 - protein, 8 aa, Neisseria
SDGMETVE

SEQ ID NO: 14485 - protein, 5 aa, Neisseria
IIRRE

SEQ ID NO: 14486 - protein, 6 aa, Neisseria
FGSMVA

SEQ ID NO: 14487 - protein, 10 aa, Neisseria
MRFVKPIDEE

SEQ ID NO: 14488 - protein, 6 aa, Neisseria
RSHDRI

SEQ ID NO: 14489 - protein, 6 aa, Neisseria
AVLEVL

SEQ ID NO: 14490 - protein, 7 aa, Neisseria
DTVTGHG

SEQ ID NO: 14491 - protein, 5 aa, Neisseria
PKKLL

SEQ ID NO: 14492 - protein, 13 aa, Neisseria
AGFPKRCESEYDA

SEQ ID NO: 14493 - protein, 6 aa, Neisseria
HSSTSI

SEQ ID NO: 14494 - protein, 13 aa, Neisseria
AADKQLGSDRRSV

SEQ ID NO: 14495 - protein, 6 aa, Neisseria
GDGAMT

SEQ ID NO: 14496 - protein, 7 aa, Neisseria
CAGDMDV

SEQ ID NO: 14497 - protein, 7 aa, Neisseria
NDNEMSI

SEQ ID NO: 14498 - protein, 8 aa, Neisseria
NVVRDMHG

SEQ ID NO: 14499 - protein, 14 aa, Neisseria
VKAQTGKVLDKIPG

SEQ ID NO: 14500 - protein, 21 aa, Neisseria
FAQKVEHKIKTLAEEAEHAKQ

SEQ ID NO: 14501 - protein, 9 aa, Neisseria
YTGPVDGHN

SEQ ID NO: 14502 - protein, 11 aa, Neisseria
VLEDLRGRKGP

SEQ ID NO: 14503 - protein, 17 aa, Neisseria
ITKKGNGYKLAENDPVK

SEQ ID NO: 14504 - protein, 7 aa, Neisseria
LPKESAA

SEQ ID NO: 14505 - protein, 15 aa, Neisseria
MPSEKEPKPAAKPTY

SEQ ID NO: 14506 - protein, 8 aa, Neisseria
RAAADSRL

SEQ ID NO: 14507 - protein, 20 aa, Neisseria
AMREGSGLVEFEQRFPDRYF

SEQ ID NO: 14508 - protein, 8 aa, Neisseria
VGADGPTH

SEQ ID NO: 14509 - protein, 10 aa, Neisseria
AAPSDENECR

SEQ ID NO: 14510 - protein, 8 aa, Neisseria
RYPRGTGT

SEQ ID NO: 14511 - protein, 23 aa, Neisseria
VSDGMETVEIGKGIIRREGEKTA

SEQ ID NO: 14512 - protein, 8 aa, Neisseria
KPIDEELI

SEQ ID NO: 14513 - protein, 21 aa, Neisseria
LARSHDRIVTLEENAEQGGAG

SEQ ID NO: 14514 - protein, 16 aa, Neisseria
VTGHGDPKKLLDDLGL

SEQ ID NO: 14515 - protein, 8 aa, Neisseria
EAVERRVR

SEQ ID NO: 14516 - protein, 8 aa, Neisseria
LSDRDAAN

SEQ ID NO: 14517 - protein, 10 aa, Neisseria
FPKRCESEYD

SEQ ID NO: 14518 - protein, 13 aa, Neisseria
AADKQLGSDRRSV

SEQ ID NO: 14519 - protein, 5 aa, Neisseria
GDMDV

SEQ ID NO: 14520 - protein, 7 aa, Neisseria
NDNEMSI

SEQ ID NO: 14521 - protein, 6 aa, Neisseria
VVRDMH

SEQ ID NO: 14522 - protein, 8 aa, Neisseria
KVLDKIPG

SEQ ID NO: 14523 - protein, 21 aa, Neisseria
FAQKVEHKIKTLAEEAEHAKQ

SEQ ID NO: 14524 - protein, 11 aa, Neisseria
VLEDLRGRKGP

SEQ ID NO: 14525 - protein, 7 aa, Neisseria
ITKKGNG

SEQ ID NO: 14526 - protein, 9 aa, Neisseria
KLAENDPVK

SEQ ID NO: 14527 - protein, 7 aa, Neisseria
LPKESAA

SEQ ID NO: 14528 - protein, 11 aa, Neisseria
MPSEKEPKPAA

SEQ ID NO: 14529 - protein, 8 aa, Neisseria
RAAADSRL

SEQ ID NO: 14530 - protein, 7 aa, Neisseria
AMREGSG

SEQ ID NO: 14531 - protein, 12 aa, Neisseria
VEFEQRFPDRYF

SEQ ID NO: 14532 - protein, 7 aa, Neisseria
PSDENEC

SEQ ID NO: 14533 - protein, 21 aa, Neisseria
DGMETVEIGKGIIRREGEKTA

SEQ ID NO: 14534 - protein, 8 aa, Neisseria
KPIDEELI

SEQ ID NO: 14535 - protein, 19 aa, Neisseria
LARSHDRIVTLEENAEQGG

SEQ ID NO: 14536 - protein, 11 aa, Neisseria
TGHGDPKKLLD

SEQ ID NO: 14537 - protein, 8 aa, Neisseria
EAVERRVR

SEQ ID NO: 14538 - protein, 8 aa, Neisseria
LSDRDAAN

SEQ ID NO: 14539 - protein, 5 aa, Neisseria
LDHAA

SEQ ID NO: 14540 - protein, 14 aa, Neisseria
NLEQMRAIMEAADQ

SEQ ID NO: 14541 - protein, 9 aa, Neisseria
AVEEFPHIP

SEQ ID NO: 14542 - protein, 6 aa, Neisseria
TVVNFS

SEQ ID NO: 14543 - protein, 10 aa, Neisseria
IGVLGNLETG

SEQ ID NO: 14544 - protein, 7 aa, Neisseria
GAVGKLS

SEQ ID NO: 14545 - protein, 15 aa, Neisseria
LTSVEDAVRFVKDTG

SEQ ID NO: 14546 - protein, 9 aa, Neisseria
YKFTRPPTG

SEQ ID NO: 14547 - protein, 14 aa, Neisseria
VLRIDRIKEIHQAL

SEQ ID NO: 14548 - protein, 35 aa, Neisseria; identical to SEQ ID NO: 289

SEQ ID NO: 14549 - protein, 7 aa, Neisseria
RRYLAEN

SEQ ID NO: 14550 - protein, 9 aa, Neisseria
LSKTIEAMK

SEQ ID NO: 14551 - protein, 19 aa, Neisseria
VSLEKMANRYAKGELNQIV

SEQ ID NO: 14552 - protein, 6 aa, Neisseria
LPKETQ

SEQ ID NO: 14553 - protein, 8 aa, Neisseria
HAAENSYG

SEQ ID NO: 14554 - protein, 13 aa, Neisseria
EQMRAIMEAADQV

SEQ ID NO: 14555 - protein, 8 aa, Neisseria
SAGARKYA

SEQ ID NO: 14556 - protein, 15 aa, Neisseria
HQDHGASPDVCQRSI

SEQ ID NO: 14557 - protein, 17 aa, Neisseria
MDGSLMEDGKTPSSYEY

SEQ ID NO: 14558 - protein, 5 aa, Neisseria
VEGEI

SEQ ID NO: 14559 - protein, 13 aa, Neisseria
NLETGEAGEEDGV

SEQ ID NO: 14560 - protein, 5 aa, Neisseria
LSHDQ

SEQ ID NO: 14561 - protein, 15 aa, Neisseria
SVEDAVRFVKDTGVD

SEQ ID NO: 14562 - protein, 5 aa, Neisseria
TSHGA

SEQ ID NO: 14563 - protein, 20 aa, Neisseria
KFTRPPTGDVLRIDRIKEIH

SEQ ID NO: 14564 - protein, 6 aa, Neisseria
GSSSVP

SEQ ID NO: 14565 - protein, 9 aa, Neisseria
NEYGGNIGE

SEQ ID NO: 14566 - protein, 27 aa, Neisseria
EIVEGIKHGVRKVNIDTDLRLASTGAV

SEQ ID NO: 14567 - protein, 23 aa, Neisseria
YLAENPSDFDPRKYLSKTIEAMK

SEQ ID NO: 14568 - protein, 25 aa, Neisseria
CEGQAGKIKPVSLEKMANRYAKGEL

SEQ ID NO: 14569 - protein, 13 aa, Neisseria
EQMRAIMEAADQV

SEQ ID NO: 14570 - protein, 7 aa, Neisseria
AGARKYA

SEQ ID NO: 14571 - protein, 10 aa, Neisseria
DHGASPDVCQ

SEQ ID NO: 14572 - protein, 10 aa, Neisseria
SLMEDGKTPS

SEQ ID NO: 14573 - protein, 5 aa, Neisseria
VEGEI

SEQ ID NO: 14574 - protein, 11 aa, Neisseria
ETGEAGEEDGV

SEQ ID NO: 14575 - protein, 14 aa, Neisseria
SVEDAVRFVKDTGV

SEQ ID NO: 14576 - protein, 12 aa, Neisseria
DVLRIDRIKEIH

SEQ ID NO: 14577 - protein, 21 aa, Neisseria
EIVEGIKHGVRKVNIDTDLRL

SEQ ID NO: 14578 - protein, 19 aa, Neisseria
NPSDFDPRKYLSKTIEAMK

SEQ ID NO: 14579 - protein, 23 aa, Neisseria
GQAGKIKPVSLEKMANRYAKGEL

SEQ ID NO: 14580 - protein, 8 aa, Neisseria
AVYSACAA

SEQ ID NO: 14581 - protein, 7 aa, Neisseria
GRCVNQY

SEQ ID NO: 14582 - protein, 10 aa, Neisseria
SSGRFCQTIK

SEQ ID NO: 14583 - protein, 7 aa, Neisseria
AASAAQS

SEQ ID NO: 14584 - protein, 14 aa, Neisseria
SACRTMHKTLRPYV

SEQ ID NO: 14585 - protein, 5 aa, Neisseria
RLKEY

SEQ ID NO: 14586 - protein, 26 aa, Neisseria
PARTSSSRRCVSSGRCVNQYSSRADA

SEQ ID NO: 14587 - protein, 8 aa, Neisseria
PWRRHSGA

SEQ ID NO: 14588 - protein, 9 aa, Neisseria
CSSDSSGRF

SEQ ID NO: 14589 - protein, 21 aa, Neisseria
PSFSARKTCSDGETSADSNWR

SEQ ID NO: 14590 - protein, 10 aa, Neisseria
HADGLQTASS

SEQ ID NO: 14591 - protein, 10 aa, Neisseria
  VARIANT (1)...(10): Xaa is any amino acid
SAXTARRMFT

SEQ ID NO: 14592 - protein, 62 aa, Neisseria
  VARIANT (1)...(62): Xaa is any amino acid
QSRRFCCGRRAARRVPQRRRENRLQPPDXGSRRRSAYRVCLRRADGFPARTHCRCRLKRRIL

SEQ ID NO: 14593 - protein, 35 aa, Neisseria
LPPDRPDNRSNGGGSACRTMHKTLRPYVRPQRQGC

SEQ ID NO: 14594 - protein, 18 aa, Neisseria
AARRRHRARVRRLKEYQT

SEQ ID NO: 14595 - protein, 10 aa, Neisseria
NLAPRRCRYA

SEQ ID NO: 14596 - protein, 11 aa, Neisseria
RTSSSRRCVSS

SEQ ID NO: 14597 - protein, 6 aa, Neisseria
YSSRAD

SEQ ID NO: 14598 - protein, 5 aa, Neisseria
RRHSG

SEQ ID NO: 14599 - protein, 8 aa, Neisseria
CSSDSSGR

SEQ ID NO: 14600 - protein, 14 aa, Neisseria
FSARKTCSDGETSA

SEQ ID NO: 14601 - protein, 7 aa, Neisseria
  VARIANT (1)...(7): Xaa is any amino acid
XTARRMF

SEQ ID NO: 14602 - protein, 34 aa, Neisseria
  VARIANT (1)...(34): Xaa is any amino acid
RFCCGRRAARRVPQRRRENRLQPPDXGSRRRSAY

SEQ ID NO: 14603 - protein, 9 aa, Neisseria
CLRRADGFP

SEQ ID NO: 14604 - protein, 12 aa, Neisseria
THCRCRLKRRIL

SEQ ID NO: 14605 - protein, 12 aa, Neisseria
PPDRPDNRSNGG

SEQ ID NO: 14606 - protein, 16 aa, Neisseria
TMHKTLRPYVRPQRQG

SEQ ID NO: 14607 - protein, 17 aa, Neisseria
AARRRHRARVRRLKEYQ

SEQ ID NO: 14608 - protein, 7 aa, Neisseria
APRRCRY

SEQ ID NO: 14609 - protein, 5 aa, Neisseria
EAKDH

SEQ ID NO: 14610 - protein, 15 aa, Neisseria
EKGTGELSAVQEVEK

SEQ ID NO: 14611 - protein, 7 aa, Neisseria
APIASLN

SEQ ID NO: 14612 - protein, 18 aa, Neisseria
EFGQFLEPVRAYRRQYGV

SEQ ID NO: 14613 - protein, 7 aa, Neisseria
TDFRQDF

SEQ ID NO: 14614 - protein, 11 aa, Neisseria
EFTTKAGRRSP

SEQ ID NO: 14615 - protein, 7 aa, Neisseria
GLFNDGL

SEQ ID NO: 14616 - protein, 6 aa, Neisseria
IESGIR

SEQ ID NO: 14617 - protein, 6 aa, Neisseria
LAEKGV

SEQ ID NO: 14618 - protein, 13 aa, Neisseria
YNRKEAKDHGEGG

SEQ ID NO: 14619 - protein, 21 aa, Neisseria
VISAGTSVRESIKLIEAEGAT

SEQ ID NO: 14620 - protein, 10 aa, Neisseria
LDRMEKGTGE

SEQ ID NO: 14621 - protein, 9 aa, Neisseria
QEVEKQYGL

SEQ ID NO: 14622 - protein, 8 aa, Neisseria
QNNPEFGQ

SEQ ID NO: 14623 - protein, 11 aa, Neisseria
VRAYRRQYGVE

SEQ ID NO: 14624 - protein, 7 aa, Neisseria
TDFRQDF

SEQ ID NO: 14625 - protein, 10 aa, Neisseria
EFTTKAGRRS

SEQ ID NO: 14626 - protein, 6 aa, Neisseria
LAEKGV

SEQ ID NO: 14627 - protein, 11 aa, Neisseria
YNRKEAKDHGE

SEQ ID NO: 14628 - protein, 16 aa, Neisseria
TSVRESIKLIEAEGAT

SEQ ID NO: 14629 - protein, 10 aa, Neisseria
LDRMEKGTGE

SEQ ID NO: 14630 - protein, 7 aa, Neisseria
QEVEKQY

SEQ ID NO: 14631 - protein, 8 aa, Neisseria
RAYRRQYG

SEQ ID NO: 14632 - protein, 5 aa, Neisseria
AAPYI

SEQ ID NO: 14633 - protein, 5 aa, Neisseria
AGIDD

SEQ ID NO: 14634 - protein, 6 aa, Neisseria
DTLNKF

SEQ ID NO: 14635 - protein, 12 aa, Neisseria
PHYCRGLRVTDE

SEQ ID NO: 14636 - protein, 9 aa, Neisseria
LEQAQQFAG

SEQ ID NO: 14637 - protein, 9 aa, Neisseria
SVSGFARAP

SEQ ID NO: 14638 - protein, 8 aa, Neisseria
RPIGVIDG

SEQ ID NO: 14639 - protein, 6 aa, Neisseria
YAGVIR

SEQ ID NO: 14640 - protein, 9 aa, Neisseria
LSDGISRPD

SEQ ID NO: 14641 - protein, 9 aa, Neisseria
EAQSLAEHA

SEQ ID NO: 14642 - protein, 8 aa, Neisseria
SAVAALEG

SEQ ID NO: 14643 - protein, 5 aa, Neisseria
IGTSI

SEQ ID NO: 14644 - protein, 20 aa, Neisseria
IRQAHSGDIPHIAALIRPLE

SEQ ID NO: 14645 - protein, 11 aa, Neisseria
YLENHISEFSI

SEQ ID NO: 14646 - protein, 13 aa, Neisseria
YGCAALKTFAEAD

SEQ ID NO: 14647 - protein, 6 aa, Neisseria
RLLAHI

SEQ ID NO: 14648 - protein, 5 aa, Neisseria
SRLFA

SEQ ID NO: 14649 - protein, 16 aa, Neisseria
FREAAPYIRQMRGKTL

SEQ ID NO: 14650 - protein, 13 aa, Neisseria
GIDDRLLEGDTLN

SEQ ID NO: 14651 - protein, 32 aa, Neisseria; identical to SEQ ID NO: 393

SEQ ID NO: 14652 - protein, 7 aa, Neisseria
TVRSRFE

SEQ ID NO: 14653 - protein, 5 aa, Neisseria
RAPSV

SEQ ID NO: 14654 - protein, 7 aa, Neisseria
DGTDMEY

SEQ ID NO: 14655 - protein, 8 aa, Neisseria
IRKTDTAA

SEQ ID NO: 14656 - protein, 10 aa, Neisseria
LGHSYSGKTF

SEQ ID NO: 14657 - protein, 11 aa, Neisseria
SDGISRPDGTL

SEQ ID NO: 14658 - protein, 19 aa, Neisseria
AQEAQSLAEHAGGETRRLI

SEQ ID NO: 14659 - protein, 5 aa, Neisseria
LEGGV

SEQ ID NO: 14660 - protein, 8 aa, Neisseria
GAADGSLL

SEQ ID NO: 14661 - protein, 16 aa, Neisseria
FTRNGIGTSIAKEAFV

SEQ ID NO: 14662 - protein, 9 aa, Neisseria
IRQAHSGDI

SEQ ID NO: 14663 - protein, 7 aa, Neisseria
RPLEEQG

SEQ ID NO: 14664 - protein, 9 aa, Neisseria
LLHRSREYL

SEQ ID NO: 14665 - protein, 8 aa, Neisseria
LEHDGNLY

SEQ ID NO: 14666 - protein, 9 aa, Neisseria
TFAEADCGE

SEQ ID NO: 14667 - protein, 12 aa, Neisseria
PQAQDGGYGERL

SEQ ID NO: 14668 - protein, 6 aa, Neisseria
IDKARG

SEQ ID NO: 14669 - protein, 5 aa, Neisseria
TNTGE

SEQ ID NO: 14670 - protein, 29 aa, Neisseria
RGFQTASEDELPETRRKDYRSNGRNSHIL

SEQ ID NO: 14671 - protein, 6 aa, Neisseria
FREAAP

SEQ ID NO: 14672 - protein, 7 aa, Neisseria
RQMRGKT

SEQ ID NO: 14673 - protein, 13 aa, Neisseria
GIDDRLLEGDTLN

SEQ ID NO: 14674 - protein, 13 aa, Neisseria
HFLDRHAAAQGRT

SEQ ID NO: 14675 - protein, 11 aa, Neisseria
LRVTDETSLEQ

SEQ ID NO: 14676 - protein, 6 aa, Neisseria
VRSRFE

SEQ ID NO: 14677 - protein, 7 aa, Neisseria
DGTDMEY

SEQ ID NO: 14678 - protein, 8 aa, Neisseria
IRKTDTAA

SEQ ID NO: 14679 - protein, 7 aa, Neisseria
GISRPDG

SEQ ID NO: 14680 - protein, 9 aa, Neisseria
AQEAQSLAE

SEQ ID NO: 14681 - protein, 9 aa, Neisseria
AGGETRRLI

SEQ ID NO: 14682 - protein, 6 aa, Neisseria
QAHSGD

SEQ ID NO: 14683 - protein, 7 aa, Neisseria
RPLEEQG

SEQ ID NO: 14684 - protein, 7 aa, Neisseria
HRSREYL

SEQ ID NO: 14685 - protein, 9 aa, Neisseria
TFAEADCGE

SEQ ID NO: 14686 - protein, 9 aa, Neisseria
QAQDGGYGE

SEQ ID NO: 14687 - protein, 6 aa, Neisseria
IDKARG

SEQ ID NO: 14688 - protein, 25 aa, Neisseria
RGFQTASEDELPETRRKDYRSNGRN

SEQ ID NO: 14689 - protein, 14 aa, Neisseria
DPYRHFENLDSAET

SEQ ID NO: 14690 - protein, 5 aa, Neisseria
DGILA

SEQ ID NO: 14691 - protein, 10 aa, Neisseria
KGVYRVCTAA

SEQ ID NO: 14692 - protein, 8 aa, Neisseria
VADFDELL

SEQ ID NO: 14693 - protein, 10 aa, Neisseria
GVSHLVEQPN

SEQ ID NO: 14694 - protein, 9 aa, Neisseria
MVNAWRYLD

SEQ ID NO: 14695 - protein, 7 aa, Neisseria
IDLIEAS

SEQ ID NO: 14696 - protein, 13 aa, Neisseria
LNLPNDCDVVGYL

SEQ ID NO: 14697 - protein, 8 aa, Neisseria
QALESVET

SEQ ID NO: 14698 - protein, 10 aa, Neisseria
ASLLENVQGR

SEQ ID NO: 14699 - protein, 8 aa, Neisseria
TELPRLPS

SEQ ID NO: 14700 - protein, 6 aa, Neisseria
DFTTPL

SEQ ID NO: 14701 - protein, 5 aa, Neisseria
QPQQF

SEQ ID NO: 14702 - protein, 16 aa, Neisseria
GFGIPELPHYLGSIGK

SEQ ID NO: 14703 - protein, 19 aa, Neisseria
AAQGISKHKSVDDLLAVVS

SEQ ID NO: 14704 - protein, 5 aa, Neisseria
SSPEH

SEQ ID NO: 14705 - protein, 6 aa, Neisseria
VREPQS

SEQ ID NO: 14706 - protein, 7 aa, Neisseria
LTDMIRY

SEQ ID NO: 14707 - protein, 12 aa, Neisseria
WTDEYGNPQKYE

SEQ ID NO: 14708 - protein, 15 aa, Neisseria
LSPYHNLSDGIDYPP

SEQ ID NO: 14709 - protein, 5 aa, Neisseria
AHALK

SEQ ID NO: 14710 - protein, 11 aa, Neisseria
GHTGNGTQREA

SEQ ID NO: 14711 - protein, 20 aa, Neisseria
MKSYPDPYRHFENLDSAETQ

SEQ ID NO: 14712 - protein, 21 aa, Neisseria
ANAETRARFLNNDKARALSDG

SEQ ID NO: 14713 - protein, 9 aa, Neisseria
LQDTRQIPF

SEQ ID NO: 14714 - protein, 6 aa, Neisseria
QEHRAR

SEQ ID NO: 14715 - protein, 9 aa, Neisseria
QDAEYPKGV

SEQ ID NO: 14716 - protein, 8 aa, Neisseria
YRSGYPEW

SEQ ID NO: 14717 - protein, 11 aa, Neisseria
DFDELLGDDVY

SEQ ID NO: 14718 - protein, 5 aa, Neisseria
EQPNR

SEQ ID NO: 14719 - protein, 8 aa, Neisseria
LSKSGGDT

SEQ ID NO: 14720 - protein, 10 aa, Neisseria
VDLEAGELVE

SEQ ID NO: 14721 - protein, 14 aa, Neisseria
AGKNHVSWRDENSV

SEQ ID NO: 14722 - protein, 30 aa, Neisseria
PAWDERQLTESGYPREVWLVERGKSFEESL

SEQ ID NO: 14723 - protein, 6 aa, Neisseria
IAEDGM

SEQ ID NO: 14724 - protein, 20 aa, Neisseria
RYLDPQGSPIDLIEASDGFY

SEQ ID NO: 14725 - protein, 17 aa, Neisseria
SAEGEAKPLNLPNDCDV

SEQ ID NO: 14726 - protein, 14 aa, Neisseria
LRKDWHRANQSYPS

SEQ ID NO: 14727 - protein, 8 aa, Neisseria
KLNRGELG

SEQ ID NO: 14728 - protein, 7 aa, Neisseria
APNETQA

SEQ ID NO: 14729 - protein, 7 aa, Neisseria
ESVETTK

SEQ ID NO: 14730 - protein, 7 aa, Neisseria
VQGRLKA

SEQ ID NO: 14731 - protein, 18 aa, Neisseria
RFTDGKWQETELPRLPSG

SEQ ID NO: 14732 - protein, 9 aa, Neisseria
EMTDQPWGG

SEQ ID NO: 14733 - protein, 15 aa, Neisseria
VMRRQPQQFDSDGIN

SEQ ID NO: 14734 - protein, 8 aa, Neisseria
TSADGERI

SEQ ID NO: 14735 - protein, 8 aa, Neisseria
GKNAAPDM

SEQ ID NO: 14736 - protein, 13 aa, Neisseria
NIRGGGEFGPRWH

SEQ ID NO: 14737 - protein, 10 aa, Neisseria
GISKHKSVDD

SEQ ID NO: 14738 - protein, 12 aa, Neisseria
DLSERGISSPEH

SEQ ID NO: 14739 - protein, 5 aa, Neisseria
GGSNG

SEQ ID NO: 14740 - protein, 10 aa, Neisseria
FVREPQSIGA

SEQ ID NO: 14741 - protein, 27 aa, Neisseria
GSSWTDEYGNPQKYEVCKRRLGELSPY

SEQ ID NO: 14742 - protein, 9 aa, Neisseria
NLSDGIDYP

SEQ ID NO: 14743 - protein, 9 aa, Neisseria
TSLSDDRVH

SEQ ID NO: 14744 - protein, 10 aa, Neisseria
AKLRETSPQS

SEQ ID NO: 14745 - protein, 21 aa, Neisseria
YSPDGGGHTGNGTQREAADEL

SEQ ID NO: 14746 - protein, 8 aa, Neisseria
SYPDPYRH

SEQ ID NO: 14747 - protein, 8 aa, Neisseria
ENLDSAET

SEQ ID NO: 14748 - protein, 19 aa, Neisseria
ANAETRARFLNNDKARALS

SEQ ID NO: 14749 - protein, 5 aa, Neisseria
QDTRQ

SEQ ID NO: 14750 - protein, 6 aa, Neisseria
QEHRAR

SEQ ID NO: 14751 - protein, 6 aa, Neisseria
QDAEYP

SEQ ID NO: 14752 - protein, 7 aa, Neisseria
DFDELLG

SEQ ID NO: 14753 - protein, 5 aa, Neisseria
KSGGD

SEQ ID NO: 14754 - protein, 10 aa, Neisseria
VDLEAGELVE

SEQ ID NO: 14755 - protein, 8 aa, Neisseria
VSWRDENS

SEQ ID NO: 14756 - protein, 7 aa, Neisseria
WDERQLT

SEQ ID NO: 14757 - protein, 10 aa, Neisseria
ERGKSFEESL

SEQ ID NO: 14758 - protein, 6 aa, Neisseria
IAEDGM

SEQ ID NO: 14759 - protein, 7 aa, Neisseria
DLIEASD

SEQ ID NO: 14760 - protein, 7 aa, Neisseria
AEGEAKP

SEQ ID NO: 14761 - protein, 7 aa, Neisseria
LRKDWHR

SEQ ID NO: 14762 - protein, 8 aa, Neisseria
KLNRGELG

SEQ ID NO: 14763 - protein, 7 aa, Neisseria
ESVETTK

SEQ ID NO: 14764 - protein, 7 aa, Neisseria
VQGRLKA

SEQ ID NO: 14765 - protein, 9 aa, Neisseria
KWQETELPR

SEQ ID NO: 14766 - protein, 15 aa, Neisseria
VMRRQPQQFDSDGIN

SEQ ID NO: 14767 - protein, 5 aa, Neisseria
ADGER

SEQ ID NO: 14768 - protein, 6 aa, Neisseria
KNAAPD

SEQ ID NO: 14769 - protein, 7 aa, Neisseria
RGGGEFG

SEQ ID NO: 14770 - protein, 10 aa, Neisseria
GISKHKSVDD

SEQ ID NO: 14771 - protein, 9 aa, Neisseria
DLSERGISS

SEQ ID NO: 14772 - protein, 7 aa, Neisseria
FVREPQS

SEQ ID NO: 14773 - protein, 7 aa, Neisseria
WTDEYGN

SEQ ID NO: 14774 - protein, 12 aa, Neisseria
QKYEVCKRRLGE

SEQ ID NO: 14775 - protein, 7 aa, Neisseria
LSDDRVH

SEQ ID NO: 14776 - protein, 7 aa, Neisseria
AKLRETS

SEQ ID NO: 14777 - protein, 10 aa, Neisseria
GTQREAADEL

SEQ ID NO: 14778 - protein, 7 aa, Neisseria
ALSNTST

SEQ ID NO: 14779 - protein, 8 aa, Neisseria
AVRSMMKI

SEQ ID NO: 14780 - protein, 10 aa, Neisseria
SPLVRILPLS

SEQ ID NO: 14781 - protein, 9 aa, Neisseria
SMVVAFFAN

SEQ ID NO: 14782 - protein, 16 aa, Neisseria
RTSALSNTSTAAGPSC

SEQ ID NO: 14783 - protein, 26 aa, Neisseria
YSKETGCPCPSLRKDSSTGGRPMSPC

SEQ ID NO: 14784 - protein, 12 aa, Neisseria
LANRDCVPKADT

SEQ ID NO: 14785 - protein, 9 aa, Neisseria
TDSTSPRPL

SEQ ID NO: 14786 - protein, 12 aa, Neisseria
ARASLPKIRAKV

SEQ ID NO: 14787 - protein, 9 aa, Neisseria
CSYASAPGP

SEQ ID NO: 14788 - protein, 7 aa, Neisseria
YSKETGC

SEQ ID NO: 14789 - protein, 13 aa, Neisseria
SLRKDSSTGGRPM

SEQ ID NO: 14790 - protein, 11 aa, Neisseria
ANRDCVPKADT

SEQ ID NO: 14791 - protein, 6 aa, Neisseria
DSTSPR

SEQ ID NO: 14792 - protein, 9 aa, Neisseria
SLPKIRAKV

SEQ ID NO: 14793 - protein, 5 aa, Neisseria
VEPSR

SEQ ID NO: 14794 - protein, 15 aa, Neisseria
HGGLDGAAGFDEGER

SEQ ID NO: 14795 - protein, 6 aa, Neisseria
ASGDGF

SEQ ID NO: 14796 - protein, 9 aa, Neisseria
AGDFGDGQR

SEQ ID NO: 14797 - protein, 5 aa, Neisseria
MPPAP

SEQ ID NO: 14798 - protein, 18 aa, Neisseria
IRRQKSVMPSERFVEPSR

SEQ ID NO: 14799 - protein, 18 aa, Neisseria
VHGGLDGAAGFDEGERVF

SEQ ID NO: 14800 - protein, 10 aa, Neisseria
AAQASGDGFA

SEQ ID NO: 14801 - protein, 16 aa, Neisseria
QSDAAGDFGDGQRTGE

SEQ ID NO: 14802 - protein, 7 aa, Neisseria
VLQDVGG

SEQ ID NO: 14803 - protein, 6 aa, Neisseria
AEGEAQ

SEQ ID NO: 14804 - protein, 18 aa, Neisseria
IRRQKSVMPSERFVEPSR

SEQ ID NO: 14805 - protein, 10 aa, Neisseria
AGFDEGERVF

SEQ ID NO: 14806 - protein, 13 aa, Neisseria
DAAGDFGDGQRTG

SEQ ID NO: 14807 - protein, 6 aa, Neisseria
AEGEAQ

SEQ ID NO: 14808 - protein, 6 aa, Neisseria
RPTSSP

SEQ ID NO: 14809 - protein, 9 aa, Neisseria
TSCSGLMVS

SEQ ID NO: 14810 - protein, 6 aa, Neisseria
FSLFSS

SEQ ID NO: 14811 - protein, 5 aa, Neisseria
KSASS

SEQ ID NO: 14812 - protein, 7 aa, Neisseria
SCNAFSS

SEQ ID NO: 14813 - protein, 14 aa, Neisseria
TSLLGMAARFCATV

SEQ ID NO: 14814 - protein, 11 aa, Neisseria
RPTSSPPRRAC

SEQ ID NO: 14815 - protein, 25 aa, Neisseria
IRTRSSAKRKTCNAPGQSIRPASCS

SEQ ID NO: 14816 - protein, 7 aa, Neisseria
PNMERLP

SEQ ID NO: 14817 - protein, 21 aa, Neisseria
SRYSLERTRAMRPGMLNRSAA

SEQ ID NO: 14818 - protein, 38 aa, Neisseria; identical to SEQ ID NO: 560

SEQ ID NO: 14819 - protein, 8 aa, Neisseria
EPTCPLPK

SEQ ID NO: 14820 - protein, 10 aa, Neisseria
PTSSPPRRAC

SEQ ID NO: 14821 - protein, 13 aa, Neisseria
IRTRSSAKRKTCN

SEQ ID NO: 14822 - protein, 7 aa, Neisseria
QSIRPAS

SEQ ID NO: 14823 - protein, 6 aa, Neisseria
NMERLP

SEQ ID NO: 14824 - protein, 12 aa, Neisseria
SRYSLERTRAMR

SEQ ID NO: 14825 - protein, 12 aa, Neisseria
SLRESASSKSAS

SEQ ID NO: 14826 - protein, 13 aa, Neisseria
APARSNVKGDAPL

SEQ ID NO: 14827 - protein, 12 aa, Neisseria
IADIAQDLPDGA

SEQ ID NO: 14828 - protein, 7 aa, Neisseria
AENIGAV

SEQ ID NO: 14829 - protein, 7 aa, Neisseria
RLAKQLE

SEQ ID NO: 14830 - protein, 8 aa, Neisseria
YIDEIDVF

SEQ ID NO: 14831 - protein, 5 aa, Neisseria
SALLA

SEQ ID NO: 14832 - protein, 5 aa, Neisseria
LLEGN

SEQ ID NO: 14833 - protein, 6 aa, Neisseria
IGSILA

SEQ ID NO: 14834 - protein, 9 aa, Neisseria
SGIKWPEGC

SEQ ID NO: 14835 - protein, 10 aa, Neisseria
IAAVVRAGTG

SEQ ID NO: 14836 - protein, 9 aa, Neisseria
ILNELEKLI

SEQ ID NO: 14837 - protein, 8 aa, Neisseria
QARRGGLL

SEQ ID NO: 14838 - protein, 10 aa, Neisseria
IAQDLPDGAD

SEQ ID NO: 14839 - protein, 6 aa, Neisseria
YRNNRL

SEQ ID NO: 14840 - protein, 5 aa, Neisseria
IEGDE

SEQ ID NO: 14841 - protein, 14 aa, Neisseria
PELRPKETSTRRIM

SEQ ID NO: 14842 - protein, 5 aa, Neisseria
GGGNI

SEQ ID NO: 14843 - protein, 5 aa, Neisseria
KQLEH

SEQ ID NO: 14844 - protein, 12 aa, Neisseria
IIECRPRRAEWI

SEQ ID NO: 14845 - protein, 7 aa, Neisseria
ENLDNTL

SEQ ID NO: 14846 - protein, 17 aa, Neisseria
SATDETLLDNEYIDEID

SEQ ID NO: 14847 - protein, 8 aa, Neisseria
TNDDESNI

SEQ ID NO: 14848 - protein, 6 aa, Neisseria
LGAKRV

SEQ ID NO: 14849 - protein, 5 aa, Neisseria
NRSSY

SEQ ID NO: 14850 - protein, 6 aa, Neisseria
LEGNKI

SEQ ID NO: 14851 - protein, 8 aa, Neisseria
HIRRGDIV

SEQ ID NO: 14852 - protein, 11 aa, Neisseria
PIRRGTAEAIE

SEQ ID NO: 14853 - protein, 8 aa, Neisseria
AHGDKKTS

SEQ ID NO: 14854 - protein, 15 aa, Neisseria
IGRRISGIKWPEGCH

SEQ ID NO: 14855 - protein, 7 aa, Neisseria
RAGTGET

SEQ ID NO: 14856 - protein, 7 aa, Neisseria
VIQDGDH

SEQ ID NO: 14857 - protein, 12 aa, Neisseria
VSRRRILNELEK

SEQ ID NO: 14858 - protein, 6 aa, Neisseria
QARRGG

SEQ ID NO: 14859 - protein, 10 aa, Neisseria
IAQDLPDGAD

SEQ ID NO: 14860 - protein, 5 aa, Neisseria
IEGDE

SEQ ID NO: 14861 - protein, 14 aa, Neisseria
PELRPKETSTRRIM

SEQ ID NO: 14862 - protein, 12 aa, Neisseria
IIECRPRRAEWI

SEQ ID NO: 14863 - protein, 8 aa, Neisseria
SATDETLL

SEQ ID NO: 14864 - protein, 7 aa, Neisseria
EYIDEID

SEQ ID NO: 14865 - protein, 8 aa, Neisseria
TNDDESNI

SEQ ID NO: 14866 - protein, 6 aa, Neisseria
LGAKRV

SEQ ID NO: 14867 - protein, 6 aa, Neisseria
LEGNKI

SEQ ID NO: 14868 - protein, 6 aa, Neisseria
IRRGDI

SEQ ID NO: 14869 - protein, 11 aa, Neisseria
PIRRGTAEAIE

SEQ ID NO: 14870 - protein, 8 aa, Neisseria
AHGDKKTS

SEQ ID NO: 14871 - protein, 6 aa, Neisseria
IGRRIS

SEQ ID NO: 14872 - protein, 6 aa, Neisseria
VIQDGD

SEQ ID NO: 14873 - protein, 11 aa, Neisseria
SRRRILNELEK

SEQ ID NO: 14874 - protein, 5 aa, Neisseria
QHLLE

SEQ ID NO: 14875 - protein, 11 aa, Neisseria
TDDTVDGIGQM

SEQ ID NO: 14876 - protein, 5 aa, Neisseria
QPFGQ

SEQ ID NO: 14877 - protein, 10 aa, Neisseria
EHFAPVDGFR

SEQ ID NO: 14878 - protein, 5 aa, Neisseria
HQRFF

SEQ ID NO: 14879 - protein, 7 aa, Neisseria
IGVFPAF

SEQ ID NO: 14880 - protein, 12 aa, Neisseria
RGAGQRRVSRHC

SEQ ID NO: 14881 - protein, 11 aa, Neisseria
ARLTQVFQTFF

SEQ ID NO: 14882 - protein, 7 aa, Neisseria
FDYRTRL

SEQ ID NO: 14883 - protein, 7 aa, Neisseria
LIGKNRH

SEQ ID NO: 14884 - protein, 11 aa, Neisseria
LHRRTDDTVDG

SEQ ID NO: 14885 - protein, 5 aa, Neisseria
DQPFG

SEQ ID NO: 14886 - protein, 20 aa, Neisseria
APVDGFRVQNIDLDGHQRFF

SEQ ID NO: 14887 - protein, 12 aa, Neisseria
FRNPVCRRTRFC

SEQ ID NO: 14888 - protein, 10 aa, Neisseria
GIKPDSPPRF

SEQ ID NO: 14889 - protein, 12 aa, Neisseria
FRNRHLQGSLRV

SEQ ID NO: 14890 - protein, 9 aa, Neisseria
FLKDDHRVG

SEQ ID NO: 14891 - protein, 5 aa, Neisseria
QHTGS

SEQ ID NO: 14892 - protein, 21 aa, Neisseria
RHRRVRSGFRGAGQRRVSRHC

SEQ ID NO: 14893 - protein, 11 aa, Neisseria
RQTNPRPKRGL

SEQ ID NO: 14894 - protein, 6 aa, Neisseria
IGKNRH

SEQ ID NO: 14895 - protein, 8 aa, Neisseria
RRTDDTVD

SEQ ID NO: 14896 - protein, 12 aa, Neisseria
QNIDLDGHQRFF

SEQ ID NO: 14897 - protein, 9 aa, Neisseria
PVCRRTRFC

SEQ ID NO: 14898 - protein, 7 aa, Neisseria
KPDSPPR

SEQ ID NO: 14899 - protein, 8 aa, Neisseria
FLKDDHRV

SEQ ID NO: 14900 - protein, 19 aa, Neisseria
RHRRVRSGFRGAGQRRVSR

SEQ ID NO: 14901 - protein, 11 aa, Neisseria
RQTNPRPKRGL

SEQ ID NO: 14902 - protein, 14 aa, Neisseria
IQSICDAFQFISYY

SEQ ID NO: 14903 - protein, 14 aa, Neisseria
PKDYIDALYKAWQK

SEQ ID NO: 14904 - protein, 5 aa, Neisseria
VNEGV

SEQ ID NO: 14905 - protein, 12 aa, Neisseria
NPSDNIVDWVLK

SEQ ID NO: 14906 - protein, 5 aa, Neisseria
PTMGA

SEQ ID NO: 14907 - protein, 9 aa, Neisseria
LELFEKVNA

SEQ ID NO: 14908 - protein, 7 aa, Neisseria
GLGGLTT

SEQ ID NO: 14909 - protein, 5 aa, Neisseria
AMIPN

SEQ ID NO: 14910 - protein, 9 aa, Neisseria
RVEDWPDLT

SEQ ID NO: 14911 - protein, 8 aa, Neisseria
NGKRVDVD

SEQ ID NO: 14912 - protein, 9 aa, Neisseria
KRLVDMLDK

SEQ ID NO: 14913 - protein, 7 aa, Neisseria
VDFTNRL

SEQ ID NO: 14914 - protein, 8 aa, Neisseria
PVDPVGDE

SEQ ID NO: 14915 - protein, 11 aa, Neisseria
ATRMDKFTRQM

SEQ ID NO: 14916 - protein, 6 aa, Neisseria
TDLLGM

SEQ ID NO: 14917 - protein, 8 aa, Neisseria
KSSKVLAF

SEQ ID NO: 14918 - protein, 7 aa, Neisseria
IKQEDFI

SEQ ID NO: 14919 - protein, 10 aa, Neisseria
YHPKDYIDAL

SEQ ID NO: 14920 - protein, 13 aa, Neisseria
WQKEENPAAKDAM

SEQ ID NO: 14921 - protein, 16 aa, Neisseria
SRMCAENNRPICQDTG

SEQ ID NO: 14922 - protein, 26 aa, Neisseria
MSVEEMVNEGVRRAYTWEGNTLRASV

SEQ ID NO: 14923 - protein, 13 aa, Neisseria
DPAGKRQNTKDNT

SEQ ID NO: 14924 - protein, 8 aa, Neisseria
VPGDKVEV

SEQ ID NO: 14925 - protein, 14 aa, Neisseria
CAAKGGGSENKSKL

SEQ ID NO: 14926 - protein, 6 aa, Neisseria
NPSDNI

SEQ ID NO: 14927 - protein, 17 aa, Neisseria
GIGGTPEKAVLMAKESL

SEQ ID NO: 14928 - protein, 17 aa, Neisseria
DIQELQEKAASGAELST

SEQ ID NO: 14929 - protein, 48 aa, Neisseria; identical to SEQ ID NO: 673

SEQ ID NO: 14930 - protein, 22 aa, Neisseria
LTGRDAAHKRLVDMLDKGEELP

SEQ ID NO: 14931 - protein, 33 aa, Neisseria
PVDPVGDEIVGPAGPTTATRMDKFTRQMLEQTD

SEQ ID NO: 14932 - protein, 9 aa, Neisseria
GKSERGAAT

SEQ ID NO: 14933 - protein, 7 aa, Neisseria
AIADNKA

SEQ ID NO: 14934 - protein, 6 aa, Neisseria
AIKSSK

SEQ ID NO: 14935 - protein, 7 aa, Neisseria
FEVKDMP

SEQ ID NO: 14936 - protein, 8 aa, Neisseria
VDSKGESI

SEQ ID NO: 14937 - protein, 6 aa, Neisseria
APPQWQ

SEQ ID NO: 14938 - protein, 7 aa, Neisseria
IKQEDFI

SEQ ID NO: 14939 - protein, 13 aa, Neisseria
WQKEENPAAKDAM

SEQ ID NO: 14940 - protein, 10 aa, Neisseria
MCAENNRPIC

SEQ ID NO: 14941 - protein, 13 aa, Neisseria
MSVEEMVNEGVRR

SEQ ID NO: 14942 - protein, 12 aa, Neisseria
PAGKRQNTKDNT

SEQ ID NO: 14943 - protein, 7 aa, Neisseria
PGDKVEV

SEQ ID NO: 14944 - protein, 12 aa, Neisseria
AKGGGSENKSKL

SEQ ID NO: 14945 - protein, 14 aa, Neisseria
GTPEKAVLMAKESL

SEQ ID NO: 14946 - protein, 11 aa, Neisseria
DIQELQEKAAS

SEQ ID NO: 14947 - protein, 5 aa, Neisseria
AELST

SEQ ID NO: 14948 - protein, 9 aa, Neisseria
RHVEFELDG

SEQ ID NO: 14949 - protein, 9 aa, Neisseria
TPPRVEDWP

SEQ ID NO: 14950 - protein, 19 aa, Neisseria
PDNGKRVDVDKLTKEEVAS

SEQ ID NO: 14951 - protein, 22 aa, Neisseria
LTGRDAAHKRLVDMLDKGEELP

SEQ ID NO: 14952 - protein, 7 aa, Neisseria
PVGDEIV

SEQ ID NO: 14953 - protein, 15 aa, Neisseria
TRMDKFTRQMLEQTD

SEQ ID NO: 14954 - protein, 9 aa, Neisseria
GKSERGAAT

SEQ ID NO: 14955 - protein, 7 aa, Neisseria
AIADNKA

SEQ ID NO: 14956 - protein, 6 aa, Neisseria
AIKSSK

SEQ ID NO: 14957 - protein, 7 aa, Neisseria
FEVKDMP

SEQ ID NO: 14958 - protein, 8 aa, Neisseria
VDSKGESI

SEQ ID NO: 14959 - protein, 18 aa, Neisseria
AKASKSATSPKGLDGVSK

SEQ ID NO: 14960 - protein, 24 aa, Neisseria
TAAFHSFISVGDTLTSMPNLVTML

SEQ ID NO: 14961 - protein, 7 aa, Neisseria
VAEETEI

SEQ ID NO: 14962 - protein, 20 aa, Neisseria
CFKGEPTGDSRLLSTTKSAP

SEQ ID NO: 14963 - protein, 25 aa, Neisseria
CANSAKASKSATSPKGLDGVSKNSS

SEQ ID NO: 14964 - protein, 8 aa, Neisseria
VVPNRLRL

SEQ ID NO: 14965 - protein, 10 aa, Neisseria
PACKKVKNAA

SEQ ID NO: 14966 - protein, 7 aa, Neisseria
VAEETEI

SEQ ID NO: 14967 - protein, 11 aa, Neisseria
FKGEPTGDSRL

SEQ ID NO: 14968 - protein, 5 aa, Neisseria
TKSAP

SEQ ID NO: 14969 - protein, 22 aa, Neisseria
NSAKASKSATSPKGLDGVSKNS

SEQ ID NO: 14970 - protein, 5 aa, Neisseria
NRLRL

SEQ ID NO: 14971 - protein, 9 aa, Neisseria
ACKKVKNAA

SEQ ID NO: 14972 - protein, 13 aa, Neisseria
KTPTTIQPASIPS

SEQ ID NO: 14973 - protein, 8 aa, Neisseria
APYLRQVL

SEQ ID NO: 14974 - protein, 6 aa, Neisseria
FKKCLA

SEQ ID NO: 14975 - protein, 20 aa, Neisseria
DFFQTCVNRFFEVVEIIGIG

SEQ ID NO: 14976 - protein, 13 aa, Neisseria
TMEKTKSAAKTPT

SEQ ID NO: 14977 - protein, 6 aa, Neisseria
QPASIP

SEQ ID NO: 14978 - protein, 5 aa, Neisseria
AKARG

SEQ ID NO: 14979 - protein, 20 aa, Neisseria
FFRRPPNIRKSVFQKSEYDK

SEQ ID NO: 14980 - protein, 11 aa, Neisseria
TMEKTKSAAKT

SEQ ID NO: 14981 - protein, 5 aa, Neisseria
AKARG

SEQ ID NO: 14982 - protein, 20 aa, Neisseria
FFRRPPNIRKSVFQKSEYDK

SEQ ID NO: 14983 - protein, 8 aa, Neisseria
EAMERLTR

SEQ ID NO: 14984 - protein, 6 aa, Neisseria
FPDTVE

SEQ ID NO: 14985 - protein, 8 aa, Neisseria
PVARWGDH

SEQ ID NO: 14986 - protein, 15 aa, Neisseria
SAEMLRRYDEFSTVL

SEQ ID NO: 14987 - protein, 12 aa, Neisseria
KRLRLFTEAWQH

SEQ ID NO: 14988 - protein, 12 aa, Neisseria
MWDNAEAMERLT

SEQ ID NO: 14989 - protein, 6 aa, Neisseria
NSNHLP

SEQ ID NO: 14990 - protein, 5 aa, Neisseria
VSLKG

SEQ ID NO: 14991 - protein, 7 aa, Neisseria
YSDKKAL

SEQ ID NO: 14992 - protein, 15 aa, Neisseria
NILRTDINGAQEAYR

SEQ ID NO: 14993 - protein, 11 aa, Neisseria
MVRRRFPDTVE

SEQ ID NO: 14994 - protein, 11 aa, Neisseria
LTERKPVARWG

SEQ ID NO: 14995 - protein, 10 aa, Neisseria
ALVDGEGNVF

SEQ ID NO: 14996 - protein, 9 aa, Neisseria
ARLDRPGMP

SEQ ID NO: 14997 - protein, 7 aa, Neisseria
RGAEGTS

SEQ ID NO: 14998 - protein, 8 aa, Neisseria
EMLRRYDE

SEQ ID NO: 14999 - protein, 5 aa, Neisseria
LGIKE

SEQ ID NO: 15000 - protein, 13 aa, Neisseria
RLGRENEMKRLRL

SEQ ID NO: 15001 - protein, 10 aa, Neisseria
LLRKNKNRLS

SEQ ID NO: 15002 - protein, 8 aa, Neisseria
MRYKDGFS

SEQ ID NO: 15003 - protein, 13 aa, Neisseria
YAPDGLPEKESEE

SEQ ID NO: 15004 - protein, 10 aa, Neisseria
DNAEAMERLT

SEQ ID NO: 15005 - protein, 7 aa, Neisseria
YSDKKAL

SEQ ID NO: 15006 - protein, 13 aa, Neisseria
LRTDINGAQEAYR

SEQ ID NO: 15007 - protein, 10 aa, Neisseria
MVRRRFPDTV

SEQ ID NO: 15008 - protein, 11 aa, Neisseria
LTERKPVARWG

SEQ ID NO: 15009 - protein, 10 aa, Neisseria
ALVDGEGNVF

SEQ ID NO: 15010 - protein, 7 aa, Neisseria
ARLDRPG

SEQ ID NO: 15011 - protein, 7 aa, Neisseria
RGAEGTS

SEQ ID NO: 15012 - protein, 8 aa, Neisseria
EMLRRYDE

SEQ ID NO: 15013 - protein, 5 aa, Neisseria
LGIKE

SEQ ID NO: 15014 - protein, 13 aa, Neisseria
RLGRENEMKRLRL

SEQ ID NO: 15015 - protein, 9 aa, Neisseria
LRKNKNRLS

SEQ ID NO: 15016 - protein, 8 aa, Neisseria
MRYKDGFS

SEQ ID NO: 15017 - protein, 9 aa, Neisseria
GLPEKESEE

SEQ ID NO: 15018 - protein, 10 aa, Neisseria
KPVSRIVTDS

SEQ ID NO: 15019 - protein, 13 aa, Neisseria
TALQMLAKAWREN

SEQ ID NO: 15020 - protein, 10 aa, Neisseria
KEMLAAVLRR

SEQ ID NO: 15021 - protein, 5 aa, Neisseria
TAGNF

SEQ ID NO: 15022 - protein, 15 aa, Neisseria
MNHFGELAVLTQIAK

SEQ ID NO: 15023 - protein, 6 aa, Neisseria
VNNAMR

SEQ ID NO: 15024 - protein, 9 aa, Neisseria
DGVGDIAKA

SEQ ID NO: 15025 - protein, 14 aa, Neisseria
LNDVAEGLKGFSNI

SEQ ID NO: 15026 - protein, 10 aa, Neisseria
AAVDVLARMP

SEQ ID NO: 15027 - protein, 10 aa, Neisseria
VMGDMGELGE

SEQ ID NO: 15028 - protein, 5 aa, Neisseria
VEAAE

SEQ ID NO: 15029 - protein, 10 aa, Neisseria
PMPSESKPVS

SEQ ID NO: 15030 - protein, 12 aa, Neisseria
IVTDSRDIRAGD

SEQ ID NO: 15031 - protein, 7 aa, Neisseria
AGGRFDA

SEQ ID NO: 15032 - protein, 8 aa, Neisseria
VSREDCVA

SEQ ID NO: 15033 - protein, 9 aa, Neisseria
GALKVDDTL

SEQ ID NO: 15034 - protein, 9 aa, Neisseria
AWRENVNPF

SEQ ID NO: 15035 - protein, 12 aa, Neisseria
GSGGKTTVKEML

SEQ ID NO: 15036 - protein, 10 aa, Neisseria
LRRRFGDNAV

SEQ ID NO: 15037 - protein, 6 aa, Neisseria
NFNNHI

SEQ ID NO: 15038 - protein, 7 aa, Neisseria
KLNEKHR

SEQ ID NO: 15039 - protein, 5 aa, Neisseria
AKPDA

SEQ ID NO: 15040 - protein, 17 aa, Neisseria
GCGFDGVGDIAKAKSEI

SEQ ID NO: 15041 - protein, 6 aa, Neisseria
GLCSDG

SEQ ID NO: 15042 - protein, 6 aa, Neisseria
PQEDAN

SEQ ID NO: 15043 - protein, 15 aa, Neisseria
LNTRTFGIDSGDVHA

SEQ ID NO: 15044 - protein, 7 aa, Neisseria
VPGRHNV

SEQ ID NO: 15045 - protein, 7 aa, Neisseria
DVAEGLK

SEQ ID NO: 15046 - protein, 16 aa, Neisseria
FSNIKGRLNVKSGIKG

SEQ ID NO: 15047 - protein, 18 aa, Neisseria
TLIDDTYNANPDSMKAAV

SEQ ID NO: 15048 - protein, 11 aa, Neisseria
DMGELGEDEAA

SEQ ID NO: 15049 - protein, 8 aa, Neisseria
AYARDQGI

SEQ ID NO: 15050 - protein, 13 aa, Neisseria
GDNSVEAAEKFGA

SEQ ID NO: 15051 - protein, 11 aa, Neisseria
LRHDLPERATV

SEQ ID NO: 15052 - protein, 5 aa, Neisseria
VKGSR

SEQ ID NO: 15053 - protein, 10 aa, Neisseria
EEVVEALEDK

SEQ ID NO: 15054 - protein, 9 aa, Neisseria
MPSESKPVS

SEQ ID NO: 15055 - protein, 10 aa, Neisseria
IVTDSRDIRA

SEQ ID NO: 15056 - protein, 5 aa, Neisseria
GRFDA

SEQ ID NO: 15057 - protein, 8 aa, Neisseria
VSREDCVA

SEQ ID NO: 15058 - protein, 9 aa, Neisseria
GALKVDDTL

SEQ ID NO: 15059 - protein, 6 aa, Neisseria
AWRENV

SEQ ID NO: 15060 - protein, 11 aa, Neisseria
SGGKTTVKEML

SEQ ID NO: 15061 - protein, 7 aa, Neisseria
LRRRFGD

SEQ ID NO: 15062 - protein, 7 aa, Neisseria
KLNEKHR

SEQ ID NO: 15063 - protein, 5 aa, Neisseria
AKPDA

SEQ ID NO: 15064 - protein, 12 aa, Neisseria
GVGDIAKAKSEI

SEQ ID NO: 15065 - protein, 6 aa, Neisseria
PQEDAN

SEQ ID NO: 15066 - protein, 7 aa, Neisseria
DSGDVHA

SEQ ID NO: 15067 - protein, 7 aa, Neisseria
DVAEGLK

SEQ ID NO: 15068 - protein, 7 aa, Neisseria
IKGRLNV

SEQ ID NO: 15069 - protein, 13 aa, Neisseria
TYNANPDSMKAAV

SEQ ID NO: 15070 - protein, 11 aa, Neisseria
DMGELGEDEAA

SEQ ID NO: 15071 - protein, 8 aa, Neisseria
AYARDQGI

SEQ ID NO: 15072 - protein, 11 aa, Neisseria
NSVEAAEKFGA

SEQ ID NO: 15073 - protein, 11 aa, Neisseria
LRHDLPERATV

SEQ ID NO: 15074 - protein, 10 aa, Neisseria
EEVVEALEDK

SEQ ID NO: 15075 - protein, 14 aa, Neisseria
RIKNMDQTLKNTLG

SEQ ID NO: 15076 - protein, 5 aa, Neisseria
CALLA

SEQ ID NO: 15077 - protein, 6 aa, Neisseria
AVGALA

SEQ ID NO: 15078 - protein, 5 aa, Neisseria
FPRVS

SEQ ID NO: 15079 - protein, 9 aa, Neisseria
QIVGSILES

SEQ ID NO: 15080 - protein, 8 aa, Neisseria
EFVGNLPG

SEQ ID NO: 15081 - protein, 17 aa, Neisseria
MKQSARIKNMDQTLKNT

SEQ ID NO: 15082 - protein, 8 aa, Neisseria
YEYGYRYS

SEQ ID NO: 15083 - protein, 13 aa, Neisseria
LESNPAEAREFVG

SEQ ID NO: 15084 - protein, 5 aa, Neisseria
VSGGG

SEQ ID NO: 15085 - protein, 14 aa, Neisseria
MKQSARIKNMDQTL

SEQ ID NO: 15086 - protein, 9 aa, Neisseria
NPAEAREFV

SEQ ID NO: 15087 - protein, 13 aa, Neisseria
ERVSQIGKMFDGL

SEQ ID NO: 15088 - protein, 10 aa, Neisseria
LKDALSNGFD

SEQ ID NO: 15089 - protein, 16 aa, Neisseria
RNGGRVLGDIELLADI

SEQ ID NO: 15090 - protein, 6 aa, Neisseria
TSLVGY

SEQ ID NO: 15091 - protein, 7 aa, Neisseria
IAGNIGA

SEQ ID NO: 15092 - protein, 6 aa, Neisseria
ENTESL

SEQ ID NO: 15093 - protein, 11 aa, Neisseria
HLDRYDDLLDY

SEQ ID NO: 15094 - protein, 6 aa, Neisseria
RGDGVQ

SEQ ID NO: 15095 - protein, 8 aa, Neisseria
FCRAMKRA

SEQ ID NO: 15096 - protein, 15 aa, Neisseria
HNATNVMAAVALCEA

SEQ ID NO: 15097 - protein, 16 aa, Neisseria
HVKTFQGLPHRVEKIG

SEQ ID NO: 15098 - protein, 6 aa, Neisseria
AAIAGL

SEQ ID NO: 15099 - protein, 7 aa, Neisseria
GKGQDFT

SEQ ID NO: 15100 - protein, 12 aa, Neisseria
DCATLEEAVQKA

SEQ ID NO: 15101 - protein, 8 aa, Neisseria
SFDMFKGY

SEQ ID NO: 15102 - protein, 6 aa, Neisseria
QNKKIL

SEQ ID NO: 15103 - protein, 29 aa, Neisseria
YLRKNGAEVAAYDAELKPERVSQIGKMFD

SEQ ID NO: 15104 - protein, 10 aa, Neisseria
GRLKDALSNG

SEQ ID NO: 15105 - protein, 23 aa, Neisseria
SPGISERQPDIEAFKRNGGRVLG

SEQ ID NO: 15106 - protein, 10 aa, Neisseria
IVNRRGDKVI

SEQ ID NO: 15107 - protein, 8 aa, Neisseria
TGSNGKTT

SEQ ID NO: 15108 - protein, 13 aa, Neisseria
LEAELQREGKKAD

SEQ ID NO: 15109 - protein, 15 aa, Neisseria
SSFQLENTESLRPTA

SEQ ID NO: 15110 - protein, 13 aa, Neisseria
ISEDHLDRYDDLL

SEQ ID NO: 15111 - protein, 13 aa, Neisseria
AHTKAKIFRGDGV

SEQ ID NO: 15112 - protein, 18 aa, Neisseria
NADDAFCRAMKRAGREVK

SEQ ID NO: 15113 - protein, 19 aa, Neisseria
FWLERETGRLKQGNEDLIA

SEQ ID NO: 15114 - protein, 7 aa, Neisseria
GLPREAL

SEQ ID NO: 15115 - protein, 13 aa, Neisseria
LPHRVEKIGEKNG

SEQ ID NO: 15116 - protein, 10 aa, Neisseria
FIDDSKGTNV

SEQ ID NO: 15117 - protein, 20 aa, Neisseria
GMGKGQDFTPLRDALAGKAK

SEQ ID NO: 15118 - protein, 27 aa, Neisseria
DAPQIRRDLDGCDLNMTDCATLEEAVQ

SEQ ID NO: 15119 - protein, 5 aa, Neisseria
YAHRS

SEQ ID NO: 15120 - protein, 6 aa, Neisseria
QNKKIL

SEQ ID NO: 15121 - protein, 6 aa, Neisseria
RKNGAE

SEQ ID NO: 15122 - protein, 14 aa, Neisseria
AAYDAELKPERVSQ

SEQ ID NO: 15123 - protein, 6 aa, Neisseria
RLKDAL

SEQ ID NO: 15124 - protein, 17 aa, Neisseria
GISERQPDIEAFKRNGG

SEQ ID NO: 15125 - protein, 10 aa, Neisseria
IVNRRGDKVI

SEQ ID NO: 15126 - protein, 6 aa, Neisseria
SNGKTT

SEQ ID NO: 15127 - protein, 13 aa, Neisseria
LEAELQREGKKAD

SEQ ID NO: 15128 - protein, 8 aa, Neisseria
ENTESLRP

SEQ ID NO: 15129 - protein, 13 aa, Neisseria
ISEDHLDRYDDLL

SEQ ID NO: 15130 - protein, 12 aa, Neisseria
AHTKAKIFRGDG

SEQ ID NO: 15131 - protein, 18 aa, Neisseria
NADDAFCRAMKRAGREVK

SEQ ID NO: 15132 - protein, 19 aa, Neisseria
FWLERETGRLKQGNEDLIA

SEQ ID NO: 15133 - protein, 7 aa, Neisseria
GLPREAL

SEQ ID NO: 15134 - protein, 11 aa, Neisseria
HRVEKIGEKNG

SEQ ID NO: 15135 - protein, 7 aa, Neisseria
DDSKGTN

SEQ ID NO: 15136 - protein, 5 aa, Neisseria
GKGQD

SEQ ID NO: 15137 - protein, 12 aa, Neisseria
TPLRDALAGKAK

SEQ ID NO: 15138 - protein, 11 aa, Neisseria
PQIRRDLDGCD

SEQ ID NO: 15139 - protein, 8 aa, Neisseria
ATLEEAVQ

SEQ ID NO: 15140 - protein, 5 aa, Neisseria
YAHRS

SEQ ID NO: 15141 - protein, 9 aa, Neisseria
MRTWRRLVP

SEQ ID NO: 15142 - protein, 6 aa, Neisseria
INGATR

SEQ ID NO: 15143 - protein, 9 aa, Neisseria
PTELFKLAV

SEQ ID NO: 15144 - protein, 20 aa, Neisseria
EVLRSMESLGWQSIWRGTAN

SEQ ID NO: 15145 - protein, 6 aa, Neisseria
EMYGRF

SEQ ID NO: 15146 - protein, 5 aa, Neisseria
SFVVI

SEQ ID NO: 15147 - protein, 16 aa, Neisseria
RVQRVVAFLDPWKDPQ

SEQ ID NO: 15148 - protein, 6 aa, Neisseria
GFFGMC

SEQ ID NO: 15149 - protein, 7 aa, Neisseria
WIGIQSF

SEQ ID NO: 15150 - protein, 8 aa, Neisseria
LASKEGGD

SEQ ID NO: 15151 - protein, 6 aa, Neisseria
MRTWRR

SEQ ID NO: 15152 - protein, 9 aa, Neisseria
AGREINGAT

SEQ ID NO: 15153 - protein, 12 aa, Neisseria
FTRREEVLRSME

SEQ ID NO: 15154 - protein, 5 aa, Neisseria
WRGTA

SEQ ID NO: 15155 - protein, 13 aa, Neisseria
ATNPQARRETLEM

SEQ ID NO: 15156 - protein, 5 aa, Neisseria
APYRV

SEQ ID NO: 15157 - protein, 10 aa, Neisseria
LDPWKDPQGA

SEQ ID NO: 15158 - protein, 12 aa, Neisseria
GLGASLSKRGFL

SEQ ID NO: 15159 - protein, 10 aa, Neisseria
SIGKQSRDLG

SEQ ID NO: 15160 - protein, 6 aa, Neisseria
LPTKGL

SEQ ID NO: 15161 - protein, 15 aa, Neisseria
IDYENRRKMRGYRVE

SEQ ID NO: 15162 - protein, 7 aa, Neisseria
ASKEGGD

SEQ ID NO: 15163 - protein, 7 aa, Neisseria
AGREING

SEQ ID NO: 15164 - protein, 12 aa, Neisseria
FTRREEVLRSME

SEQ ID NO: 15165 - protein, 10 aa, Neisseria
PQARRETLEM

SEQ ID NO: 15166 - protein, 7 aa, Neisseria
PWKDPQG

SEQ ID NO: 15167 - protein, 7 aa, Neisseria
LSKRGFL

SEQ ID NO: 15168 - protein, 6 aa, Neisseria
KQSRDL

SEQ ID NO: 15169 - protein, 15 aa, Neisseria
IDYENRRKMRGYRVE

SEQ ID NO: 15170 - protein, 6 aa, Neisseria
VADSLR

SEQ ID NO: 15171 - protein, 9 aa, Neisseria
QTVREAQQI

SEQ ID NO: 15172 - protein, 17 aa, Neisseria
GFGGFVTFPGGLAAKLL

SEQ ID NO: 15173 - protein, 20 aa, Neisseria
GLSNRHLSRWAKRVLYAFPK

SEQ ID NO: 15174 - protein, 6 aa, Neisseria
VGNPVR

SEQ ID NO: 15175 - protein, 9 aa, Neisseria
GADVLNKTV

SEQ ID NO: 15176 - protein, 13 aa, Neisseria
ECVEFITDMVSAY

SEQ ID NO: 15177 - protein, 8 aa, Neisseria
EKLAEILG

SEQ ID NO: 15178 - protein, 5 aa, Neisseria
WAENA

SEQ ID NO: 15179 - protein, 7 aa, Neisseria
DSLRARG

SEQ ID NO: 15180 - protein, 13 aa, Neisseria
LGSKDSMEERIVP

SEQ ID NO: 15181 - protein, 12 aa, Neisseria
KGVRGNGIKRKL

SEQ ID NO: 15182 - protein, 14 aa, Neisseria
TVREAQQIIRKHRV

SEQ ID NO: 15183 - protein, 11 aa, Neisseria
LSNRHLSRWAK

SEQ ID NO: 15184 - protein, 7 aa, Neisseria
FSHEGGL

SEQ ID NO: 15185 - protein, 8 aa, Neisseria
NPVRADIS

SEQ ID NO: 15186 - protein, 12 aa, Neisseria
PAERFQGREGRL

SEQ ID NO: 15187 - protein, 6 aa, Neisseria
VLNKTV

SEQ ID NO: 15188 - protein, 19 aa, Neisseria
LPDNARPQMYHQSGRGKLG

SEQ ID NO: 15189 - protein, 5 aa, Neisseria
ADYDA

SEQ ID NO: 15190 - protein, 7 aa, Neisseria
SAYRDAD

SEQ ID NO: 15191 - protein, 8 aa, Neisseria
AVDDHQTA

SEQ ID NO: 15192 - protein, 9 aa, Neisseria
QLTAEKLAE

SEQ ID NO: 15193 - protein, 9 aa, Neisseria
GLNREKCLK

SEQ ID NO: 15194 - protein, 6 aa, Neisseria
AENART

SEQ ID NO: 15195 - protein, 8 aa, Neisseria
HSADDVAE

SEQ ID NO: 15196 - protein, 7 aa, Neisseria
DSLRARG

SEQ ID NO: 15197 - protein, 11 aa, Neisseria
SKDSMEERIVP

SEQ ID NO: 15198 - protein, 7 aa, Neisseria
NGIKRKL

SEQ ID NO: 15199 - protein, 14 aa, Neisseria
TVREAQQIIRKHRV

SEQ ID NO: 15200 - protein, 7 aa, Neisseria
HLSRWAK

SEQ ID NO: 15201 - protein, 5 aa, Neisseria
VRADI

SEQ ID NO: 15202 - protein, 12 aa, Neisseria
PAERFQGREGRL

SEQ ID NO: 15203 - protein, 6 aa, Neisseria
SGRGKL

SEQ ID NO: 15204 - protein, 7 aa, Neisseria
SAYRDAD

SEQ ID NO: 15205 - protein, 8 aa, Neisseria
AVDDHQTA

SEQ ID NO: 15206 - protein, 8 aa, Neisseria
LTAEKLAE

SEQ ID NO: 15207 - protein, 8 aa, Neisseria
LNREKCLK

SEQ ID NO: 15208 - protein, 5 aa, Neisseria
AENAR

SEQ ID NO: 15209 - protein, 8 aa, Neisseria
HSADDVAE

SEQ ID NO: 15210 - protein, 16 aa, Neisseria
HFSNWLTGLNIFQYTT

SEQ ID NO: 15211 - protein, 7 aa, Neisseria
RAVMAAL

SEQ ID NO: 15212 - protein, 12 aa, Neisseria
TIRRLTALKCGQ

SEQ ID NO: 15213 - protein, 7 aa, Neisseria
LWGNWAN

SEQ ID NO: 15214 - protein, 11 aa, Neisseria
GFYDDWRKVVY

SEQ ID NO: 15215 - protein, 8 aa, Neisseria
AIIAGLAL

SEQ ID NO: 15216 - protein, 10 aa, Neisseria
GFLVLSYLTI

SEQ ID NO: 15217 - protein, 16 aa, Neisseria
TSNAVNLTDGLDGLAT

SEQ ID NO: 15218 - protein, 12 aa, Neisseria
HSQFAQYLQLPY

SEQ ID NO: 15219 - protein, 9 aa, Neisseria
AMCGACLGF

SEQ ID NO: 15220 - protein, 15 aa, Neisseria
TALKCGQAVRTDGPQ

SEQ ID NO: 15221 - protein, 8 aa, Neisseria
VKNGTPTM

SEQ ID NO: 15222 - protein, 18 aa, Neisseria
DDWRKVVYKDPNGVSAKF

SEQ ID NO: 15223 - protein, 6 aa, Neisseria
LTDGLD

SEQ ID NO: 15224 - protein, 7 aa, Neisseria
KKTKKRI

SEQ ID NO: 15225 - protein, 11 aa, Neisseria
YEQKGWKETQV

SEQ ID NO: 15226 - protein, 7 aa, Neisseria
VRTDGPQ

SEQ ID NO: 15227 - protein, 14 aa, Neisseria
DDWRKVVYKDPNGV

SEQ ID NO: 15228 - protein, 7 aa, Neisseria
KKTKKRI

SEQ ID NO: 15229 - protein, 5 aa, Neisseria
KGWKE

SEQ ID NO: 15230 - protein, 7 aa, Neisseria
  VARIANT 5: Xaa is any amino acid
CGRPXKV

SEQ ID NO: 15231 - protein, 12 aa, Neisseria
TLVALCKPCSGI

SEQ ID NO: 15232 - protein, 6 aa, Neisseria
SRPARF

SEQ ID NO: 15233 - protein, 10 aa, Neisseria
MPPKITKSGF

SEQ ID NO: 15234 - protein, 10 aa, Neisseria
  VARIANT 9: Xaa is any amino acid
FSTRCGRPXK

SEQ ID NO: 15235 - protein, 15 aa, Neisseria
SSNASRGKPTASHKA

SEQ ID NO: 15236 - protein, 5 aa, Neisseria
PCSGI

SEQ ID NO: 15237 - protein, 50 aa, Neisseria
CFRRPVSRSNQKSASYSNENHFTSRPARFIARQNASSAFKTCTPSPRKIL

SEQ ID NO: 15238 - protein, 7 aa, Neisseria
  VARIANT 6: Xaa is any amino acid
RCGRPXK

SEQ ID NO: 15239 - protein, 13 aa, Neisseria
NASRGKPTASHKA

SEQ ID NO: 15240 - protein, 18 aa, Neisseria
CFRRPVSRSNQKSASYSN

SEQ ID NO: 15241 - protein, 7 aa, Neisseria
RPARFIA

SEQ ID NO: 15242 - protein, 7 aa, Neisseria
TPSPRKI

SEQ ID NO: 15243 - protein, 12 aa, Neisseria
SQSLKRPDKHFR

SEQ ID NO: 15244 - protein, 21 aa, Neisseria
DFFHAVRQALKGFDVFEQCFA

SEQ ID NO: 15245 - protein, 5 aa, Neisseria
QTDGF

SEQ ID NO: 15246 - protein, 10 aa, Neisseria
VSGVVQALQR

SEQ ID NO: 15247 - protein, 17 aa, Neisseria
LHRTTERIVRIQNLHTV

SEQ ID NO: 15248 - protein, 5 aa, Neisseria
VVEQV

SEQ ID NO: 15249 - protein, 8 aa, Neisseria
VQHCRRSR

SEQ ID NO: 15250 - protein, 13 aa, Neisseria
GAECQNIETVGER

SEQ ID NO: 15251 - protein, 9 aa, Neisseria
PVKHLTDLR

SEQ ID NO: 15252 - protein, 20 aa, Neisseria
NLRAVFAQVGNHGNTRAAKS

SEQ ID NO: 15253 - protein, 13 aa, Neisseria
VSQSLKRPDKHFR

SEQ ID NO: 15254 - protein, 15 aa, Neisseria
HIETRAGGAEQHDIA

SEQ ID NO: 15255 - protein, 5 aa, Neisseria
FQSGA

SEQ ID NO: 15256 - protein, 12 aa, Neisseria
ADLRRIDTDQEH

SEQ ID NO: 15257 - protein, 11 aa, Neisseria
AGKRVAQGREV

SEQ ID NO: 15258 - protein, 21 aa, Neisseria
  VARIANT 1: Xaa is any amino acid
XNHEERILQTGNRGGGRTDVR

SEQ ID NO: 15259 - protein, 7 aa, Neisseria
QALKGFD

SEQ ID NO: 15260 - protein, 18 aa, Neisseria
FARQTDGFAQGNGSHHVS

SEQ ID NO: 15261 - protein, 7 aa, Neisseria
NILRGNQ

SEQ ID NO: 15262 - protein, 8 aa, Neisseria
QRKPFHLA

SEQ ID NO: 15263 - protein, 8 aa, Neisseria
RTTERIVR

SEQ ID NO: 15264 - protein, 9 aa, Neisseria
QHCRRSRAQ

SEQ ID NO: 15265 - protein, 7 aa, Neisseria
ETGKLQH

SEQ ID NO: 15266 - protein, 14 aa, Neisseria
LQNRRADIARDNGI

SEQ ID NO: 15267 - protein, 15 aa, Neisseria
PTLDAEIADQARYRG

SEQ ID NO: 15268 - protein, 6 aa, Neisseria
AGNRNH

SEQ ID NO: 15269 - protein, 5 aa, Neisseria
VRQQF

SEQ ID NO: 15270 - protein, 5 aa, Neisseria
KGLDI

SEQ ID NO: 15271 - protein, 7 aa, Neisseria
AGAECQN

SEQ ID NO: 15272 - protein, 8 aa, Neisseria
ARVKHQPV

SEQ ID NO: 15273 - protein, 7 aa, Neisseria
HLTDLRH

SEQ ID NO: 15274 - protein, 7 aa, Neisseria
IIRSNLR

SEQ ID NO: 15275 - protein, 17 aa, Neisseria
GNHGNTRAAKSGDEDFF

SEQ ID NO: 15276 - protein, 11 aa, Neisseria
QSLKRPDKHFR

SEQ ID NO: 15277 - protein, 15 aa, Neisseria
HIETRAGGAEQHDIA

SEQ ID NO: 15278 - protein, 12 aa, Neisseria
ADLRRIDTDQEH

SEQ ID NO: 15279 - protein, 11 aa, Neisseria
AGKRVAQGREV

SEQ ID NO: 15280 - protein, 8 aa, Neisseria
  VARIANT 1: Xaa is any amino acid
XNHEERIL

SEQ ID NO: 15281 - protein, 11 aa, Neisseria
GNRGGGRTDVR

SEQ ID NO: 15282 - protein, 8 aa, Neisseria
RTTERIVR

SEQ ID NO: 15283 - protein, 8 aa, Neisseria
QHCRRSRA

SEQ ID NO: 15284 - protein, 6 aa, Neisseria
ETGKLQ

SEQ ID NO: 15285 - protein, 14 aa, Neisseria
LQNRRADIARDNGI

SEQ ID NO: 15286 - protein, 12 aa, Neisseria
LDAEIADQARYR

SEQ ID NO: 15287 - protein, 5 aa, Neisseria
KGLDI

SEQ ID NO: 15288 - protein, 7 aa, Neisseria
AGAECQN

SEQ ID NO: 15289 - protein, 7 aa, Neisseria
ARVKHQP

SEQ ID NO: 15290 - protein, 5 aa, Neisseria
TDLRH

SEQ ID NO: 15291 - protein, 6 aa, Neisseria
IIRSNL

SEQ ID NO: 15292 - protein, 14 aa, Neisseria
GNTRAAKSGDEDFF

SEQ ID NO: 15293 - protein, 9 aa, Neisseria
PLSDGIASC

SEQ ID NO: 15294 - protein, 8 aa, Neisseria
ITRFQALV

SEQ ID NO: 15295 - protein, 11 aa, Neisseria
VLVSVLTSLAK

SEQ ID NO: 15296 - protein, 7 aa, Neisseria
VPPSPAT

SEQ ID NO: 15297 - protein, 8 aa, Neisseria
KPLSDGIA

SEQ ID NO: 15298 - protein, 10 aa, Neisseria
GMSGIAEVLH

SEQ ID NO: 15299 - protein, 9 aa, Neisseria
ARNAATEHL

SEQ ID NO: 15300 - protein, 8 aa, Neisseria
HTAEHVNG

SEQ ID NO: 15301 - protein, 5 aa, Neisseria
VAALE

SEQ ID NO: 15302 - protein, 8 aa, Neisseria
AELMRFRD

SEQ ID NO: 15303 - protein, 12 aa, Neisseria
LTPIMSVVTNID

SEQ ID NO: 15304 - protein, 19 aa, Neisseria
TYGHSVEKLHQAFIDFIHR

SEQ ID NO: 15305 - protein, 13 aa, Neisseria
HVRAILPKVSKPY

SEQ ID NO: 15306 - protein, 8 aa, Neisseria
TYGLDDTA

SEQ ID NO: 15307 - protein, 9 aa, Neisseria
NVLNALAAI

SEQ ID NO: 15308 - protein, 7 aa, Neisseria
VEAIQKG

SEQ ID NO: 15309 - protein, 11 aa, Neisseria
GRRFQKYGDIK

SEQ ID NO: 15310 - protein, 22 aa, Neisseria
RYTRTRDLFEDFTKVLNTVDAL

SEQ ID NO: 15311 - protein, 11 aa, Neisseria
LARAIRVLGKL

SEQ ID NO: 15312 - protein, 13 aa, Neisseria
CENVADLPEMLLN

SEQ ID NO: 15313 - protein, 10 aa, Neisseria
LWRANGQPFK

SEQ ID NO: 15314 - protein, 19 aa, Neisseria
TPLRIENPPERNIMMKNRV

SEQ ID NO: 15315 - protein, 11 aa, Neisseria
VSGSDQARNAA

SEQ ID NO: 15316 - protein, 9 aa, Neisseria
AVKKENPEV

SEQ ID NO: 15317 - protein, 7 aa, Neisseria
MRFRDGI

SEQ ID NO: 15318 - protein, 8 aa, Neisseria
GTHGKTTT

SEQ ID NO: 15319 - protein, 11 aa, Neisseria
GTNARLGKGEY

SEQ ID NO: 15320 - protein, 7 aa, Neisseria
EADESDA

SEQ ID NO: 15321 - protein, 11 aa, Neisseria
NIDEDHMDTYG

SEQ ID NO: 15322 - protein, 6 aa, Neisseria
SVEKLH

SEQ ID NO: 15323 - protein, 6 aa, Neisseria
IDSEHV

SEQ ID NO: 15324 - protein, 10 aa, Neisseria
ILPKVSKPYA

SEQ ID NO: 15325 - protein, 7 aa, Neisseria
GLDDTAD

SEQ ID NO: 15326 - protein, 7 aa, Neisseria
DIENVGA

SEQ ID NO: 15327 - protein, 9 aa, Neisseria
MKGHEQGSF

SEQ ID NO: 15328 - protein, 18 aa, Neisseria
GVGRRFQKYGDIKLPNGG

SEQ ID NO: 15329 - protein, 7 aa, Neisseria
DDYGHHP

SEQ ID NO: 15330 - protein, 7 aa, Neisseria
AYPEKRL

SEQ ID NO: 15331 - protein, 17 aa, Neisseria
QPHRYTRTRDLFEDFTK

SEQ ID NO: 15332 - protein, 17 aa, Neisseria
AAGEEPIAAADSRALAR

SEQ ID NO: 15333 - protein, 6 aa, Neisseria
NVADLP

SEQ ID NO: 15334 - protein, 6 aa, Neisseria
LQDGDI

SEQ ID NO: 15335 - protein, 6 aa, Neisseria
GAGSIN

SEQ ID NO: 15336 - protein, 18 aa, Neisseria
PLRIENPPERNIMMKNRV

SEQ ID NO: 15337 - protein, 10 aa, Neisseria
SGSDQARNAA

SEQ ID NO: 15338 - protein, 8 aa, Neisseria
AVKKENPE

SEQ ID NO: 15339 - protein, 5 aa, Neisseria
MRFRD

SEQ ID NO: 15340 - protein, 5 aa, Neisseria
HGKTT

SEQ ID NO: 15341 - protein, 7 aa, Neisseria
ARLGKGE

SEQ ID NO: 15342 - protein, 7 aa, Neisseria
EADESDA

SEQ ID NO: 15343 - protein, 8 aa, Neisseria
NIDEDHMD

SEQ ID NO: 15344 - protein, 6 aa, Neisseria
SVEKLH

SEQ ID NO: 15345 - protein, 5 aa, Neisseria
DSEHV

SEQ ID NO: 15346 - protein, 7 aa, Neisseria
GLDDTAD

SEQ ID NO: 15347 - protein, 7 aa, Neisseria
KGHEQGS

SEQ ID NO: 15348 - protein, 8 aa, Neisseria
GVGRRFQK

SEQ ID NO: 15349 - protein, 5 aa, Neisseria
GDIKL

SEQ ID NO: 15350 - protein, 7 aa, Neisseria
AYPEKRL

SEQ ID NO: 15351 - protein, 14 aa, Neisseria
RYTRTRDLFEDFTK

SEQ ID NO: 15352 - protein, 17 aa, Neisseria
AAGEEPIAAADSRALAR

SEQ ID NO: 15353 - protein, 6 aa, Neisseria
NVADLP

SEQ ID NO: 15354 - protein, 5 aa, Neisseria
QDGDI

SEQ ID NO: 15355 - protein, 5 aa, Neisseria
TAILN

SEQ ID NO: 15356 - protein, 8 aa, Neisseria
TAFNILHG

SEQ ID NO: 15357 - protein, 10 aa, Neisseria
KSVYEELKHF

SEQ ID NO: 15358 - protein, 9 aa, Neisseria
IHIIPATEF

SEQ ID NO: 15359 - protein, 5 aa, Neisseria
FLKDT

SEQ ID NO: 15360 - protein, 9 aa, Neisseria
INTLPGMTG

SEQ ID NO: 15361 - protein, 15 aa, Neisseria
GGFSSEREISLDSGT

SEQ ID NO: 15362 - protein, 7 aa, Neisseria
LKSKGID

SEQ ID NO: 15363 - protein, 16 aa, Neisseria
AFDPKETPLSELKAQG

SEQ ID NO: 15364 - protein, 9 aa, Neisseria
GTYGEDGAV

SEQ ID NO: 15365 - protein, 7 aa, Neisseria
GMDKYRC

SEQ ID NO: 15366 - protein, 14 aa, Neisseria
HDDTDFDAVEEKLG

SEQ ID NO: 15367 - protein, 7 aa, Neisseria
PAAEGSS

SEQ ID NO: 15368 - protein, 19 aa, Neisseria
KVKGKGRLKSVYEELKHFQ

SEQ ID NO: 15369 - protein, 9 aa, Neisseria
RFIGGGEYS

SEQ ID NO: 15370 - protein, 6 aa, Neisseria
NGKGLP

SEQ ID NO: 15371 - protein, 14 aa, Neisseria
EFYDYEAKYNRNDT

SEQ ID NO: 15372 - protein, 17 aa, Neisseria
YQCPSEDLTEAEESLMR

SEQ ID NO: 15373 - protein, 6 aa, Neisseria
GAEGCV

SEQ ID NO: 15374 - protein, 8 aa, Neisseria
DFLKDTDG

SEQ ID NO: 15375 - protein, 6 aa, Neisseria
TLPGMT

SEQ ID NO: 15376 - protein, 8 aa, Neisseria
SSEREISL

SEQ ID NO: 15377 - protein, 7 aa, Neisseria
LKSKGID

SEQ ID NO: 15378 - protein, 14 aa, Neisseria
AFDPKETPLSELKA

SEQ ID NO: 15379 - protein, 7 aa, Neisseria
YGEDGAV

SEQ ID NO: 15380 - protein, 7 aa, Neisseria
GMDKYRC

SEQ ID NO: 15381 - protein, 14 aa, Neisseria
HDDTDFDAVEEKLG

SEQ ID NO: 15382 - protein, 7 aa, Neisseria
PAAEGSS

SEQ ID NO: 15383 - protein, 19 aa, Neisseria
KVKGKGRLKSVYEELKHFQ

SEQ ID NO: 15384 - protein, 12 aa, Neisseria
YDYEAKYNRNDT

SEQ ID NO: 15385 - protein, 14 aa, Neisseria
PSEDLTEAEESLMR

SEQ ID NO: 15386 - protein, 8 aa, Neisseria
DFLKDTDG

SEQ ID NO: 15387 - protein, 9 aa, Neisseria
LPPITKVGS

SEQ ID NO: 15388 - protein, 7 aa, Neisseria
FSFLTAV

SEQ ID NO: 15389 - protein, 8 aa, Neisseria
SPLPKRAL

SEQ ID NO: 15390 - protein, 11 aa, Neisseria
GSSPAAPRMEA

SEQ ID NO: 15391 - protein, 18 aa, Neisseria
MPSRKRINSANIRARGIT

SEQ ID NO: 15392 - protein, 6 aa, Neisseria
LPKRAL

SEQ ID NO: 15393 - protein, 7 aa, Neisseria
AAPRMEA

SEQ ID NO: 15394 - protein, 7 aa, Neisseria
PSRKRIN

SEQ ID NO: 15395 - protein, 6 aa, Neisseria
NIRARG

SEQ ID NO: 15396 - protein, 18 aa, Neisseria
CASNLFRQFQQRGGDAVD

SEQ ID NO: 15397 - protein, 18 aa, Neisseria
VLQNVQQHFGQIGNVFAV

SEQ ID NO: 15398 - protein, 22 aa, Neisseria
FGQHQRVNGIEDFGKVFKQIAR

SEQ ID NO: 15399 - protein, 10 aa, Neisseria
GRRHFDGVVS

SEQ ID NO: 15400 - protein, 24 aa, Neisseria
FLDRFNRCADFQRHADGCQCVQHV

SEQ ID NO: 15401 - protein, 5 aa, Neisseria
QHDFK

SEQ ID NO: 15402 - protein, 12 aa, Neisseria
DVGGIVQTVSSI

SEQ ID NO: 15403 - protein, 16 aa, Neisseria
TVDEIDKRLMQLLNTV

SEQ ID NO: 15404 - protein, 7 aa, Neisseria
GCIRLVG

SEQ ID NO: 15405 - protein, 17 aa, Neisseria
NGDAVTEAHQLRQHQGA

SEQ ID NO: 15406 - protein, 6 aa, Neisseria
VNVFCG

SEQ ID NO: 15407 - protein, 13 aa, Neisseria
MLGSGISRLIRTG

SEQ ID NO: 15408 - protein, 13 aa, Neisseria
TQIVQDFGDTAHA

SEQ ID NO: 15409 - protein, 8 aa, Neisseria
SGGCASNL

SEQ ID NO: 15410 - protein, 16 aa, Neisseria
FQQRGGDAVDASRTHI

SEQ ID NO: 15411 - protein, 19 aa, Neisseria
QHADGAGKSAGISGGNRLF

SEQ ID NO: 15412 - protein, 13 aa, Neisseria
QHQRVNGIEDFGK

SEQ ID NO: 15413 - protein, 7 aa, Neisseria
VRLEGEY

SEQ ID NO: 15414 - protein, 13 aa, Neisseria
AACGGKGRRHFDG

SEQ ID NO: 15415 - protein, 8 aa, Neisseria
VHQERGST

SEQ ID NO: 15416 - protein, 12 aa, Neisseria
AAADTFKAEQAF

SEQ ID NO: 15417 - protein, 17 aa, Neisseria
DRFNRCADFQRHADGCQ

SEQ ID NO: 15418 - protein, 5 aa, Neisseria
HDFKR

SEQ ID NO: 15419 - protein, 7 aa, Neisseria
GQNRADV

SEQ ID NO: 15420 - protein, 8 aa, Neisseria
NTQKGFAV

SEQ ID NO: 15421 - protein, 10 aa, Neisseria
HTVDEIDKRL

SEQ ID NO: 15422 - protein, 15 aa, Neisseria
IGNDGHNRCQVQKGC

SEQ ID NO: 15423 - protein, 37 aa, Neisseria; identical to SEQ ID NO: 1179

SEQ ID NO: 15424 - protein, 14 aa, Neisseria
HQLRQHQGARNNGN

SEQ ID NO: 15425 - protein, 8 aa, Neisseria
LQRSDNFG

SEQ ID NO: 15426 - protein, 12 aa, Neisseria
FDGGRGNDDIRT

SEQ ID NO: 15427 - protein, 10 aa, Neisseria
RLIRTGNFKT

SEQ ID NO: 15428 - protein, 19 aa, Neisseria
QDFGDTAHADAADTDKMDV

SEQ ID NO: 15429 - protein, 16 aa, Neisseria
FQQRGGDAVDASRTHI

SEQ ID NO: 15430 - protein, 9 aa, Neisseria
ADGAGKSAG

SEQ ID NO: 15431 - protein, 8 aa, Neisseria
NGIEDFGK

SEQ ID NO: 15432 - protein, 7 aa, Neisseria
VRLEGEY

SEQ ID NO: 15433 - protein, 9 aa, Neisseria
CGGKGRRHF

SEQ ID NO: 15434 - protein, 6 aa, Neisseria
HQERGS

SEQ ID NO: 15435 - protein, 12 aa, Neisseria
AAADTFKAEQAF

SEQ ID NO: 15436 - protein, 9 aa, Neisseria
ADFQRHADG

SEQ ID NO: 15437 - protein, 5 aa, Neisseria
HDFKR

SEQ ID NO: 15438 - protein, 10 aa, Neisseria
HTVDEIDKRL

SEQ ID NO: 15439 - protein, 11 aa, Neisseria
IGNDGHNRCQV

SEQ ID NO: 15440 - protein, 19 aa, Neisseria
FAADNESRVKSCRAEDGGG

SEQ ID NO: 15441 - protein, 8 aa, Neisseria
AGNGDAVT

SEQ ID NO: 15442 - protein, 13 aa, Neisseria
HQLRQHQGARNNG

SEQ ID NO: 15443 - protein, 5 aa, Neisseria
QRSDN

SEQ ID NO: 15444 - protein, 10 aa, Neisseria
GGRGNDDIRT

SEQ ID NO: 15445 - protein, 13 aa, Neisseria
AHADAADTDKMDV

SEQ ID NO: 15446 - protein, 9 aa, Neisseria
GIFEEIDAH

SEQ ID NO: 15447 - protein, 5 aa, Neisseria
AANRQ

SEQ ID NO: 15448 - protein, 5 aa, Neisseria
GVVAV

SEQ ID NO: 15449 - protein, 8 aa, Neisseria
QFFVNAFQ

SEQ ID NO: 15450 - protein, 8 aa, Neisseria
AYAAAFGR

SEQ ID NO: 15451 - protein, 5 aa, Neisseria
NQFAA

SEQ ID NO: 15452 - protein, 10 aa, Neisseria
DTAAGIGNAQ

SEQ ID NO: 15453 - protein, 5 aa, Neisseria
QWGFL

SEQ ID NO: 15454 - protein, 5 aa, Neisseria
HTGQG

SEQ ID NO: 15455 - protein, 5 aa, Neisseria
EEIDA

SEQ ID NO: 15456 - protein, 10 aa, Neisseria
FRTDCLRAAN

SEQ ID NO: 15457 - protein, 10 aa, Neisseria
KLGRGDDVYA

SEQ ID NO: 15458 - protein, 10 aa, Neisseria
AADKPFGNDF

SEQ ID NO: 15459 - protein, 7 aa, Neisseria
RFHKHRQ

SEQ ID NO: 15460 - protein, 14 aa, Neisseria
VQDGELGNGQSQCL

SEQ ID NO: 15461 - protein, 8 aa, Neisseria
ADGGCGDT

SEQ ID NO: 15462 - protein, 9 aa, Neisseria
TVKDVECRL

SEQ ID NO: 15463 - protein, 5 aa, Neisseria
EEIDA

SEQ ID NO: 15464 - protein, 7 aa, Neisseria
DCLRAAN

SEQ ID NO: 15465 - protein, 8 aa, Neisseria
LGRGDDVY

SEQ ID NO: 15466 - protein, 7 aa, Neisseria
AADKPFG

SEQ ID NO: 15467 - protein, 7 aa, Neisseria
RFHKHRQ

SEQ ID NO: 15468 - protein, 7 aa, Neisseria
QDGELGN

SEQ ID NO: 15469 - protein, 6 aa, Neisseria
GGCGDT

SEQ ID NO: 15470 - protein, 9 aa, Neisseria
TVKDVECRL

SEQ ID NO: 15471 - protein, 13 aa, Neisseria
AGLTTFLTMCYIV

SEQ ID NO: 15472 - protein, 5 aa, Neisseria
MGFVG

SEQ ID NO: 15473 - protein, 20 aa, Neisseria
ATLVGLGDIHQPSALLALFG

SEQ ID NO: 15474 - protein, 24 aa, Neisseria
TITVIASLMGLNEFHGIIGEVPSI

SEQ ID NO: 15475 - protein, 5 aa, Neisseria
LFTVS

SEQ ID NO: 15476 - protein, 6 aa, Neisseria
FDSTGT

SEQ ID NO: 15477 - protein, 10 aa, Neisseria
LAKSVPAFAT

SEQ ID NO: 15478 - protein, 8 aa, Neisseria
MLRSARDI

SEQ ID NO: 15479 - protein, 8 aa, Neisseria
MDTSKQTL

SEQ ID NO: 15480 - protein, 14 aa, Neisseria
FKLKANGTTVRTEL

SEQ ID NO: 15481 - protein, 6 aa, Neisseria
KVREML

SEQ ID NO: 15482 - protein, 5 aa, Neisseria
FDSTG

SEQ ID NO: 15483 - protein, 10 aa, Neisseria
VDGKLPRLKR

SEQ ID NO: 15484 - protein, 7 aa, Neisseria
SAGGRTG

SEQ ID NO: 15485 - protein, 13 aa, Neisseria
RSARDIDWDDMTE

SEQ ID NO: 15486 - protein, 10 aa, Neisseria
LCRRTKDVPP

SEQ ID NO: 15487 - protein, 5 aa, Neisseria
MDTSK

SEQ ID NO: 15488 - protein, 11 aa, Neisseria
KANGTTVRTEL

SEQ ID NO: 15489 - protein, 6 aa, Neisseria
KVREML

SEQ ID NO: 15490 - protein, 8 aa, Neisseria
GKLPRLKR

SEQ ID NO: 15491 - protein, 5 aa, Neisseria
AGGRT

SEQ ID NO: 15492 - protein, 13 aa, Neisseria
RSARDIDWDDMTE

SEQ ID NO: 15493 - protein, 9 aa, Neisseria
LCRRTKDVP

SEQ ID NO: 15494 - protein, 11 aa, Neisseria
AAEAGEQFVGD

SEQ ID NO: 15495 - protein, 9 aa, Neisseria
VGDFFKLAF

SEQ ID NO: 15496 - protein, 15 aa, Neisseria
CQIQNVVTAIAQIVA

SEQ ID NO: 15497 - protein, 7 aa, Neisseria
LSSFSHG

SEQ ID NO: 15498 - protein, 10 aa, Neisseria
VQEDAAEAGE

SEQ ID NO: 15499 - protein, 5 aa, Neisseria
MGMCR

SEQ ID NO: 15500 - protein, 9 aa, Neisseria
FNHTDRQAA

SEQ ID NO: 15501 - protein, 20 aa, Neisseria
TANGTQSGITGRNARKRNGF

SEQ ID NO: 15502 - protein, 13 aa, Neisseria
FEGRGLSSFSHGI

SEQ ID NO: 15503 - protein, 9 aa, Neisseria
VFRRPMRIC

SEQ ID NO: 15504 - protein, 10 aa, Neisseria
VQEDAAEAGE

SEQ ID NO: 15505 - protein, 7 aa, Neisseria
NHTDRQA

SEQ ID NO: 15506 - protein, 11 aa, Neisseria
ITGRNARKRNG

SEQ ID NO: 15507 - protein, 5 aa, Neisseria
FEGRG

SEQ ID NO: 15508 - protein, 7 aa, Neisseria
VFRRPMR

SEQ ID NO: 15509 - protein, 8 aa, Neisseria
SMMRLPDI

SEQ ID NO: 15510 - protein, 9 aa, Neisseria
AFVEFFGEG

SEQ ID NO: 15511 - protein, 9 aa, Neisseria
KLVETYAKT

SEQ ID NO: 15512 - protein, 8 aa, Neisseria
WADALKTA

SEQ ID NO: 15513 - protein, 9 aa, Neisseria
TRNMAGPSN

SEQ ID NO: 15514 - protein, 16 aa, Neisseria
AGKGLAKPYEEPSDGQ

SEQ ID NO: 15515 - protein, 15 aa, Neisseria
AAITSCTNTSNPRNV

SEQ ID NO: 15516 - protein, 6 aa, Neisseria
TCNGMS

SEQ ID NO: 15517 - protein, 8 aa, Neisseria
IDAIVAEY

SEQ ID NO: 15518 - protein, 8 aa, Neisseria
KPQQFRDV

SEQ ID NO: 15519 - protein, 8 aa, Neisseria
PSPLYDWR

SEQ ID NO: 15520 - protein, 5 aa, Neisseria
STYIR

SEQ ID NO: 15521 - protein, 7 aa, Neisseria
LSGMRPL

SEQ ID NO: 15522 - protein, 7 aa, Neisseria
DFNSYAT

SEQ ID NO: 15523 - protein, 6 aa, Neisseria
FNEMVR

SEQ ID NO: 15524 - protein, 11 aa, Neisseria
MRMWEAIETYM

SEQ ID NO: 15525 - protein, 5 aa, Neisseria
RLAGV

SEQ ID NO: 15526 - protein, 13 aa, Neisseria
IVAEGFERIHRTN

SEQ ID NO: 15527 - protein, 5 aa, Neisseria
GTETY

SEQ ID NO: 15528 - protein, 8 aa, Neisseria
LNGKRKAG

SEQ ID NO: 15529 - protein, 8 aa, Neisseria
FLRKERVV

SEQ ID NO: 15530 - protein, 6 aa, Neisseria
GEGARS

SEQ ID NO: 15531 - protein, 7 aa, Neisseria
SIGDRAT

SEQ ID NO: 15532 - protein, 5 aa, Neisseria
MTPEF

SEQ ID NO: 15533 - protein, 5 aa, Neisseria
IDEQT

SEQ ID NO: 15534 - protein, 10 aa, Neisseria
TGRDDAQVKL

SEQ ID NO: 15535 - protein, 13 aa, Neisseria
SVTRNMAGPSNPH

SEQ ID NO: 15536 - protein, 22 aa, Neisseria
LAGKGLAKPYEEPSDGQMPDGA

SEQ ID NO: 15537 - protein, 10 aa, Neisseria
CTNTSNPRNV

SEQ ID NO: 15538 - protein, 19 aa, Neisseria
GLQRKPWVKSSFAPGSKVA

SEQ ID NO: 15539 - protein, 14 aa, Neisseria
YLKEADLLPEMEKL

SEQ ID NO: 15540 - protein, 23 aa, Neisseria
TCNGMSGALDPKIQKEIIDRDLY

SEQ ID NO: 15541 - protein, 15 aa, Neisseria
SGNRNFDGRIHPYAK

SEQ ID NO: 15542 - protein, 9 aa, Neisseria
IRFDIENDV

SEQ ID NO: 15543 - protein, 21 aa, Neisseria
GVADGKEIRLKDIWPTDEEID

SEQ ID NO: 15544 - protein, 9 aa, Neisseria
YVKPQQFRD

SEQ ID NO: 15545 - protein, 28 aa, Neisseria
DTGTAQKAPSPLYDWRPMSTYIRRPPYW

SEQ ID NO: 15546 - protein, 11 aa, Neisseria
LAGERTLSGMR

SEQ ID NO: 15547 - protein, 14 aa, Neisseria
LPDNITTDHLSPSN

SEQ ID NO: 15548 - protein, 19 aa, Neisseria
GLPEEDFNSYATHRGDHLT

SEQ ID NO: 15549 - protein, 6 aa, Neisseria
ANPKLF

SEQ ID NO: 15550 - protein, 23 aa, Neisseria
MVRNEDGSVRQGSLARVEPEGQT

SEQ ID NO: 15551 - protein, 7 aa, Neisseria
YMNRKQP

SEQ ID NO: 15552 - protein, 17 aa, Neisseria
ADYGQGSSRDWAAKGVR

SEQ ID NO: 15553 - protein, 10 aa, Neisseria
GFERIHRTNL

SEQ ID NO: 15554 - protein, 30 aa, Neisseria
FKPGTNRHTLQLDGTETYDVVGERTPRCDL

SEQ ID NO: 15555 - protein, 10 aa, Neisseria
IHRKNGETVE

SEQ ID NO: 15556 - protein, 8 aa, Neisseria
CRLDTAEE

SEQ ID NO: 15557 - protein, 8 aa, Neisseria
LNGKRKAG

SEQ ID NO: 15558 - protein, 8 aa, Neisseria
FLRKERVV

SEQ ID NO: 15559 - protein, 5 aa, Neisseria
GEGAR

SEQ ID NO: 15560 - protein, 7 aa, Neisseria
SIGDRAT

SEQ ID NO: 15561 - protein, 5 aa, Neisseria
IDEQT

SEQ ID NO: 15562 - protein, 10 aa, Neisseria
TGRDDAQVKL

SEQ ID NO: 15563 - protein, 15 aa, Neisseria
GLAKPYEEPSDGQMP

SEQ ID NO: 15564 - protein, 14 aa, Neisseria
YLKEADLLPEMEKL

SEQ ID NO: 15565 - protein, 15 aa, Neisseria
LDPKIQKEIIDRDLY

SEQ ID NO: 15566 - protein, 7 aa, Neisseria
RNFDGRI

SEQ ID NO: 15567 - protein, 9 aa, Neisseria
IRFDIENDV

SEQ ID NO: 15568 - protein, 10 aa, Neisseria
ADGKEIRLKD

SEQ ID NO: 15569 - protein, 8 aa, Neisseria
WPTDEEID

SEQ ID NO: 15570 - protein, 6 aa, Neisseria
TAQKAP

SEQ ID NO: 15571 - protein, 8 aa, Neisseria
LAGERTLS

SEQ ID NO: 15572 - protein, 8 aa, Neisseria
GLPEEDFN

SEQ ID NO: 15573 - protein, 7 aa, Neisseria
HRGDHLT

SEQ ID NO: 15574 - protein, 11 aa, Neisseria
MVRNEDGSVRQ

SEQ ID NO: 15575 - protein, 9 aa, Neisseria
ARVEPEGQT

SEQ ID NO: 15576 - protein, 7 aa, Neisseria
YMNRKQP

SEQ ID NO: 15577 - protein, 15 aa, Neisseria
YGQGSSRDWAAKGVR

SEQ ID NO: 15578 - protein, 7 aa, Neisseria
GFERIHR

SEQ ID NO: 15579 - protein, 6 aa, Neisseria
PGTNRH

SEQ ID NO: 15580 - protein, 5 aa, Neisseria
DGTET

SEQ ID NO: 15581 - protein, 11 aa, Neisseria
DVVGERTPRCD

SEQ ID NO: 15582 - protein, 10 aa, Neisseria
IHRKNGETVE

SEQ ID NO: 15583 - protein, 8 aa, Neisseria
CRLDTAEE

SEQ ID NO: 15584 - protein, 10 aa, Neisseria
VLLYTWFSML

SEQ ID NO: 15585 - protein, 23 aa, Neisseria
  VARIANT 3: Xaa is any amino acid
GAXFDTMVKDLLGRSWNIINGIA

SEQ ID NO: 15586 - protein, 9 aa, Neisseria
TAKGLGSAA

SEQ ID NO: 15587 - protein, 10 aa, Neisseria
LVFFGILAFC

SEQ ID NO: 15588 - protein, 9 aa, Neisseria
LVDRFTSVL

SEQ ID NO: 15589 - protein, 5 aa, Neisseria
GMVLT

SEQ ID NO: 15590 - protein, 10 aa, Neisseria
NVSSLLKYFK

SEQ ID NO: 15591 - protein, 6 aa, Neisseria
KVAKSI

SEQ ID NO: 15592 - protein, 24 aa, Neisseria
IETLSKFAQTGNMDKILSLFSYMA

SEQ ID NO: 15593 - protein, 12 aa, Neisseria
FDYIADIFKWND

SEQ ID NO: 15594 - protein, 7 aa, Neisseria
FVTAIGY

SEQ ID NO: 15595 - protein, 9 aa, Neisseria
ATVWTGIIP

SEQ ID NO: 15596 - protein, 6 aa, Neisseria
GKTYKV

SEQ ID NO: 15597 - protein, 8 aa, Neisseria
MPTKTPSL

SEQ ID NO: 15598 - protein, 5 aa, Neisseria
LLGRS

SEQ ID NO: 15599 - protein, 13 aa, Neisseria
DLTAKGLGSAAGG

SEQ ID NO: 15600 - protein, 7 aa, Neisseria
RLVDRFT

SEQ ID NO: 15601 - protein, 8 aa, Neisseria
TQAPTGTN

SEQ ID NO: 15602 - protein, 10 aa, Neisseria
YFKGDAPKVA

SEQ ID NO: 15603 - protein, 8 aa, Neisseria
  VARIANT 1: Xaa is any amino acid
XNLPRNEF

SEQ ID NO: 15604 - protein, 9 aa, Neisseria
AQTGNMDKI

SEQ ID NO: 15605 - protein, 12 aa, Neisseria
KWNDSVSGRTKT

SEQ ID NO: 15606 - protein, 16 aa, Neisseria
LYRSRKKFGAGKTYKV

SEQ ID NO: 15607 - protein, 5 aa, Neisseria
MPTKT

SEQ ID NO: 15608 - protein, 7 aa, Neisseria
RLVDRFT

SEQ ID NO: 15609 - protein, 9 aa, Neisseria
FKGDAPKVA

SEQ ID NO: 15610 - protein, 6 aa, Neisseria
LPRNEF

SEQ ID NO: 15611 - protein, 5 aa, Neisseria
GNMDK

SEQ ID NO: 15612 - protein, 7 aa, Neisseria
VSGRTKT

SEQ ID NO: 15613 - protein, 8 aa, Neisseria
RSRKKFGA

SEQ ID NO: 15614 - protein, 5 aa, Neisseria
WIGLG

SEQ ID NO: 15615 - protein, 6 aa, Neisseria
VTRLLD

SEQ ID NO: 15616 - protein, 9 aa, Neisseria
KVYGNTAEL

SEQ ID NO: 15617 - protein, 14 aa, Neisseria
AAVCDILNGVRDGL

SEQ ID NO: 15618 - protein, 5 aa, Neisseria
TISPT

SEQ ID NO: 15619 - protein, 13 aa, Neisseria
VEAAGGQFAEAPV

SEQ ID NO: 15620 - protein, 11 aa, Neisseria
AVLNPLQKIFS

SEQ ID NO: 15621 - protein, 8 aa, Neisseria
FGDVGKGS

SEQ ID NO: 15622 - protein, 11 aa, Neisseria
NSLLGIFGEAY

SEQ ID NO: 15623 - protein, 9 aa, Neisseria
IVEAIGGSA

SEQ ID NO: 15624 - protein, 12 aa, Neisseria
LEQAGNTLPAVE

SEQ ID NO: 15625 - protein, 10 aa, Neisseria
AASYRKAVEA

SEQ ID NO: 15626 - protein, 6 aa, Neisseria
SANEYT

SEQ ID NO: 15627 - protein, 7 aa, Neisseria
LLDGGIE

SEQ ID NO: 15628 - protein, 23 aa, Neisseria
VYNRSPDKTAPISAKGAKVYGNT

SEQ ID NO: 15629 - protein, 8 aa, Neisseria
NGVRDGLA

SEQ ID NO: 15630 - protein, 10 aa, Neisseria
STISPTENLA

SEQ ID NO: 15631 - protein, 10 aa, Neisseria
PVSGSVGPAT

SEQ ID NO: 15632 - protein, 5 aa, Neisseria
GGSEA

SEQ ID NO: 15633 - protein, 16 aa, Neisseria
VGKKTFHFGDVGKGSG

SEQ ID NO: 15634 - protein, 9 aa, Neisseria
FGIDTDTIV

SEQ ID NO: 15635 - protein, 22 aa, Neisseria
SAMDSPMFQTKKSLWANREFPP

SEQ ID NO: 15636 - protein, 21 aa, Neisseria
HASKDLNLAVKELEQAGNTLP

SEQ ID NO: 15637 - protein, 18 aa, Neisseria
ASYRKAVEAGYGEQDVSG

SEQ ID NO: 15638 - protein, 6 aa, Neisseria
LLDGGI

SEQ ID NO: 15639 - protein, 15 aa, Neisseria
RSPDKTAPISAKGAK

SEQ ID NO: 15640 - protein, 8 aa, Neisseria
NGVRDGLA

SEQ ID NO: 15641 - protein, 7 aa, Neisseria
DVGKGSG

SEQ ID NO: 15642 - protein, 8 aa, Neisseria
FGIDTDTI

SEQ ID NO: 15643 - protein, 8 aa, Neisseria
QTKKSLWA

SEQ ID NO: 15644 - protein, 17 aa, Neisseria
HASKDLNLAVKELEQAG

SEQ ID NO: 15645 - protein, 7 aa, Neisseria
SYRKAVE

SEQ ID NO: 15646 - protein, 7 aa, Neisseria
GYGEQDV

SEQ ID NO: 15647 - protein, 12 aa, Neisseria
GTYRDLHRPASE

SEQ ID NO: 15648 - protein, 10 aa, Neisseria
LIPAMAGTIG

SEQ ID NO: 15649 - protein, 6 aa, Neisseria
AVAAAF

SEQ ID NO: 15650 - protein, 5 aa, Neisseria
GLLMA

SEQ ID NO: 15651 - protein, 7 aa, Neisseria
IMAKLTS

SEQ ID NO: 15652 - protein, 14 aa, Neisseria
GTTGQVKKLFSWAG

SEQ ID NO: 15653 - protein, 14 aa, Neisseria
VMYALLEHWKKRWL

SEQ ID NO: 15654 - protein, 5 aa, Neisseria
VPLGC

SEQ ID NO: 15655 - protein, 7 aa, Neisseria
HQVFQKI

SEQ ID NO: 15656 - protein, 6 aa, Neisseria
VGSILG

SEQ ID NO: 15657 - protein, 6 aa, Neisseria
TSSWGT

SEQ ID NO: 15658 - protein, 18 aa, Neisseria
AVGMLPGIPPFLEHFKSL

SEQ ID NO: 15659 - protein, 16 aa, Neisseria
MEKHNGTYRDLHRPAS

SEQ ID NO: 15660 - protein, 9 aa, Neisseria
FATRDEYLE

SEQ ID NO: 15661 - protein, 19 aa, Neisseria
MQPKRWRPNLPFRDYRFEW

SEQ ID NO: 15662 - protein, 5 aa, Neisseria
LGLPD

SEQ ID NO: 15663 - protein, 9 aa, Neisseria
PGANLPGTH

SEQ ID NO: 15664 - protein, 6 aa, Neisseria
LTSNGV

SEQ ID NO: 15665 - protein, 6 aa, Neisseria
TGQVKK

SEQ ID NO: 15666 - protein, 6 aa, Neisseria
APGLPP

SEQ ID NO: 15667 - protein, 5 aa, Neisseria
ENSGW

SEQ ID NO: 15668 - protein, 9 aa, Neisseria
SYPEKTDKV

SEQ ID NO: 15669 - protein, 7 aa, Neisseria
NIDDTMT

SEQ ID NO: 15670 - protein, 9 aa, Neisseria
IAKRPIPGG

SEQ ID NO: 15671 - protein, 14 aa, Neisseria
AGMEMTRKGKTTQS

SEQ ID NO: 15672 - protein, 7 aa, Neisseria
GCKERSA

SEQ ID NO: 15673 - protein, 16 aa, Neisseria
MEKHNGTYRDLHRPAS

SEQ ID NO: 15674 - protein, 9 aa, Neisseria
FATRDEYLE

SEQ ID NO: 15675 - protein, 5 aa, Neisseria
KRWRP

SEQ ID NO: 15676 - protein, 7 aa, Neisseria
RDYRFEW

SEQ ID NO: 15677 - protein, 5 aa, Neisseria
GQVKK

SEQ ID NO: 15678 - protein, 9 aa, Neisseria
SYPEKTDKV

SEQ ID NO: 15679 - protein, 6 aa, Neisseria
IDDTMT

SEQ ID NO: 15680 - protein, 7 aa, Neisseria
IAKRPIP

SEQ ID NO: 15681 - protein, 13 aa, Neisseria
AGMEMTRKGKTTQ

SEQ ID NO: 15682 - protein, 7 aa, Neisseria
GCKERSA

SEQ ID NO: 15683 - protein, 9 aa, Neisseria
RLPNFIRTL

SEQ ID NO: 15684 - protein, 22 aa, Neisseria
PSPAEIQKRIDDALKEVNRQMS

SEQ ID NO: 15685 - protein, 7 aa, Neisseria
FNQHTAG

SEQ ID NO: 15686 - protein, 7 aa, Neisseria
GPLVNLW

SEQ ID NO: 15687 - protein, 9 aa, Neisseria
IKQAASYTG

SEQ ID NO: 15688 - protein, 5 aa, Neisseria
DYASL

SEQ ID NO: 15689 - protein, 8 aa, Neisseria
LDLSSIAK

SEQ ID NO: 15690 - protein, 7 aa, Neisseria
YLVEIGG

SEQ ID NO: 15691 - protein, 5 aa, Neisseria
ETEAL

SEQ ID NO: 15692 - protein, 10 aa, Neisseria
MPSETRLPNF

SEQ ID NO: 15693 - protein, 6 aa, Neisseria
CSEQTA

SEQ ID NO: 15694 - protein, 6 aa, Neisseria
QGETMG

SEQ ID NO: 15695 - protein, 57 aa, Neisseria; identical to SEQ ID NO: 1557

SEQ ID NO: 15696 - protein, 19 aa, Neisseria
GFGPDKSVTREPSPEQIKQ

SEQ ID NO: 15697 - protein, 19 aa, Neisseria
IILKQGKDYASLSKTHPKA

SEQ ID NO: 15698 - protein, 14 aa, Neisseria
FGVDKVAGELEKYG

SEQ ID NO: 15699 - protein, 26 aa, Neisseria
IGGELHGKGKNARGEPWRIGIEQPNI

SEQ ID NO: 15700 - protein, 13 aa, Neisseria
LNNRSLATSGDYR

SEQ ID NO: 15701 - protein, 11 aa, Neisseria
FHVDKSGKRLS

SEQ ID NO: 15702 - protein, 10 aa, Neisseria
INPNNKRPIS

SEQ ID NO: 15703 - protein, 8 aa, Neisseria
AMTADGLS

SEQ ID NO: 15704 - protein, 13 aa, Neisseria
ETEALKLAEREKL

SEQ ID NO: 15705 - protein, 8 aa, Neisseria
VRDKGGYR

SEQ ID NO: 15706 - protein, 10 aa, Neisseria
MSSEFEKLLR

SEQ ID NO: 15707 - protein, 7 aa, Neisseria
MPSETRL

SEQ ID NO: 15708 - protein, 6 aa, Neisseria
CSEQTA

SEQ ID NO: 15709 - protein, 9 aa, Neisseria
SNNRDKLPS

SEQ ID NO: 15710 - protein, 17 aa, Neisseria
AEIQKRIDDALKEVNRQ

SEQ ID NO: 15711 - protein, 8 aa, Neisseria
QPDSEISR

SEQ ID NO: 15712 - protein, 7 aa, Neisseria
KPLRISS

SEQ ID NO: 15713 - protein, 17 aa, Neisseria
GPDKSVTREPSPEQIKQ

SEQ ID NO: 15714 - protein, 11 aa, Neisseria
IILKQGKDYAS

SEQ ID NO: 15715 - protein, 5 aa, Neisseria
SKTHP

SEQ ID NO: 15716 - protein, 14 aa, Neisseria
FGVDKVAGELEKYG

SEQ ID NO: 15717 - protein, 13 aa, Neisseria
LHGKGKNARGEPW

SEQ ID NO: 15718 - protein, 10 aa, Neisseria
HVDKSGKRLS

SEQ ID NO: 15719 - protein, 7 aa, Neisseria
PNNKRPI

SEQ ID NO: 15720 - protein, 13 aa, Neisseria
ETEALKLAEREKL

SEQ ID NO: 15721 - protein, 7 aa, Neisseria
VRDKGGY

SEQ ID NO: 15722 - protein, 8 aa, Neisseria
SEFEKLLR

SEQ ID NO: 15723 - protein, 8 aa, Neisseria
PIQDTQSA

SEQ ID NO: 15724 - protein, 13 aa, Neisseria
LQELREWFDSYCT

SEQ ID NO: 15725 - protein, 7 aa, Neisseria
GEPLPDH

SEQ ID NO: 15726 - protein, 6 aa, Neisseria
HELDLL

SEQ ID NO: 15727 - protein, 14 aa, Neisseria
DAVAATLLADIGRY

SEQ ID NO: 15728 - protein, 27 aa, Neisseria
CNSTVAELVKGVDEVQKLTHFARVDSL

SEQ ID NO: 15729 - protein, 6 aa, Neisseria
KMLLAM

SEQ ID NO: 15730 - protein, 11 aa, Neisseria
FLSNAPDSPEK

SEQ ID NO: 15731 - protein, 6 aa, Neisseria
EPEKYR

SEQ ID NO: 15732 - protein, 13 aa, Neisseria
RLEYIENFLNILR

SEQ ID NO: 15733 - protein, 11 aa, Neisseria
GRPKHIYSIYK

SEQ ID NO: 15734 - protein, 5 aa, Neisseria
LFDIR

SEQ ID NO: 15735 - protein, 32 aa, Neisseria; identical to SEQ ID NO: 1591

SEQ ID NO: 15736 - protein, 7 aa, Neisseria
GYKSLHT

SEQ ID NO: 15737 - protein, 11 aa, Neisseria
DMHQFNEFGVA

SEQ ID NO: 15738 - protein, 5 aa, Neisseria
QLLDW

SEQ ID NO: 15739 - protein, 7 aa, Neisseria
HSSIGDR

SEQ ID NO: 15740 - protein, 9 aa, Neisseria
KAIGKIRAY

SEQ ID NO: 15741 - protein, 5 aa, Neisseria
QQNAD

SEQ ID NO: 15742 - protein, 5 aa, Neisseria
QLAKL

SEQ ID NO: 15743 - protein, 5 aa, Neisseria
QELAE

SEQ ID NO: 15744 - protein, 10 aa, Neisseria
GYKKPEDLYT

SEQ ID NO: 15745 - protein, 15 aa, Neisseria
NRAIQKACGTLNEPP

SEQ ID NO: 15746 - protein, 6 aa, Neisseria
KIKKGG

SEQ ID NO: 15747 - protein, 11 aa, Neisseria
MTTLAKCCKPA

SEQ ID NO: 15748 - protein, 5 aa, Neisseria
DDIVG

SEQ ID NO: 15749 - protein, 16 aa, Neisseria
SFRHLAEHAPEKVLDA

SEQ ID NO: 15750 - protein, 6 aa, Neisseria
RDVSDA

SEQ ID NO: 15751 - protein, 23 aa, Neisseria
QVTDLPRVLASLGDVKGVLSVTR

SEQ ID NO: 15752 - protein, 10 aa, Neisseria
SPIQDTQSAT

SEQ ID NO: 15753 - protein, 21 aa, Neisseria
QELREWFDSYCTALPNNDKKL

SEQ ID NO: 15754 - protein, 13 aa, Neisseria
AATPYGEPLPDHF

SEQ ID NO: 15755 - protein, 9 aa, Neisseria
DIGRYVPDW

SEQ ID NO: 15756 - protein, 9 aa, Neisseria
VSERCNSTV

SEQ ID NO: 15757 - protein, 11 aa, Neisseria
ELVKGVDEVQK

SEQ ID NO: 15758 - protein, 20 aa, Neisseria
ARVDSLATPEERAQQAETMR

SEQ ID NO: 15759 - protein, 6 aa, Neisseria
AMRTRT

SEQ ID NO: 15760 - protein, 16 aa, Neisseria
NAPDSPEKRAVAKETL

SEQ ID NO: 15761 - protein, 14 aa, Neisseria
DLGFRHQEPEKYRE

SEQ ID NO: 15762 - protein, 11 aa, Neisseria
LDEKRTERLEY

SEQ ID NO: 15763 - protein, 7 aa, Neisseria
LRTELKK

SEQ ID NO: 15764 - protein, 7 aa, Neisseria
VAGRPKH

SEQ ID NO: 15765 - protein, 9 aa, Neisseria
KMVKKKLSF

SEQ ID NO: 15766 - protein, 6 aa, Neisseria
TVPECY

SEQ ID NO: 15767 - protein, 20 aa, Neisseria
PIPGEFDDYIANPKGNGYKS

SEQ ID NO: 15768 - protein, 15 aa, Neisseria
IVGPEDKGVEVQIRT

SEQ ID NO: 15769 - protein, 16 aa, Neisseria
WRYKEGGKGDSAYEQK

SEQ ID NO: 15770 - protein, 17 aa, Neisseria
LDWRENMAESGKEDLAA

SEQ ID NO: 15771 - protein, 5 aa, Neisseria
TPHGK

SEQ ID NO: 15772 - protein, 15 aa, Neisseria
HSSIGDRCRGAKVEG

SEQ ID NO: 15773 - protein, 22 aa, Neisseria
TPLENGQRVEIITAKEGHPSVN

SEQ ID NO: 15774 - protein, 11 aa, Neisseria
GWVKSNKAIGK

SEQ ID NO: 15775 - protein, 22 aa, Neisseria
IRQQNADTVREEGRVQLDKQLA

SEQ ID NO: 15776 - protein, 12 aa, Neisseria
LTPKPNLQELAE

SEQ ID NO: 15777 - protein, 9 aa, Neisseria
LGYKKPEDL

SEQ ID NO: 15778 - protein, 24 aa, Neisseria
GQGEISNRAIQKACGTLNEPPPVP

SEQ ID NO: 15779 - protein, 13 aa, Neisseria
KQSKIKKGGKNGV

SEQ ID NO: 15780 - protein, 7 aa, Neisseria
IDGEDGL

SEQ ID NO: 15781 - protein, 12 aa, Neisseria
KCCKPAPPDDIV

SEQ ID NO: 15782 - protein, 17 aa, Neisseria
VTRDRGISVHRKTCPSF

SEQ ID NO: 15783 - protein, 8 aa, Neisseria
HAPEKVLD

SEQ ID NO: 15784 - protein, 24 aa, Neisseria
IEIRAQDRSGLLRDVSDALARHKL

SEQ ID NO: 15785 - protein, 11 aa, Neisseria
QTQSRDLEASM

SEQ ID NO: 15786 - protein, 11 aa, Neisseria
LEVKQVTDLPR

SEQ ID NO: 15787 - protein, 5 aa, Neisseria
GDVKG

SEQ ID NO: 15788 - protein, 5 aa, Neisseria
QDTQS

SEQ ID NO: 15789 - protein, 7 aa, Neisseria
QELREWF

SEQ ID NO: 15790 - protein, 7 aa, Neisseria
PNNDKKL

SEQ ID NO: 15791 - protein, 8 aa, Neisseria
VSERCNST

SEQ ID NO: 15792 - protein, 11 aa, Neisseria
ELVKGVDEVQK

SEQ ID NO: 15793 - protein, 5 aa, Neisseria
ARVDS

SEQ ID NO: 15794 - protein, 14 aa, Neisseria
ATPEERAQQAETMR

SEQ ID NO: 15795 - protein, 6 aa, Neisseria
AMRTRT

SEQ ID NO: 15796 - protein, 15 aa, Neisseria
APDSPEKRAVAKETL

SEQ ID NO: 15797 - protein, 14 aa, Neisseria
DLGFRHQEPEKYRE

SEQ ID NO: 15798 - protein, 11 aa, Neisseria
LDEKRTERLEY

SEQ ID NO: 15799 - protein, 7 aa, Neisseria
LRTELKK

SEQ ID NO: 15800 - protein, 7 aa, Neisseria
VAGRPKH

SEQ ID NO: 15801 - protein, 9 aa, Neisseria
KMVKKKLSF

SEQ ID NO: 15802 - protein, 5 aa, Neisseria
GEFDD

SEQ ID NO: 15803 - protein, 5 aa, Neisseria
PKGNG

SEQ ID NO: 15804 - protein, 13 aa, Neisseria
GPEDKGVEVQIRT

SEQ ID NO: 15805 - protein, 14 aa, Neisseria
RYKEGGKGDSAYEQ

SEQ ID NO: 15806 - protein, 17 aa, Neisseria
LDWRENMAESGKEDLAA

SEQ ID NO: 15807 - protein, 12 aa, Neisseria
IGDRCRGAKVEG

SEQ ID NO: 15808 - protein, 17 aa, Neisseria
LENGQRVEIITAKEGHP

SEQ ID NO: 15809 - protein, 9 aa, Neisseria
VKSNKAIGK

SEQ ID NO: 15810 - protein, 19 aa, Neisseria
QNADTVREEGRVQLDKQLA

SEQ ID NO: 15811 - protein, 9 aa, Neisseria
LGYKKPEDL

SEQ ID NO: 15812 - protein, 5 aa, Neisseria
GEISN

SEQ ID NO: 15813 - protein, 10 aa, Neisseria
KQSKIKKGGK

SEQ ID NO: 15814 - protein, 7 aa, Neisseria
IDGEDGL

SEQ ID NO: 15815 - protein, 11 aa, Neisseria
KCCKPAPPDDI

SEQ ID NO: 15816 - protein, 15 aa, Neisseria
VTRDRGISVHRKTCP

SEQ ID NO: 15817 - protein, 7 aa, Neisseria
HAPEKVL

SEQ ID NO: 15818 - protein, 24 aa, Neisseria
IEIRAQDRSGLLRDVSDALARHKL

SEQ ID NO: 15819 - protein, 10 aa, Neisseria
TQSRDLEASM

SEQ ID NO: 15820 - protein, 11 aa, Neisseria
LEVKQVTDLPR

SEQ ID NO: 15821 - protein, 5 aa, Neisseria
GDVKG

SEQ ID NO: 15822 - protein, 5 aa, Neisseria
GKWYD

SEQ ID NO: 15823 - protein, 5 aa, Neisseria
IPRDI

SEQ ID NO: 15824 - protein, 12 aa, Neisseria
IGTIIDFLMVPN

SEQ ID NO: 15825 - protein, 13 aa, Neisseria
IHERYERFTTMLR

SEQ ID NO: 15826 - protein, 12 aa, Neisseria
CEFKDFRRNIPC

SEQ ID NO: 15827 - protein, 8 aa, Neisseria
EEYDENSF

SEQ ID NO: 15828 - protein, 38 aa, Neisseria
GKWYDDGVWDDEEYWKLENDLIEVRKKYPYPMDIPRDI

SEQ ID NO: 15829 - protein, 6 aa, Neisseria
PWLPDS

SEQ ID NO: 15830 - protein, 8 aa, Neisseria
GIHERYER

SEQ ID NO: 15831 - protein, 7 aa, Neisseria
FTEKDIV

SEQ ID NO: 15832 - protein, 7 aa, Neisseria
FDYYNKK

SEQ ID NO: 15833 - protein, 12 aa, Neisseria
CEFKDFRRNIPC

SEQ ID NO: 15834 - protein, 5 aa, Neisseria
EEYDE

SEQ ID NO: 15835 - protein, 24 aa, Neisseria
GVWDDEEYWKLENDLIEVRKKYPY

SEQ ID NO: 15836 - protein, 5 aa, Neisseria
ERYER

SEQ ID NO: 15837 - protein, 7 aa, Neisseria
FTEKDIV

SEQ ID NO: 15838 - protein, 5 aa, Neisseria
YYNKK

SEQ ID NO: 15839 - protein, 6 aa, Neisseria
KNIFSA

SEQ ID NO: 15840 - protein, 12 aa, Neisseria
SGNAYKIVSTIK

SEQ ID NO: 15841 - protein, 13 aa, Neisseria
NTLHPTYYRDIRR

SEQ ID NO: 15842 - protein, 17 aa, Neisseria
ITNGKKLYSVGGLNKAG

SEQ ID NO: 15843 - protein, 8 aa, Neisseria
PSLNNIPA

SEQ ID NO: 15844 - protein, 5 aa, Neisseria
SGSYG

SEQ ID NO: 15845 - protein, 10 aa, Neisseria
TFERSGNAYK

SEQ ID NO: 15846 - protein, 8 aa, Neisseria
FESGGTVV

SEQ ID NO: 15847 - protein, 11 aa, Neisseria
RDIRRGKLYAE

SEQ ID NO: 15848 - protein, 23 aa, Neisseria
KFADGSVTYGKAGESKTEQSPKA

SEQ ID NO: 15849 - protein, 20 aa, Neisseria
ANDAKLPPGLKITNGKKLYS

SEQ ID NO: 15850 - protein, 31 aa, Neisseria; identical to SEQ ID NO: 1681

SEQ ID NO: 15851 - protein, 9 aa, Neisseria
GYTDDGKTY

SEQ ID NO: 15852 - protein, 6 aa, Neisseria
GQAAKP

SEQ ID NO: 15853 - protein, 7 aa, Neisseria
TFERSGN

SEQ ID NO: 15854 - protein, 10 aa, Neisseria
RDIRRGKLYA

SEQ ID NO: 15855 - protein, 13 aa, Neisseria
KAGESKTEQSPKA

SEQ ID NO: 15856 - protein, 6 aa, Neisseria
ANDAKL

SEQ ID NO: 15857 - protein, 7 aa, Neisseria
TNGKKLY

SEQ ID NO: 15858 - protein, 6 aa, Neisseria
NKAGTG

SEQ ID NO: 15859 - protein, 16 aa, Neisseria
VETEVVKYRVRRGDDA

SEQ ID NO: 15860 - protein, 8 aa, Neisseria
YTDDGKTY

SEQ ID NO: 15861 - protein, 5 aa, Neisseria
QAAKP

SEQ ID NO: 15862 - protein, 10 aa, Neisseria
QELSRLYAQT

SEQ ID NO: 15863 - protein, 6 aa, Neisseria
TVRHAP

SEQ ID NO: 15864 - protein, 5 aa, Neisseria
PAFHE

SEQ ID NO: 15865 - protein, 9 aa, Neisseria
LNIGGIANI

SEQ ID NO: 15866 - protein, 12 aa, Neisseria
PGNMLMDAWMQA

SEQ ID NO: 15867 - protein, 12 aa, Neisseria
GNILPQLLDRLL

SEQ ID NO: 15868 - protein, 5 aa, Neisseria
PKSTG

SEQ ID NO: 15869 - protein, 5 aa, Neisseria
ETYLD

SEQ ID NO: 15870 - protein, 20 aa, Neisseria
DVLRTLSRFTAQTVFDAVSH

SEQ ID NO: 15871 - protein, 7 aa, Neisseria
ADLAECF

SEQ ID NO: 15872 - protein, 8 aa, Neisseria
VNRIPGSP

SEQ ID NO: 15873 - protein, 7 aa, Neisseria
TSMDGAD

SEQ ID NO: 15874 - protein, 10 aa, Neisseria
IRMDGGKWLG

SEQ ID NO: 15875 - protein, 28 aa, Neisseria
PYPGRLRRKLLDLQDTGADELHRSRMLS

SEQ ID NO: 15876 - protein, 9 aa, Neisseria
NLAPSDITA

SEQ ID NO: 15877 - protein, 15 aa, Neisseria
CHGQTVRHAPEHSYS

SEQ ID NO: 15878 - protein, 7 aa, Neisseria
LLAERTQ

SEQ ID NO: 15879 - protein, 15 aa, Neisseria
VGDFRSRDLAAGGQG

SEQ ID NO: 15880 - protein, 10 aa, Neisseria
LFRDDRETRA

SEQ ID NO: 15881 - protein, 5 aa, Neisseria
PPDAP

SEQ ID NO: 15882 - protein, 8 aa, Neisseria
GFDTGPGN

SEQ ID NO: 15883 - protein, 13 aa, Neisseria
PYDKNGAKAAQGN

SEQ ID NO: 15884 - protein, 9 aa, Neisseria
PHPKSTGRE

SEQ ID NO: 15885 - protein, 16 aa, Neisseria
YLDGGENRYDVLRTLS

SEQ ID NO: 15886 - protein, 6 aa, Neisseria
AADARQ

SEQ ID NO: 15887 - protein, 9 aa, Neisseria
GGGIRNPVL

SEQ ID NO: 15888 - protein, 16 aa, Neisseria
IPGSPHKATGASKPCI

SEQ ID NO: 15889 - protein, 7 aa, Neisseria
TSMDGAD

SEQ ID NO: 15890 - protein, 25 aa, Neisseria
GRLRRKLLDLQDTGADELHRSRMLS

SEQ ID NO: 15891 - protein, 6 aa, Neisseria
TVRHAP

SEQ ID NO: 15892 - protein, 7 aa, Neisseria
LLAERTQ

SEQ ID NO: 15893 - protein, 9 aa, Neisseria
DFRSRDLAA

SEQ ID NO: 15894 - protein, 10 aa, Neisseria
LFRDDRETRA

SEQ ID NO: 15895 - protein, 10 aa, Neisseria
YDKNGAKAAQ

SEQ ID NO: 15896 - protein, 8 aa, Neisseria
HPKSTGRE

SEQ ID NO: 15897 - protein, 10 aa, Neisseria
LDGGENRYDV

SEQ ID NO: 15898 - protein, 6 aa, Neisseria
AADARQ

SEQ ID NO: 15899 - protein, 12 aa, Neisseria
IPGSPHKATGAS

SEQ ID NO: 15900 - protein, 6 aa, Neisseria
NIHKTF

SEQ ID NO: 15901 - protein, 13 aa, Neisseria
TFLRCLNALEMPE

SEQ ID NO: 15902 - protein, 6 aa, Neisseria
LENVME

SEQ ID NO: 15903 - protein, 5 aa, Neisseria
KLLEK

SEQ ID NO: 15904 - protein, 18 aa, Neisseria
PELVQDVLNAMKELAREG

SEQ ID NO: 15905 - protein, 8 aa, Neisseria
PKELFDHP

SEQ ID NO: 15906 - protein, 12 aa, Neisseria
RNIHKTFGKNTI

SEQ ID NO: 15907 - protein, 6 aa, Neisseria
DVCKGQ

SEQ ID NO: 15908 - protein, 9 aa, Neisseria
GPSGSGKTT

SEQ ID NO: 15909 - protein, 29 aa, Neisseria
EMPEDGQIEFDNERPLKIDFSKKPSKHDI

SEQ ID NO: 15910 - protein, 8 aa, Neisseria
ALRRKSGM

SEQ ID NO: 15911 - protein, 7 aa, Neisseria
FPHKTAL

SEQ ID NO: 15912 - protein, 16 aa, Neisseria
GKPAAQAREEALKLLE

SEQ ID NO: 15913 - protein, 9 aa, Neisseria
VGLGDKVDL

SEQ ID NO: 15914 - protein, 10 aa, Neisseria
SGGQQQRVGI

SEQ ID NO: 15915 - protein, 12 aa, Neisseria
DEPTSALDPELV

SEQ ID NO: 15916 - protein, 11 aa, Neisseria
NAMKELAREGW

SEQ ID NO: 15917 - protein, 23 aa, Neisseria
VEQGSPKELFDHPKHERTRRFLS

SEQ ID NO: 15918 - protein, 28 aa, Neisseria
EMPEDGQIEFDNERPLKIDFSKKPSKHD

SEQ ID NO: 15919 - protein, 7 aa, Neisseria
ALRRKSG

SEQ ID NO: 15920 - protein, 16 aa, Neisseria
GKPAAQAREEALKLLE

SEQ ID NO: 15921 - protein, 8 aa, Neisseria
VGLGDKVD

SEQ ID NO: 15922 - protein, 12 aa, Neisseria
DEPTSALDPELV

SEQ ID NO: 15923 - protein, 8 aa, Neisseria
NAMKELAR

SEQ ID NO: 15924 - protein, 20 aa, Neisseria
QGSPKELFDHPKHERTRRFL

SEQ ID NO: 15925 - protein, 6 aa, Neisseria
LKQSVR

SEQ ID NO: 15926 - protein, 8 aa, Neisseria
GCQSVQEA

SEQ ID NO: 15927 - protein, 6 aa, Neisseria
FQLVEA

SEQ ID NO: 15928 - protein, 6 aa, Neisseria
LDAGCQ

SEQ ID NO: 15929 - protein, 15 aa, Neisseria
LMPWAAPIGTGLGAV

SEQ ID NO: 15930 - protein, 11 aa, Neisseria
SGDPVNMARAF

SEQ ID NO: 15931 - protein, 7 aa, Neisseria
ETFPSRL

SEQ ID NO: 15932 - protein, 11 aa, Neisseria
EILKQSVRTAR

SEQ ID NO: 15933 - protein, 16 aa, Neisseria
SLRRAGCGGEAHGQGF

SEQ ID NO: 15934 - protein, 8 aa, Neisseria
QMAREVFE

SEQ ID NO: 15935 - protein, 10 aa, Neisseria
ELIGDDDTLQ

SEQ ID NO: 15936 - protein, 9 aa, Neisseria
LIKDGFKVL

SEQ ID NO: 15937 - protein, 7 aa, Neisseria
RLLDAGC

SEQ ID NO: 15938 - protein, 11 aa, Neisseria
VLRERLPDTPL

SEQ ID NO: 15939 - protein, 10 aa, Neisseria
AVSRSGDPVN

SEQ ID NO: 15940 - protein, 7 aa, Neisseria
ESGRLAF

SEQ ID NO: 15941 - protein, 16 aa, Neisseria
GPVEARDKAQASTPTV

SEQ ID NO: 15942 - protein, 11 aa, Neisseria
EILKQSVRTAR

SEQ ID NO: 15943 - protein, 12 aa, Neisseria
SLRRAGCGGEAH

SEQ ID NO: 15944 - protein, 8 aa, Neisseria
QMAREVFE

SEQ ID NO: 15945 - protein, 9 aa, Neisseria
LIGDDDTLQ

SEQ ID NO: 15946 - protein, 8 aa, Neisseria
VLRERLPD

SEQ ID NO: 15947 - protein, 7 aa, Neisseria
VSRSGDP

SEQ ID NO: 15948 - protein, 7 aa, Neisseria
ESGRLAF

SEQ ID NO: 15949 - protein, 11 aa, Neisseria
GPVEARDKAQA

SEQ ID NO: 15950 - protein, 8 aa, Neisseria
MLDTWLGA

SEQ ID NO: 15951 - protein, 5 aa, Neisseria
ESVAV

SEQ ID NO: 15952 - protein, 7 aa, Neisseria
VGDYIEI

SEQ ID NO: 15953 - protein, 8 aa, Neisseria
INLLNTLM

SEQ ID NO: 15954 - protein, 9 aa, Neisseria
PNPLVGQLA

SEQ ID NO: 15955 - protein, 7 aa, Neisseria
LEPLCAP

SEQ ID NO: 15956 - protein, 12 aa, Neisseria
IPAIQRHLENVQ

SEQ ID NO: 15957 - protein, 10 aa, Neisseria
RIIVRFASPV

SEQ ID NO: 15958 - protein, 9 aa, Neisseria
AVMDEFLRV

SEQ ID NO: 15959 - protein, 7 aa, Neisseria
IRAEAVE

SEQ ID NO: 15960 - protein, 18 aa, Neisseria
HFKRHPDFGIESKRRFLV

SEQ ID NO: 15961 - protein, 8 aa, Neisseria
SATQQYSV

SEQ ID NO: 15962 - protein, 9 aa, Neisseria
NGLRGRVVD

SEQ ID NO: 15963 - protein, 9 aa, Neisseria
HPVRRDNIL

SEQ ID NO: 15964 - protein, 9 aa, Neisseria
LDSDEAVCR

SEQ ID NO: 15965 - protein, 17 aa, Neisseria
PAAKPRVTRVPYDDKAY

SEQ ID NO: 15966 - protein, 9 aa, Neisseria
SPVSKRLEI

SEQ ID NO: 15967 - protein, 8 aa, Neisseria
YPAGSETL

SEQ ID NO: 15968 - protein, 7 aa, Neisseria
IRAEAVE

SEQ ID NO: 15969 - protein, 17 aa, Neisseria
FKRHPDFGIESKRRFLV

SEQ ID NO: 15970 - protein, 8 aa, Neisseria
NGLRGRVV

SEQ ID NO: 15971 - protein, 8 aa, Neisseria
PVRRDNIL

SEQ ID NO: 15972 - protein, 9 aa, Neisseria
LDSDEAVCR

SEQ ID NO: 15973 - protein, 15 aa, Neisseria
AKPRVTRVPYDDKAY

SEQ ID NO: 15974 - protein, 7 aa, Neisseria
VSKRLEI

SEQ ID NO: 15975 - protein, 6 aa, Neisseria
AGSETL

SEQ ID NO: 15976 - protein, 39 aa, Neisseria
AQTHTGWANTVEPLTGITERVGRIWGVVSHLNSVTDTPE

SEQ ID NO: 15977 - protein, 9 aa, Neisseria
AYNELMPEI

SEQ ID NO: 15978 - protein, 19 aa, Neisseria
QDIELYNRFKTIKNSPEFD

SEQ ID NO: 15979 - protein, 10 aa, Neisseria
FSQNVLDATD

SEQ ID NO: 15980 - protein, 6 aa, Neisseria
GIPEDA

SEQ ID NO: 15981 - protein, 5 aa, Neisseria
HYLAV

SEQ ID NO: 15982 - protein, 6 aa, Neisseria
LREQIY

SEQ ID NO: 15983 - protein, 22 aa, Neisseria
ELSDDGKFDNTANIDRTLENAL

SEQ ID NO: 15984 - protein, 11 aa, Neisseria
AKLLGFKNYAE

SEQ ID NO: 15985 - protein, 19 aa, Neisseria
MADTPEQVLNFLHDLARRA

SEQ ID NO: 15986 - protein, 6 aa, Neisseria
AEVKAF

SEQ ID NO: 15987 - protein, 16 aa, Neisseria
GKVLNGLFAQIKKLYG

SEQ ID NO: 15988 - protein, 5 aa, Neisseria
GRRRF

SEQ ID NO: 15989 - protein, 11 aa, Neisseria
LHHLLTQVDEL

SEQ ID NO: 15990 - protein, 6 aa, Neisseria
ELPSQF

SEQ ID NO: 15991 - protein, 13 aa, Neisseria
GRLKNWQQVLDSV

SEQ ID NO: 15992 - protein, 20 aa, Neisseria
VRPPEYNRFANSFGHIFAGG

SEQ ID NO: 15993 - protein, 6 aa, Neisseria
SYAWAE

SEQ ID NO: 15994 - protein, 8 aa, Neisseria
AAFEESDD

SEQ ID NO: 15995 - protein, 9 aa, Neisseria
KRFWQEILA

SEQ ID NO: 15996 - protein, 9 aa, Neisseria
AAESFKAFR

SEQ ID NO: 15997 - protein, 19 aa, Neisseria
LGEEPRFDQIKTEDIKPAL

SEQ ID NO: 15998 - protein, 8 aa, Neisseria
AEAREQIA

SEQ ID NO: 15999 - protein, 7 aa, Neisseria
AQTHTGW

SEQ ID NO: 16000 - protein, 7 aa, Neisseria
NTVEPLT

SEQ ID NO: 16001 - protein, 9 aa, Neisseria
ITERVGRIW

SEQ ID NO: 16002 - protein, 12 aa, Neisseria
SVTDTPELRAAY

SEQ ID NO: 16003 - protein, 22 aa, Neisseria
IGQDIELYNRFKTIKNSPEFDT

SEQ ID NO: 16004 - protein, 14 aa, Neisseria
SHAQKTKLNHDLRD

SEQ ID NO: 16005 - protein, 23 aa, Neisseria
SGAELPPEQQAELAKLQTEGAQL

SEQ ID NO: 16006 - protein, 6 aa, Neisseria
KFSQNV

SEQ ID NO: 16007 - protein, 5 aa, Neisseria
DATDA

SEQ ID NO: 16008 - protein, 5 aa, Neisseria
IPEDA

SEQ ID NO: 16009 - protein, 10 aa, Neisseria
AQSEGKTGYK

SEQ ID NO: 16010 - protein, 10 aa, Neisseria
ADNRKLREQI

SEQ ID NO: 16011 - protein, 24 aa, Neisseria
VTRASELSDDGKFDNTANIDRTLE

SEQ ID NO: 16012 - protein, 8 aa, Neisseria
KMADTPEQ

SEQ ID NO: 16013 - protein, 15 aa, Neisseria
LARRAKPYAEKDLAE

SEQ ID NO: 16014 - protein, 9 aa, Neisseria
KAFARESLG

SEQ ID NO: 16015 - protein, 20 aa, Neisseria
YAGEKLREAKYAFSETEVKK

SEQ ID NO: 16016 - protein, 7 aa, Neisseria
GFTEKTV

SEQ ID NO: 16017 - protein, 15 aa, Neisseria
KDVRYFELQQNGETI

SEQ ID NO: 16018 - protein, 10 aa, Neisseria
YAREGKRGGA

SEQ ID NO: 16019 - protein, 15 aa, Neisseria
MNDYKGRRRFSDGTL

SEQ ID NO: 16020 - protein, 15 aa, Neisseria
TPPVGGKEARLSHDE

SEQ ID NO: 16021 - protein, 7 aa, Neisseria
QVDELGV

SEQ ID NO: 16022 - protein, 5 aa, Neisseria
ELPSQ

SEQ ID NO: 16023 - protein, 8 aa, Neisseria
SAHEETGV

SEQ ID NO: 16024 - protein, 10 aa, Neisseria
SEDDEGRLKN

SEQ ID NO: 16025 - protein, 18 aa, Neisseria
DSVRKEVAVVRPPEYNRF

SEQ ID NO: 16026 - protein, 7 aa, Neisseria
SAGYYSY

SEQ ID NO: 16027 - protein, 15 aa, Neisseria
FEESDDVAATGKRFW

SEQ ID NO: 16028 - protein, 20 aa, Neisseria
GGSRSAAESFKAFRGREPSI

SEQ ID NO: 16029 - protein, 10 aa, Neisseria
LRHSGFDNAA

SEQ ID NO: 16030 - protein, 17 aa, Neisseria
LGEEPRFDQIKTEDIKP

SEQ ID NO: 16031 - protein, 8 aa, Neisseria
AEAREQIA

SEQ ID NO: 16032 - protein, 6 aa, Neisseria
ITERVG

SEQ ID NO: 16033 - protein, 10 aa, Neisseria
TDTPELRAAY

SEQ ID NO: 16034 - protein, 7 aa, Neisseria
IGQDIEL

SEQ ID NO: 16035 - protein, 11 aa, Neisseria
KTIKNSPEFDT

SEQ ID NO: 16036 - protein, 14 aa, Neisseria
SHAQKTKLNHDLRD

SEQ ID NO: 16037 - protein, 20 aa, Neisseria
ELPPEQQAELAKLQTEGAQL

SEQ ID NO: 16038 - protein, 5 aa, Neisseria
IPEDA

SEQ ID NO: 16039 - protein, 9 aa, Neisseria
AQSEGKTGY

SEQ ID NO: 16040 - protein, 10 aa, Neisseria
ADNRKLREQI

SEQ ID NO: 16041 - protein, 13 aa, Neisseria
RASELSDDGKFDN

SEQ ID NO: 16042 - protein, 8 aa, Neisseria
ANIDRTLE

SEQ ID NO: 16043 - protein, 7 aa, Neisseria
KMADTPE

SEQ ID NO: 16044 - protein, 15 aa, Neisseria
LARRAKPYAEKDLAE

SEQ ID NO: 16045 - protein, 9 aa, Neisseria
KAFARESLG

SEQ ID NO: 16046 - protein, 20 aa, Neisseria
YAGEKLREAKYAFSETEVKK

SEQ ID NO: 16047 - protein, 5 aa, Neisseria
FTEKT

SEQ ID NO: 16048 - protein, 5 aa, Neisseria
KDVRY

SEQ ID NO: 16049 - protein, 5 aa, Neisseria
QNGET

SEQ ID NO: 16050 - protein, 9 aa, Neisseria
YAREGKRGG

SEQ ID NO: 16051 - protein, 9 aa, Neisseria
YKGRRRFSD

SEQ ID NO: 16052 - protein, 12 aa, Neisseria
VGGKEARLSHDE

SEQ ID NO: 16053 - protein, 6 aa, Neisseria
QVDELG

SEQ ID NO: 16054 - protein, 7 aa, Neisseria
SAHEETG

SEQ ID NO: 16055 - protein, 10 aa, Neisseria
SEDDEGRLKN

SEQ ID NO: 16056 - protein, 9 aa, Neisseria
DSVRKEVAV

SEQ ID NO: 16057 - protein, 7 aa, Neisseria
RPPEYNR

SEQ ID NO: 16058 - protein, 11 aa, Neisseria
FEESDDVAATG

SEQ ID NO: 16059 - protein, 19 aa, Neisseria
GSRSAAESFKAFRGREPSI

SEQ ID NO: 16060 - protein, 6 aa, Neisseria
TLVSGI

SEQ ID NO: 16061 - protein, 6 aa, Neisseria
GSGSFG

SEQ ID NO: 16062 - protein, 6 aa, Neisseria
QPVGQL

SEQ ID NO: 16063 - protein, 6 aa, Neisseria
NVPNAP

SEQ ID NO: 16064 - protein, 17 aa, Neisseria
QGFDTLFQHALNGFNAM

SEQ ID NO: 16065 - protein, 5 aa, Neisseria
TASAP

SEQ ID NO: 16066 - protein, 6 aa, Neisseria
FEATCQ

SEQ ID NO: 16067 - protein, 10 aa, Neisseria
CHGGSIPGIP

SEQ ID NO: 16068 - protein, 5 aa, Neisseria
KGKET

SEQ ID NO: 16069 - protein, 6 aa, Neisseria
EGFNAM

SEQ ID NO: 16070 - protein, 12 aa, Neisseria
MKQLRDNKAQGS

SEQ ID NO: 16071 - protein, 25 aa, Neisseria
AGSGSFGDVDATTEAATQTRIQPVG

SEQ ID NO: 16072 - protein, 13 aa, Neisseria
MGDGIPVGERQGE

SEQ ID NO: 16073 - protein, 19 aa, Neisseria
AADSNVPNAPKLEHNGDWA

SEQ ID NO: 16074 - protein, 5 aa, Neisseria
IAQGF

SEQ ID NO: 16075 - protein, 7 aa, Neisseria
MPAKGGA

SEQ ID NO: 16076 - protein, 9 aa, Neisseria
DLTDQELKR

SEQ ID NO: 16077 - protein, 45 aa, Neisseria; identical to SEQ ID NO: 1904

SEQ ID NO: 16078 - protein, 9 aa, Neisseria
GVDGKKVFE

SEQ ID NO: 16079 - protein, 20 aa, Neisseria
GIGKKDDWAPRIKKGKETLH

SEQ ID NO: 16080 - protein, 16 aa, Neisseria
PAKGGNAGLSDDEVKA

SEQ ID NO: 16081 - protein, 5 aa, Neisseria
QSGAK

SEQ ID NO: 16082 - protein, 11 aa, Neisseria
MKQLRDNKAQG

SEQ ID NO: 16083 - protein, 11 aa, Neisseria
GDVDATTEAAT

SEQ ID NO: 16084 - protein, 8 aa, Neisseria
PVGERQGE

SEQ ID NO: 16085 - protein, 6 aa, Neisseria
AADSNV

SEQ ID NO: 16086 - protein, 7 aa, Neisseria
PKLEHNG

SEQ ID NO: 16087 - protein, 6 aa, Neisseria
PAKGGA

SEQ ID NO: 16088 - protein, 9 aa, Neisseria
DLTDQELKR

SEQ ID NO: 16089 - protein, 13 aa, Neisseria
PNPDEAAPADNAA

SEQ ID NO: 16090 - protein, 19 aa, Neisseria
APADSAAPAEAKAEDKGAA

SEQ ID NO: 16091 - protein, 8 aa, Neisseria
VDGKKVFE

SEQ ID NO: 16092 - protein, 19 aa, Neisseria
IGKKDDWAPRIKKGKETLH

SEQ ID NO: 16093 - protein, 6 aa, Neisseria
PAKGGN

SEQ ID NO: 16094 - protein, 9 aa, Neisseria
GLSDDEVKA

SEQ ID NO: 16095 - protein, 7 aa, Neisseria
IISALAV

SEQ ID NO: 16096 - protein, 7 aa, Neisseria
ATCMAMV

SEQ ID NO: 16097 - protein, 14 aa, Neisseria
VQQTQQAPKPVSNT

SEQ ID NO: 16098 - protein, 8 aa, Neisseria
QHGKGADA

SEQ ID NO: 16099 - protein, 7 aa, Neisseria
GSGSGSA

SEQ ID NO: 16100 - protein, 9 aa, Neisseria
HTTKHGLDF

SEQ ID NO: 16101 - protein, 26 aa, Neisseria
NVQQTQQAPKPVSNTEPSAPVPQQQK

SEQ ID NO: 16102 - protein, 6 aa, Neisseria
GKGADA

SEQ ID NO: 16103 - protein, 13 aa, Neisseria
QAPKPVSNTEPSA

SEQ ID NO: 16104 - protein, 7 aa, Neisseria
IQSAGTV

SEQ ID NO: 16105 - protein, 5 aa, Neisseria
GKKTG

SEQ ID NO: 16106 - protein, 10 aa, Neisseria
SDWMDIEKQR

SEQ ID NO: 16107 - protein, 9 aa, Neisseria
VNLLDTPGH

SEQ ID NO: 16108 - protein, 9 aa, Neisseria
DTYRVLTAV

SEQ ID NO: 16109 - protein, 6 aa, Neisseria
AAKGVE

SEQ ID NO: 16110 - protein, 8 aa, Neisseria
IKLLNVCR

SEQ ID NO: 16111 - protein, 6 aa, Neisseria
KYDREV

SEQ ID NO: 16112 - protein, 14 aa, Neisseria
DSLELLDEVENILQ

SEQ ID NO: 16113 - protein, 10 aa, Neisseria
KNFKGVYHIL

SEQ ID NO: 16114 - protein, 11 aa, Neisseria
HEFDIIKGIDN

SEQ ID NO: 16115 - protein, 5 aa, Neisseria
FGSAI

SEQ ID NO: 16116 - protein, 10 aa, Neisseria
EILNSLIEWA

SEQ ID NO: 16117 - protein, 7 aa, Neisseria
KFERGMK

SEQ ID NO: 16118 - protein, 8 aa, Neisseria
DIIGIPNH

SEQ ID NO: 16119 - protein, 5 aa, Neisseria
FSEGE

SEQ ID NO: 16120 - protein, 8 aa, Neisseria
LFRSVRIK

SEQ ID NO: 16121 - protein, 6 aa, Neisseria
PLKIKQ

SEQ ID NO: 16122 - protein, 9 aa, Neisseria
QKGLQQLGE

SEQ ID NO: 16123 - protein, 8 aa, Neisseria
VQVFKPMS

SEQ ID NO: 16124 - protein, 7 aa, Neisseria
SRLANEY

SEQ ID NO: 16125 - protein, 7 aa, Neisseria
AEFEKAN

SEQ ID NO: 16126 - protein, 5 aa, Neisseria
RWPDI

SEQ ID NO: 16127 - protein, 12 aa, Neisseria
EILDQVRRRRTF

SEQ ID NO: 16128 - protein, 11 aa, Neisseria
SHPDAGKTTLT

SEQ ID NO: 16129 - protein, 13 aa, Neisseria
GTVKGKKTGKFAT

SEQ ID NO: 16130 - protein, 10 aa, Neisseria
DWMDIEKQRG

SEQ ID NO: 16131 - protein, 8 aa, Neisseria
FDYKDHTV

SEQ ID NO: 16132 - protein, 16 aa, Neisseria
LLDTPGHQDFSEDTYR

SEQ ID NO: 16133 - protein, 7 aa, Neisseria
DAAKGVE

SEQ ID NO: 16134 - protein, 7 aa, Neisseria
CRLRNTP

SEQ ID NO: 16135 - protein, 20 aa, Neisseria
MNKYDREVRDSLELLDEVEN

SEQ ID NO: 16136 - protein, 7 aa, Neisseria
GMGKNFK

SEQ ID NO: 16137 - protein, 8 aa, Neisseria
AGGERLPH

SEQ ID NO: 16138 - protein, 14 aa, Neisseria
KGIDNPELEQRFPL

SEQ ID NO: 16139 - protein, 9 aa, Neisseria
QQLRDEIEL

SEQ ID NO: 16140 - protein, 7 aa, Neisseria
ASNEFNL

SEQ ID NO: 16141 - protein, 20 aa, Neisseria
PAPKPRDATVRMVEPDEPKF

SEQ ID NO: 16142 - protein, 13 aa, Neisseria
QANMDPKHRDRIA

SEQ ID NO: 16143 - protein, 23 aa, Neisseria
RVCSGKFERGMKMKHLRINREIA

SEQ ID NO: 16144 - protein, 8 aa, Neisseria
SHDRELVE

SEQ ID NO: 16145 - protein, 5 aa, Neisseria
IPNHG

SEQ ID NO: 16146 - protein, 10 aa, Neisseria
IGDSFSEGEQ

SEQ ID NO: 16147 - protein, 24 aa, Neisseria
VRIKNPLKIKQLQKGLQQLGEEGA

SEQ ID NO: 16148 - protein, 8 aa, Neisseria
RLANEYGV

SEQ ID NO: 16149 - protein, 16 aa, Neisseria
SCDDKKKLAEFEKANA

SEQ ID NO: 16150 - protein, 7 aa, Neisseria
APNRVNL

SEQ ID NO: 16151 - protein, 10 aa, Neisseria
LTQERWPDIV

SEQ ID NO: 16152 - protein, 7 aa, Neisseria
ETREHSV

SEQ ID NO: 16153 - protein, 11 aa, Neisseria
EILDQVRRRRT

SEQ ID NO: 16154 - protein, 5 aa, Neisseria
PDAGK

SEQ ID NO: 16155 - protein, 10 aa, Neisseria
GTVKGKKTGK

SEQ ID NO: 16156 - protein, 8 aa, Neisseria
MDIEKQRG

SEQ ID NO: 16157 - protein, 6 aa, Neisseria
DYKDHT

SEQ ID NO: 16158 - protein, 8 aa, Neisseria
QDFSEDTY

SEQ ID NO: 16159 - protein, 7 aa, Neisseria
DAAKGVE

SEQ ID NO: 16160 - protein, 5 aa, Neisseria
CRLRN

SEQ ID NO: 16161 - protein, 18 aa, Neisseria
KYDREVRDSLELLDEVEN

SEQ ID NO: 16162 - protein, 8 aa, Neisseria
AGGERLPH

SEQ ID NO: 16163 - protein, 14 aa, Neisseria
KGIDNPELEQRFPL

SEQ ID NO: 16164 - protein, 9 aa, Neisseria
QQLRDEIEL

SEQ ID NO: 16165 - protein, 18 aa, Neisseria
PKPRDATVRMVEPDEPKF

SEQ ID NO: 16166 - protein, 10 aa, Neisseria
MDPKHRDRIA

SEQ ID NO: 16167 - protein, 21 aa, Neisseria
CSGKFERGMKMKHLRINREIA

SEQ ID NO: 16168 - protein, 8 aa, Neisseria
SHDRELVE

SEQ ID NO: 16169 - protein, 7 aa, Neisseria
SFSEGEQ

SEQ ID NO: 16170 - protein, 16 aa, Neisseria
VRIKNPLKIKQLQKGL

SEQ ID NO: 16171 - protein, 6 aa, Neisseria
LGEEGA

SEQ ID NO: 16172 - protein, 16 aa, Neisseria
SCDDKKKLAEFEKANA

SEQ ID NO: 16173 - protein, 6 aa, Neisseria
TQERWP

SEQ ID NO: 16174 - protein, 7 aa, Neisseria
ETREHSV

SEQ ID NO: 16175 - protein, 9 aa, Neisseria
TITRQLAAL

SEQ ID NO: 16176 - protein, 6 aa, Neisseria
EYTANL

SEQ ID NO: 16177 - protein, 7 aa, Neisseria
DIDGLYT

SEQ ID NO: 16178 - protein, 8 aa, Neisseria
VRLDKIEH

SEQ ID NO: 16179 - protein, 6 aa, Neisseria
GMLTKI

SEQ ID NO: 16180 - protein, 5 aa, Neisseria
LKPDA

SEQ ID NO: 16181 - protein, 7 aa, Neisseria
AEAADNQ

SEQ ID NO: 16182 - protein, 6 aa, Neisseria
AEHALS

SEQ ID NO: 16183 - protein, 6 aa, Neisseria
IAGIEG

SEQ ID NO: 16184 - protein, 9 aa, Neisseria
SRMDTVTVY

SEQ ID NO: 16185 - protein, 6 aa, Neisseria
KATKQP

SEQ ID NO: 16186 - protein, 9 aa, Neisseria
AAEDLLKLR

SEQ ID NO: 16187 - protein, 7 aa, Neisseria
MKYKRIV

SEQ ID NO: 16188 - protein, 17 aa, Neisseria
GTSSITHSDGSLSRGKI

SEQ ID NO: 16189 - protein, 15 aa, Neisseria
GFKKRPVKIADKQAS

SEQ ID NO: 16190 - protein, 6 aa, Neisseria
LSSDGI

SEQ ID NO: 16191 - protein, 14 aa, Neisseria
ADFADKRRYQNAGG

SEQ ID NO: 16192 - protein, 6 aa, Neisseria
LQRRAV

SEQ ID NO: 16193 - protein, 20 aa, Neisseria
INENDTVSVEELKIGDNDTL

SEQ ID NO: 16194 - protein, 19 aa, Neisseria
GNPNSNPDAVRLDKIEHIN

SEQ ID NO: 16195 - protein, 10 aa, Neisseria
GGSGSANGTG

SEQ ID NO: 16196 - protein, 5 aa, Neisseria
TKIKA

SEQ ID NO: 16197 - protein, 5 aa, Neisseria
TESGV

SEQ ID NO: 16198 - protein, 19 aa, Neisseria
CSSLKPDALAEAADNQADG

SEQ ID NO: 16199 - protein, 10 aa, Neisseria
RAKGLRTQKQ

SEQ ID NO: 16200 - protein, 26 aa, Neisseria
YSESRGGVYVDEGAEHALSEQGKSLL

SEQ ID NO: 16201 - protein, 8 aa, Neisseria
GHFSRMDT

SEQ ID NO: 16202 - protein, 13 aa, Neisseria
SKATKQPLGKGRV

SEQ ID NO: 16203 - protein, 12 aa, Neisseria
AAEDLLKLRKAK

SEQ ID NO: 16204 - protein, 8 aa, Neisseria
IHRDDWIS

SEQ ID NO: 16205 - protein, 7 aa, Neisseria
MKYKRIV

SEQ ID NO: 16206 - protein, 12 aa, Neisseria
THSDGSLSRGKI

SEQ ID NO: 16207 - protein, 15 aa, Neisseria
GFKKRPVKIADKQAS

SEQ ID NO: 16208 - protein, 11 aa, Neisseria
ADFADKRRYQN

SEQ ID NO: 16209 - protein, 6 aa, Neisseria
LQRRAV

SEQ ID NO: 16210 - protein, 19 aa, Neisseria
NENDTVSVEELKIGDNDTL

SEQ ID NO: 16211 - protein, 17 aa, Neisseria
PNSNPDAVRLDKIEHIN

SEQ ID NO: 16212 - protein, 5 aa, Neisseria
TKIKA

SEQ ID NO: 16213 - protein, 15 aa, Neisseria
LKPDALAEAADNQAD

SEQ ID NO: 16214 - protein, 9 aa, Neisseria
RAKGLRTQK

SEQ ID NO: 16215 - protein, 5 aa, Neisseria
SESRG

SEQ ID NO: 16216 - protein, 16 aa, Neisseria
VYVDEGAEHALSEQGK

SEQ ID NO: 16217 - protein, 7 aa, Neisseria
HFSRMDT

SEQ ID NO: 16218 - protein, 12 aa, Neisseria
KATKQPLGKGRV

SEQ ID NO: 16219 - protein, 12 aa, Neisseria
AAEDLLKLRKAK

SEQ ID NO: 16220 - protein, 5 aa, Neisseria
HRDDW

SEQ ID NO: 16221 - protein, 7 aa, Neisseria
IRQCIRQ

SEQ ID NO: 16222 - protein, 24 aa, Neisseria
QCHDGIKQLFKRFIIDGFKPIGRH

SEQ ID NO: 16223 - protein, 5 aa, Neisseria
CVKIA

SEQ ID NO: 16224 - protein, 5 aa, Neisseria
RHCQN

SEQ ID NO: 16225 - protein, 6 aa, Neisseria
QHFGQP

SEQ ID NO: 16226 - protein, 6 aa, Neisseria
ERCQFV

SEQ ID NO: 16227 - protein, 5 aa, Neisseria
NLVAT

SEQ ID NO: 16228 - protein, 5 aa, Neisseria
QFAQP

SEQ ID NO: 16229 - protein, 13 aa, Neisseria
FGCFGKFSGIHHF

SEQ ID NO: 16230 - protein, 12 aa, Neisseria
KATKPQTVQIVR

SEQ ID NO: 16231 - protein, 5 aa, Neisseria
METNA

SEQ ID NO: 16232 - protein, 13 aa, Neisseria
ADGLRLVDDRLPV

SEQ ID NO: 16233 - protein, 7 aa, Neisseria
VDIRQCI

SEQ ID NO: 16234 - protein, 5 aa, Neisseria
LQTDS

SEQ ID NO: 16235 - protein, 10 aa, Neisseria
QCHDGIKQLF

SEQ ID NO: 16236 - protein, 11 aa, Neisseria
DGFKPIGRHNI

SEQ ID NO: 16237 - protein, 18 aa, Neisseria
IRHRGGCFHRHCQNQPFD

SEQ ID NO: 16238 - protein, 8 aa, Neisseria
TFGGGKLR

SEQ ID NO: 16239 - protein, 8 aa, Neisseria
HFGQPVER

SEQ ID NO: 16240 - protein, 9 aa, Neisseria
PAQQRRHKT

SEQ ID NO: 16241 - protein, 11 aa, Neisseria
PPFGCFGKFSG

SEQ ID NO: 16242 - protein, 11 aa, Neisseria
NLNQDKATKPQ

SEQ ID NO: 16243 - protein, 9 aa, Neisseria
VRQGEATPY

SEQ ID NO: 16244 - protein, 9 aa, Neisseria
NPLYRRNAV

SEQ ID NO: 16245 - protein, 12 aa, Neisseria
DGLRLVDDRLPV

SEQ ID NO: 16246 - protein, 7 aa, Neisseria
VDIRQCI

SEQ ID NO: 16247 - protein, 7 aa, Neisseria
DGIKQLF

SEQ ID NO: 16248 - protein, 8 aa, Neisseria
AQQRRHKT

SEQ ID NO: 16249 - protein, 9 aa, Neisseria
NQDKATKPQ

SEQ ID NO: 16250 - protein, 6 aa, Neisseria
YRRNAV

SEQ ID NO: 16251 - protein, 7 aa, Neisseria
LSYILGF

SEQ ID NO: 16252 - protein, 5 aa, Neisseria
TKESL

SEQ ID NO: 16253 - protein, 6 aa, Neisseria
DFLTWG

SEQ ID NO: 16254 - protein, 18 aa, Neisseria
FSDYLAHPLDIFKVWEGG

SEQ ID NO: 16255 - protein, 7 aa, Neisseria
GFLGVVI

SEQ ID NO: 16256 - protein, 13 aa, Neisseria
FLKLMDTVAPLVP

SEQ ID NO: 16257 - protein, 6 aa, Neisseria
RIGNFI

SEQ ID NO: 16258 - protein, 10 aa, Neisseria
WGRVTDINAF

SEQ ID NO: 16259 - protein, 10 aa, Neisseria
PLWAEWLQQY

SEQ ID NO: 16260 - protein, 8 aa, Neisseria
LPRHPSQL

SEQ ID NO: 16261 - protein, 19 aa, Neisseria
YGIFRFIAEFARQPDDYLG

SEQ ID NO: 16262 - protein, 8 aa, Neisseria
LGRRRIAQ

SEQ ID NO: 16263 - protein, 8 aa, Neisseria
FTKESLDD

SEQ ID NO: 16264 - protein, 5 aa, Neisseria
WEGGM

SEQ ID NO: 16265 - protein, 6 aa, Neisseria
GRKHGI

SEQ ID NO: 16266 - protein, 5 aa, Neisseria
ASGRI

SEQ ID NO: 16267 - protein, 10 aa, Neisseria
PQARYEDLEA

SEQ ID NO: 16268 - protein, 7 aa, Neisseria
PRHPSQL

SEQ ID NO: 16269 - protein, 9 aa, Neisseria
FSKKQRPTG

SEQ ID NO: 16270 - protein, 9 aa, Neisseria
FARQPDDYL

SEQ ID NO: 16271 - protein, 7 aa, Neisseria
FGMKKQH

SEQ ID NO: 16272 - protein, 6 aa, Neisseria
GRRRIA

SEQ ID NO: 16273 - protein, 7 aa, Neisseria
FTKESLD

SEQ ID NO: 16274 - protein, 8 aa, Neisseria
ARYEDLEA

SEQ ID NO: 16275 - protein, 7 aa, Neisseria
KKQRPTG

SEQ ID NO: 16276 - protein, 8 aa, Neisseria
FARQPDDY

SEQ ID NO: 16277 - protein, 6 aa, Neisseria
GMKKQH

SEQ ID NO: 16278 - protein, 9 aa, Neisseria
PYIRRFSGS

SEQ ID NO: 16279 - protein, 7 aa, Neisseria
NAMLEKV

SEQ ID NO: 16280 - protein, 6 aa, Neisseria
EFVQGM

SEQ ID NO: 16281 - protein, 13 aa, Neisseria
VNKEIVSMINTYG

SEQ ID NO: 16282 - protein, 10 aa, Neisseria
IGQVGTVESI

SEQ ID NO: 16283 - protein, 7 aa, Neisseria
TGLVKGL

SEQ ID NO: 16284 - protein, 7 aa, Neisseria
GKLAEEL

SEQ ID NO: 16285 - protein, 19 aa, Neisseria
MTNIAGVMDKTGNLLTKLT

SEQ ID NO: 16286 - protein, 6 aa, Neisseria
RIDELI

SEQ ID NO: 16287 - protein, 15 aa, Neisseria
GMLPKIASAVEAAVN

SEQ ID NO: 16288 - protein, 10 aa, Neisseria
ALLLEIFTDA

SEQ ID NO: 16289 - protein, 6 aa, Neisseria
MESENI

SEQ ID NO: 16290 - protein, 8 aa, Neisseria
AADKARIL

SEQ ID NO: 16291 - protein, 7 aa, Neisseria
IRRFSGS

SEQ ID NO: 16292 - protein, 7 aa, Neisseria
YGGNAMT

SEQ ID NO: 16293 - protein, 8 aa, Neisseria
PALKEGFA

SEQ ID NO: 16294 - protein, 5 aa, Neisseria
GGGPQ

SEQ ID NO: 16295 - protein, 11 aa, Neisseria
MLEKVGKKGEF

SEQ ID NO: 16296 - protein, 9 aa, Neisseria
RVTDKEAMD

SEQ ID NO: 16297 - protein, 5 aa, Neisseria
VNKEI

SEQ ID NO: 16298 - protein, 27 aa, Neisseria
SGRDDHFIKAKKLLIDTPEQNGVDIGQ

SEQ ID NO: 16299 - protein, 7 aa, Neisseria
ESIDTGL

SEQ ID NO: 16300 - protein, 7 aa, Neisseria
LIERGCI

SEQ ID NO: 16301 - protein, 8 aa, Neisseria
GVGEKGEA

SEQ ID NO: 16302 - protein, 10 aa, Neisseria
KLAEELNAEK

SEQ ID NO: 16303 - protein, 22 aa, Neisseria
VMDKTGNLLTKLTPKRIDELIA

SEQ ID NO: 16304 - protein, 6 aa, Neisseria
AVNGVK

SEQ ID NO: 16305 - protein, 8 aa, Neisseria
IDGRVPNA

SEQ ID NO: 16306 - protein, 7 aa, Neisseria
LGGGEDA

SEQ ID NO: 16307 - protein, 5 aa, Neisseria
MESEN

SEQ ID NO: 16308 - protein, 8 aa, Neisseria
AADKARIL

SEQ ID NO: 16309 - protein, 8 aa, Neisseria
PALKEGFA

SEQ ID NO: 16310 - protein, 11 aa, Neisseria
MLEKVGKKGEF

SEQ ID NO: 16311 - protein, 9 aa, Neisseria
RVTDKEAMD

SEQ ID NO: 16312 - protein, 5 aa, Neisseria
VNKEI

SEQ ID NO: 16313 - protein, 24 aa, Neisseria
SGRDDHFIKAKKLLIDTPEQNGVD

SEQ ID NO: 16314 - protein, 7 aa, Neisseria
VGEKGEA

SEQ ID NO: 16315 - protein, 10 aa, Neisseria
KLAEELNAEK

SEQ ID NO: 16316 - protein, 6 aa, Neisseria
VMDKTG

SEQ ID NO: 16317 - protein, 11 aa, Neisseria
LTPKRIDELIA

SEQ ID NO: 16318 - protein, 5 aa, Neisseria
IDGRV

SEQ ID NO: 16319 - protein, 5 aa, Neisseria
GGEDA

SEQ ID NO: 16320 - protein, 5 aa, Neisseria
YLNRT

SEQ ID NO: 16321 - protein, 8 aa, Neisseria
IGRDYSFF

SEQ ID NO: 16322 - protein, 10 aa, Neisseria
SLDSVEKTAG

SEQ ID NO: 16323 - protein, 7 aa, Neisseria
NAARTAS

SEQ ID NO: 16324 - protein, 11 aa, Neisseria
SATPETVETAA

SEQ ID NO: 16325 - protein, 25 aa, Neisseria
RAAAAVQHANAADGVRIFNNLAATV

SEQ ID NO: 16326 - protein, 9 aa, Neisseria
LKAVSDGLD

SEQ ID NO: 16327 - protein, 6 aa, Neisseria
LRVIAQ

SEQ ID NO: 16328 - protein, 5 aa, Neisseria
SLFAG

SEQ ID NO: 16329 - protein, 10 aa, Neisseria
IGYLKGLFSY

SEQ ID NO: 16330 - protein, 6 aa, Neisseria
EHAEGS

SEQ ID NO: 16331 - protein, 5 aa, Neisseria
LGALG

SEQ ID NO: 16332 - protein, 6 aa, Neisseria
GTLVGL

SEQ ID NO: 16333 - protein, 7 aa, Neisseria
GGFTGAT

SEQ ID NO: 16334 - protein, 6 aa, Neisseria
RLVAGL

SEQ ID NO: 16335 - protein, 8 aa, Neisseria
NGWNGLAR

SEQ ID NO: 16336 - protein, 18 aa, Neisseria
SAGGKGAGYLNRTGQRVP

SEQ ID NO: 16337 - protein, 7 aa, Neisseria
KIGRDYS

SEQ ID NO: 16338 - protein, 8 aa, Neisseria
NIETDGGL

SEQ ID NO: 16339 - protein, 14 aa, Neisseria
DSVEKTAGSEGDTL

SEQ ID NO: 16340 - protein, 12 aa, Neisseria
YVRRGNAARTAS

SEQ ID NO: 16341 - protein, 11 aa, Neisseria
HAVEQGGSNLE

SEQ ID NO: 16342 - protein, 14 aa, Neisseria
LDASESSATPETVE

SEQ ID NO: 16343 - protein, 15 aa, Neisseria
AAADRTDMPGIRPYG

SEQ ID NO: 16344 - protein, 5 aa, Neisseria
NAADG

SEQ ID NO: 16345 - protein, 7 aa, Neisseria
YADSTAA

SEQ ID NO: 16346 - protein, 20 aa, Neisseria
DMQGRRLKAVSDGLDHNATG

SEQ ID NO: 16347 - protein, 22 aa, Neisseria
TQQDGGTWEQGGVEGKMRGSTQ

SEQ ID NO: 16348 - protein, 9 aa, Neisseria
AAKTGENTT

SEQ ID NO: 16349 - protein, 13 aa, Neisseria
TWSENSANAKTDS

SEQ ID NO: 16350 - protein, 7 aa, Neisseria
IRHDAGD

SEQ ID NO: 16351 - protein, 24 aa, Neisseria
SYGRYKNSISRSTGADEHAEGSVN

SEQ ID NO: 16352 - protein, 12 aa, Neisseria
ATGDLTVEGGLR

SEQ ID NO: 16353 - protein, 21 aa, Neisseria
DAFAEKGSALGWSGNSITEGT

SEQ ID NO: 16354 - protein, 9 aa, Neisseria
LSQPLSDKA

SEQ ID NO: 16355 - protein, 13 aa, Neisseria
GVERDLNGRDYTV

SEQ ID NO: 16356 - protein, 13 aa, Neisseria
ATGKTGARNMPHT

SEQ ID NO: 16357 - protein, 7 aa, Neisseria
VEFGNGW

SEQ ID NO: 16358 - protein, 17 aa, Neisseria
SYAGSKQYGNHSGRVGV

SEQ ID NO: 16359 - protein, 5 aa, Neisseria
AGGKG

SEQ ID NO: 16360 - protein, 5 aa, Neisseria
IETDG

SEQ ID NO: 16361 - protein, 13 aa, Neisseria
DSVEKTAGSEGDT

SEQ ID NO: 16362 - protein, 11 aa, Neisseria
VRRGNAARTAS

SEQ ID NO: 16363 - protein, 10 aa, Neisseria
HAVEQGGSNL

SEQ ID NO: 16364 - protein, 14 aa, Neisseria
LDASESSATPETVE

SEQ ID NO: 16365 - protein, 10 aa, Neisseria
AAADRTDMPG

SEQ ID NO: 16366 - protein, 5 aa, Neisseria
NAADG

SEQ ID NO: 16367 - protein, 19 aa, Neisseria
DMQGRRLKAVSDGLDHNAT

SEQ ID NO: 16368 - protein, 11 aa, Neisseria
GGVEGKMRGST

SEQ ID NO: 16369 - protein, 7 aa, Neisseria
KTGENTT

SEQ ID NO: 16370 - protein, 9 aa, Neisseria
NSANAKTDS

SEQ ID NO: 16371 - protein, 7 aa, Neisseria
IRHDAGD

SEQ ID NO: 16372 - protein, 20 aa, Neisseria
RYKNSISRSTGADEHAEGSV

SEQ ID NO: 16373 - protein, 8 aa, Neisseria
DAFAEKGS

SEQ ID NO: 16374 - protein, 7 aa, Neisseria
QPLSDKA

SEQ ID NO: 16375 - protein, 12 aa, Neisseria
GVERDLNGRDYT

SEQ ID NO: 16376 - protein, 11 aa, Neisseria
ATGKTGARNMP

SEQ ID NO: 16377 - protein, 11 aa, Neisseria
QSSTMRPIGEI

SEQ ID NO: 16378 - protein, 5 aa, Neisseria
IEPYG

SEQ ID NO: 16379 - protein, 8 aa, Neisseria
PAEAFKLP

SEQ ID NO: 16380 - protein, 7 aa, Neisseria
ADALRHI

SEQ ID NO: 16381 - protein, 6 aa, Neisseria
FHAIGA

SEQ ID NO: 16382 - protein, 9 aa, Neisseria
NLLAAMLDN

SEQ ID NO: 16383 - protein, 19 aa, Neisseria
QLRNIIDGMGKPVDGVMRP

SEQ ID NO: 16384 - protein, 10 aa, Neisseria
DISDLKERLG

SEQ ID NO: 16385 - protein, 13 aa, Neisseria
MAALLKDAIKPNL

SEQ ID NO: 16386 - protein, 7 aa, Neisseria
QTIEGTP

SEQ ID NO: 16387 - protein, 25 aa, Neisseria
PFANIAHGCNSVTATRLAKHLADYA

SEQ ID NO: 16388 - protein, 5 aa, Neisseria
ATVRA

SEQ ID NO: 16389 - protein, 23 aa, Neisseria
LDALEKGLPNLLKHISNLKNVFG

SEQ ID NO: 16390 - protein, 8 aa, Neisseria
SLTEVWGK

SEQ ID NO: 16391 - protein, 13 aa, Neisseria
DLARKVVNAIESQ

SEQ ID NO: 16392 - protein, 6 aa, Neisseria
IASLEK

SEQ ID NO: 16393 - protein, 19 aa, Neisseria
VALCGNMMKMPGLPKVPAA

SEQ ID NO: 16394 - protein, 17 aa, Neisseria
FKTDAEIAQSSTMRPIG

SEQ ID NO: 16395 - protein, 10 aa, Neisseria
LNVDNIEPYG

SEQ ID NO: 16396 - protein, 19 aa, Neisseria
YKAKINPAEAFKLPQKQGR

SEQ ID NO: 16397 - protein, 11 aa, Neisseria
NPTPAGEGKTT

SEQ ID NO: 16398 - protein, 21 aa, Neisseria
DALRHIGKDSVIALREPSLGP

SEQ ID NO: 16399 - protein, 9 aa, Neisseria
VKGGAAGGG

SEQ ID NO: 16400 - protein, 14 aa, Neisseria
QGNELNIDPKRVLW

SEQ ID NO: 16401 - protein, 32 aa, Neisseria; identical to SEQ ID NO: 2294

SEQ ID NO: 16402 - protein, 11 aa, Neisseria
KDISDLKERLG

SEQ ID NO: 16403 - protein, 9 aa, Neisseria
YAKDGSPVY

SEQ ID NO: 16404 - protein, 7 aa, Neisseria
KDLKANG

SEQ ID NO: 16405 - protein, 7 aa, Neisseria
DAIKPNL

SEQ ID NO: 16406 - protein, 7 aa, Neisseria
RLAKHLA

SEQ ID NO: 16407 - protein, 20 aa, Neisseria
LGAEKFCDIKCRLAGLKPDA

SEQ ID NO: 16408 - protein, 27 aa, Neisseria
LKYNGGVERANLGEENLDALEKGLPNL

SEQ ID NO: 16409 - protein, 17 aa, Neisseria
FVSDSDAELAMIEKACA

SEQ ID NO: 16410 - protein, 17 aa, Neisseria
WGKGGAGGADLARKVVN

SEQ ID NO: 16411 - protein, 9 aa, Neisseria
IESQTNNFG

SEQ ID NO: 16412 - protein, 11 aa, Neisseria
LGIKDKIRAIA

SEQ ID NO: 16413 - protein, 10 aa, Neisseria
YGAEDVDFSA

SEQ ID NO: 16414 - protein, 12 aa, Neisseria
ASLEKLGLDKMP

SEQ ID NO: 16415 - protein, 8 aa, Neisseria
SLSDNAKL

SEQ ID NO: 16416 - protein, 8 aa, Neisseria
GCPEDFRI

SEQ ID NO: 16417 - protein, 5 aa, Neisseria
MPGLP

SEQ ID NO: 16418 - protein, 12 aa, Neisseria
PAAEKIDVDAEG

SEQ ID NO: 16419 - protein, 9 aa, Neisseria
FKTDAEIAQ

SEQ ID NO: 16420 - protein, 7 aa, Neisseria
YKAKINP

SEQ ID NO: 16421 - protein, 11 aa, Neisseria
EAFKLPQKQGR

SEQ ID NO: 16422 - protein, 7 aa, Neisseria
PAGEGKT

SEQ ID NO: 16423 - protein, 18 aa, Neisseria
DALRHIGKDSVIALREPS

SEQ ID NO: 16424 - protein, 10 aa, Neisseria
LNIDPKRVLW

SEQ ID NO: 16425 - protein, 14 aa, Neisseria
RVVDMNDRQLRNII

SEQ ID NO: 16426 - protein, 15 aa, Neisseria
GMGKPVDGVMRPDGF

SEQ ID NO: 16427 - protein, 11 aa, Neisseria
KDISDLKERLG

SEQ ID NO: 16428 - protein, 5 aa, Neisseria
AKDGS

SEQ ID NO: 16429 - protein, 5 aa, Neisseria
KDLKA

SEQ ID NO: 16430 - protein, 7 aa, Neisseria
RLAKHLA

SEQ ID NO: 16431 - protein, 20 aa, Neisseria
LGAEKFCDIKCRLAGLKPDA

SEQ ID NO: 16432 - protein, 20 aa, Neisseria
GGVERANLGEENLDALEKGL

SEQ ID NO: 16433 - protein, 17 aa, Neisseria
FVSDSDAELAMIEKACA

SEQ ID NO: 16434 - protein, 8 aa, Neisseria
DLARKVVN

SEQ ID NO: 16435 - protein, 11 aa, Neisseria
LGIKDKIRAIA

SEQ ID NO: 16436 - protein, 10 aa, Neisseria
YGAEDVDFSA

SEQ ID NO: 16437 - protein, 12 aa, Neisseria
ASLEKLGLDKMP

SEQ ID NO: 16438 - protein, 8 aa, Neisseria
GCPEDFRI

SEQ ID NO: 16439 - protein, 12 aa, Neisseria
PAAEKIDVDAEG

SEQ ID NO: 16440 - protein, 11 aa, Neisseria
RFAAMPDVVGK

SEQ ID NO: 16441 - protein, 7 aa, Neisseria
GQPGKMF

SEQ ID NO: 16442 - protein, 6 aa, Neisseria
AVTPCR

SEQ ID NO: 16443 - protein, 7 aa, Neisseria
VCRDDMN

SEQ ID NO: 16444 - protein, 22 aa, Neisseria
GCHRITERSLKSFLQIRHFSPL

SEQ ID NO: 16445 - protein, 16 aa, Neisseria
LRVQRILDFGKFCQQV

SEQ ID NO: 16446 - protein, 16 aa, Neisseria
LDSVVTLVHFFADFLI

SEQ ID NO: 16447 - protein, 11 aa, Neisseria
ADNQTRFFKAG

SEQ ID NO: 16448 - protein, 10 aa, Neisseria
NARLIRQILK

SEQ ID NO: 16449 - protein, 5 aa, Neisseria
PDVVG

SEQ ID NO: 16450 - protein, 12 aa, Neisseria
LFGRQAGQPGKM

SEQ ID NO: 16451 - protein, 42 aa, Neisseria
QRIDAEAAVFRQDRNDSRTPVDAQHHGRRLVRNRRNRRHCNA

SEQ ID NO: 16452 - protein, 27 aa, Neisseria
TPCRTVCRDDMNACRTGCHRITERSLK

SEQ ID NO: 16453 - protein, 5 aa, Neisseria
AAHKA

SEQ ID NO: 16454 - protein, 19 aa, Neisseria
PMCSSSDSKSRRSDISARY

SEQ ID NO: 16455 - protein, 7 aa, Neisseria
LDFGKFC

SEQ ID NO: 16456 - protein, 7 aa, Neisseria
QLQKNTS

SEQ ID NO: 16457 - protein, 23 aa, Neisseria
FQADNQTRFFKAGQDTGQAGAQN

SEQ ID NO: 16458 - protein, 16 aa, Neisseria
LKVQRAVFRQKTDNPP

SEQ ID NO: 16459 - protein, 11 aa, Neisseria
IQNRPELGHQG

SEQ ID NO: 16460 - protein, 9 aa, Neisseria
QTDIDRRMF

SEQ ID NO: 16461 - protein, 5 aa, Neisseria
QAGQP

SEQ ID NO: 16462 - protein, 40 aa, Neisseria
QRIDAEAAVFRQDRNDSRTPVDAQHHGRRLVRNRRNRRHC

SEQ ID NO: 16463 - protein, 11 aa, Neisseria
TVCRDDMNACR

SEQ ID NO: 16464 - protein, 8 aa, Neisseria
RITERSLK

SEQ ID NO: 16465 - protein, 5 aa, Neisseria
AAHKA

SEQ ID NO: 16466 - protein, 14 aa, Neisseria
SSSDSKSRRSDISA

SEQ ID NO: 16467 - protein, 18 aa, Neisseria
FQADNQTRFFKAGQDTGQ

SEQ ID NO: 16468 - protein, 14 aa, Neisseria
LKVQRAVFRQKTDN

SEQ ID NO: 16469 - protein, 8 aa, Neisseria
IQNRPELG

SEQ ID NO: 16470 - protein, 7 aa, Neisseria
DIDRRMF

SEQ ID NO: 16471 - protein, 8 aa, Neisseria
LGGIVQEF

SEQ ID NO: 16472 - protein, 7 aa, Neisseria
VLADGVR

SEQ ID NO: 16473 - protein, 11 aa, Neisseria
INKQIGRVAGR

SEQ ID NO: 16474 - protein, 5 aa, Neisseria
VGRRL

SEQ ID NO: 16475 - protein, 7 aa, Neisseria
YRYLSRH

SEQ ID NO: 16476 - protein, 12 aa, Neisseria
GPARCGSAYSAG

SEQ ID NO: 16477 - protein, 18 aa, Neisseria
SGRCRKTARLNGFRRPRS

SEQ ID NO: 16478 - protein, 17 aa, Neisseria
MSDTPATRDFGLIDGRA

SEQ ID NO: 16479 - protein, 8 aa, Neisseria
LSNRRGTR

SEQ ID NO: 16480 - protein, 5 aa, Neisseria
DGVRE

SEQ ID NO: 16481 - protein, 15 aa, Neisseria
FDDAASYADNPFQIN

SEQ ID NO: 16482 - protein, 9 aa, Neisseria
VAGRIRGAA

SEQ ID NO: 16483 - protein, 23 aa, Neisseria
DINGRTYRVEANEGRNALHGGSH

SEQ ID NO: 16484 - protein, 9 aa, Neisseria
AADGRSVVL

SEQ ID NO: 16485 - protein, 11 aa, Neisseria
TVGRRLSQRFG

SEQ ID NO: 16486 - protein, 9 aa, Neisseria
PLGRGRPAY

SEQ ID NO: 16487 - protein, 18 aa, Neisseria
YLSRHRARRHGVRPDAAH

SEQ ID NO: 16488 - protein, 10 aa, Neisseria
AGRGPARCGS

SEQ ID NO: 16489 - protein, 25 aa, Neisseria
SAGRTYSGRCRKTARLNGFRRPRSI

SEQ ID NO: 16490 - protein, 9 aa, Neisseria
MSDTPATRD

SEQ ID NO: 16491 - protein, 7 aa, Neisseria
SNRRGTR

SEQ ID NO: 16492 - protein, 5 aa, Neisseria
DGVRE

SEQ ID NO: 16493 - protein, 6 aa, Neisseria
FDDAAS

SEQ ID NO: 16494 - protein, 9 aa, Neisseria
VAGRIRGAA

SEQ ID NO: 16495 - protein, 17 aa, Neisseria
INGRTYRVEANEGRNAL

SEQ ID NO: 16496 - protein, 9 aa, Neisseria
AADGRSVVL

SEQ ID NO: 16497 - protein, 8 aa, Neisseria
TVGRRLSQ

SEQ ID NO: 16498 - protein, 6 aa, Neisseria
GRGRPA

SEQ ID NO: 16499 - protein, 14 aa, Neisseria
SRHRARRHGVRPDA

SEQ ID NO: 16500 - protein, 7 aa, Neisseria
GRGPARC

SEQ ID NO: 16501 - protein, 12 aa, Neisseria
RTYSGRCRKTAR

SEQ ID NO: 16502 - protein, 9 aa, Neisseria
NGFRRPRSI

SEQ ID NO: 16503 - protein, 11 aa, Neisseria
EQYGLFDFMPC

SEQ ID NO: 16504 - protein, 8 aa, Neisseria
PLDNFPTV

SEQ ID NO: 16505 - protein, 11 aa, Neisseria
GFGQRISNLSR

SEQ ID NO: 16506 - protein, 5 aa, Neisseria
LRACA

SEQ ID NO: 16507 - protein, 7 aa, Neisseria
HVRVFQK

SEQ ID NO: 16508 - protein, 5 aa, Neisseria
TRRVR

SEQ ID NO: 16509 - protein, 8 aa, Neisseria
RHQRGFAR

SEQ ID NO: 16510 - protein, 15 aa, Neisseria
LRPRQVIIDHDKIEQ

SEQ ID NO: 16511 - protein, 9 aa, Neisseria
CLRQPPLDN

SEQ ID NO: 16512 - protein, 33 aa, Neisseria
VRPASVETRSKHIERRRQDKDADGFGQRISNLS

SEQ ID NO: 16513 - protein, 9 aa, Neisseria
TCRRQRIHT

SEQ ID NO: 16514 - protein, 9 aa, Neisseria
SLLRDKRLK

SEQ ID NO: 16515 - protein, 12 aa, Neisseria
RRTRRVRHGNAQ

SEQ ID NO: 16516 - protein, 10 aa, Neisseria
QQPRHQRGFA

SEQ ID NO: 16517 - protein, 14 aa, Neisseria
AGSGRNDKDVAFSI

SEQ ID NO: 16518 - protein, 6 aa, Neisseria
QRTPGF

SEQ ID NO: 16519 - protein, 15 aa, Neisseria
LRPRQVIIDHDKIEQ

SEQ ID NO: 16520 - protein, 23 aa, Neisseria
ASVETRSKHIERRRQDKDADGFG

SEQ ID NO: 16521 - protein, 9 aa, Neisseria
TCRRQRIHT

SEQ ID NO: 16522 - protein, 9 aa, Neisseria
SLLRDKRLK

SEQ ID NO: 16523 - protein, 10 aa, Neisseria
RRTRRVRHGN

SEQ ID NO: 16524 - protein, 9 aa, Neisseria
QPRHQRGFA

SEQ ID NO: 16525 - protein, 10 aa, Neisseria
GSGRNDKDVA

SEQ ID NO: 16526 - protein, 11 aa, Neisseria
ADKIRKIENWP

SEQ ID NO: 16527 - protein, 12 aa, Neisseria
QSAEYFRLLVDL

SEQ ID NO: 16528 - protein, 13 aa, Neisseria
AGLELIRKLGGEI

SEQ ID NO: 16529 - protein, 17 aa, Neisseria
AAAILEFTDLQGGKNIR

SEQ ID NO: 16530 - protein, 5 aa, Neisseria
KTSNL

SEQ ID NO: 16531 - protein, 15 aa, Neisseria
LADKIRKIENWPQKG

SEQ ID NO: 16532 - protein, 7 aa, Neisseria
MDQKIDI

SEQ ID NO: 16533 - protein, 5 aa, Neisseria
LDARG

SEQ ID NO: 16534 - protein, 9 aa, Neisseria
PIRKKGKLP

SEQ ID NO: 16535 - protein, 6 aa, Neisseria
YGEAAV

SEQ ID NO: 16536 - protein, 10 aa, Neisseria
IHTDAVKLGS

SEQ ID NO: 16537 - protein, 12 aa, Neisseria
ELIRKLGGEIVE

SEQ ID NO: 16538 - protein, 15 aa, Neisseria
TDLQGGKNIRASGAP

SEQ ID NO: 16539 - protein, 8 aa, Neisseria
QNEGCMKG

SEQ ID NO: 16540 - protein, 12 aa, Neisseria
LADKIRKIENWP

SEQ ID NO: 16541 - protein, 7 aa, Neisseria
MDQKIDI

SEQ ID NO: 16542 - protein, 9 aa, Neisseria
PIRKKGKLP

SEQ ID NO: 16543 - protein, 6 aa, Neisseria
YGEAAV

SEQ ID NO: 16544 - protein, 10 aa, Neisseria
IHTDAVKLGS

SEQ ID NO: 16545 - protein, 12 aa, Neisseria
ELIRKLGGEIVE

SEQ ID NO: 16546 - protein, 7 aa, Neisseria
KNIRASG

SEQ ID NO: 16547 - protein, 5 aa, Neisseria
GCMKG

SEQ ID NO: 16548 - protein, 12 aa, Neisseria
NLGDALDGVPGI

SEQ ID NO: 16549 - protein, 17 aa, Neisseria
TGRRIKVLNHHGETGDM

SEQ ID NO: 16550 - protein, 10 aa, Neisseria
QVEILRGPVT

SEQ ID NO: 16551 - protein, 6 aa, Neisseria
VAGLVD

SEQ ID NO: 16552 - protein, 9 aa, Neisseria
PEKMPENGV

SEQ ID NO: 16553 - protein, 5 aa, Neisseria
NLEKL

SEQ ID NO: 16554 - protein, 11 aa, Neisseria
YRNLKRLPDSH

SEQ ID NO: 16555 - protein, 5 aa, Neisseria
FPGFE

SEQ ID NO: 16556 - protein, 11 aa, Neisseria
AGDAVENFFNN

SEQ ID NO: 16557 - protein, 6 aa, Neisseria
PIGRLK

SEQ ID NO: 16558 - protein, 5 aa, Neisseria
ATSEA

SEQ ID NO: 16559 - protein, 9 aa, Neisseria
RFGNYIYAQ

SEQ ID NO: 16560 - protein, 11 aa, Neisseria
NDGRGPKSIED

SEQ ID NO: 16561 - protein, 9 aa, Neisseria
RGRLKNLPS

SEQ ID NO: 16562 - protein, 9 aa, Neisseria
QAHGTEQSV

SEQ ID NO: 16563 - protein, 10 aa, Neisseria
GKSRPRATSG

SEQ ID NO: 16564 - protein, 16 aa, Neisseria
TASDKIISGDTLRQKA

SEQ ID NO: 16565 - protein, 11 aa, Neisseria
IRGQTGRRIKV

SEQ ID NO: 16566 - protein, 16 aa, Neisseria
NHHGETGDMADFSPDH

SEQ ID NO: 16567 - protein, 6 aa, Neisseria
EILRGP

SEQ ID NO: 16568 - protein, 22 aa, Neisseria
DVADGKIPEKMPENGVSGELGL

SEQ ID NO: 16569 - protein, 13 aa, Neisseria
LSSGNLEKLTSGG

SEQ ID NO: 16570 - protein, 30 aa, Neisseria; identical to SEQ ID NO: 2474

SEQ ID NO: 16571 - protein, 5 aa, Neisseria
GEKGF

SEQ ID NO: 16572 - protein, 10 aa, Neisseria
AYSDRRDQYG

SEQ ID NO: 16573 - protein, 12 aa, Neisseria
PAHSHEYDDCHA

SEQ ID NO: 16574 - protein, 8 aa, Neisseria
SLINKRYL

SEQ ID NO: 16575 - protein, 13 aa, Neisseria
LTEEDIDYDNPGL

SEQ ID NO: 16576 - protein, 9 aa, Neisseria
GFHDDDDAH

SEQ ID NO: 16577 - protein, 27 aa, Neisseria
AHNGKPWIDLRNKRYELRAEWKQPFPG

SEQ ID NO: 16578 - protein, 17 aa, Neisseria
HLNRNDYRHDEKAGDAV

SEQ ID NO: 16579 - protein, 24 aa, Neisseria
FNNQTQNARIELRHQPIGRLKGSW

SEQ ID NO: 16580 - protein, 8 aa, Neisseria
LGQKSSAL

SEQ ID NO: 16581 - protein, 7 aa, Neisseria
ATSEAVK

SEQ ID NO: 16582 - protein, 5 aa, Neisseria
LDNKV

SEQ ID NO: 16583 - protein, 40 aa, Neisseria
ANWDNFTLEGGVRVEKQKASIRYDKALIDRENYYNHPLPD

SEQ ID NO: 16584 - protein, 7 aa, Neisseria
GAHRQTA

SEQ ID NO: 16585 - protein, 16 aa, Neisseria
SHQERLPSTQELYAHG

SEQ ID NO: 16586 - protein, 14 aa, Neisseria
VGNKHLNKERSNNI

SEQ ID NO: 16587 - protein, 7 aa, Neisseria
YEGDRWQ

SEQ ID NO: 16588 - protein, 7 aa, Neisseria
YRNRFGN

SEQ ID NO: 16589 - protein, 19 aa, Neisseria
TLNDGRGPKSIEDDSEMKL

SEQ ID NO: 16590 - protein, 14 aa, Neisseria
RYNQSGADFYGAEG

SEQ ID NO: 16591 - protein, 11 aa, Neisseria
IYFKPTPRYRI

SEQ ID NO: 16592 - protein, 26 aa, Neisseria
VSGDYVRGRLKNLPSLPGREDAYGNR

SEQ ID NO: 16593 - protein, 11 aa, Neisseria
QADQNAPRVPA

SEQ ID NO: 16594 - protein, 8 aa, Neisseria
SLTDRIDA

SEQ ID NO: 16595 - protein, 13 aa, Neisseria
NKLARYETRTPGH

SEQ ID NO: 16596 - protein, 13 aa, Neisseria
GANYRRNTRYGEW

SEQ ID NO: 16597 - protein, 5 aa, Neisseria
ADNLL

SEQ ID NO: 16598 - protein, 16 aa, Neisseria
FLSDTPQMGRSFTGGV

SEQ ID NO: 16599 - protein, 5 aa, Neisseria
HGTEQ

SEQ ID NO: 16600 - protein, 8 aa, Neisseria
GKSRPRAT

SEQ ID NO: 16601 - protein, 8 aa, Neisseria
TASDKIIS

SEQ ID NO: 16602 - protein, 7 aa, Neisseria
DTLRQKA

SEQ ID NO: 16603 - protein, 8 aa, Neisseria
QTGRRIKV

SEQ ID NO: 16604 - protein, 11 aa, Neisseria
GETGDMADFSP

SEQ ID NO: 16605 - protein, 17 aa, Neisseria
DVADGKIPEKMPENGVS

SEQ ID NO: 16606 - protein, 9 aa, Neisseria
SSGNLEKLT

SEQ ID NO: 16607 - protein, 8 aa, Neisseria
GLYRKSGD

SEQ ID NO: 16608 - protein, 17 aa, Neisseria
RYRNLKRLPDSHADSQT

SEQ ID NO: 16609 - protein, 8 aa, Neisseria
YSDRRDQY

SEQ ID NO: 16610 - protein, 8 aa, Neisseria
HEYDDCHA

SEQ ID NO: 16611 - protein, 10 aa, Neisseria
LTEEDIDYDN

SEQ ID NO: 16612 - protein, 8 aa, Neisseria
FHDDDDAH

SEQ ID NO: 16613 - protein, 12 aa, Neisseria
LRNKRYELRAEW

SEQ ID NO: 16614 - protein, 17 aa, Neisseria
HLNRNDYRHDEKAGDAV

SEQ ID NO: 16615 - protein, 10 aa, Neisseria
TQNARIELRH

SEQ ID NO: 16616 - protein, 5 aa, Neisseria
GRLKG

SEQ ID NO: 16617 - protein, 7 aa, Neisseria
ATSEAVK

SEQ ID NO: 16618 - protein, 24 aa, Neisseria
GGVRVEKQKASIRYDKALIDRENY

SEQ ID NO: 16619 - protein, 7 aa, Neisseria
GAHRQTA

SEQ ID NO: 16620 - protein, 8 aa, Neisseria
SHQERLPS

SEQ ID NO: 16621 - protein, 9 aa, Neisseria
HLNKERSNN

SEQ ID NO: 16622 - protein, 6 aa, Neisseria
YEGDRW

SEQ ID NO: 16623 - protein, 18 aa, Neisseria
LNDGRGPKSIEDDSEMKL

SEQ ID NO: 16624 - protein, 5 aa, Neisseria
YGAEG

SEQ ID NO: 16625 - protein, 7 aa, Neisseria
PTPRYRI

SEQ ID NO: 16626 - protein, 9 aa, Neisseria
DYVRGRLKN

SEQ ID NO: 16627 - protein, 8 aa, Neisseria
PGREDAYG

SEQ ID NO: 16628 - protein, 10 aa, Neisseria
ADQNAPRVPA

SEQ ID NO: 16629 - protein, 8 aa, Neisseria
SLTDRIDA

SEQ ID NO: 16630 - protein, 11 aa, Neisseria
KLARYETRTPG

SEQ ID NO: 16631 - protein, 9 aa, Neisseria
NYRRNTRYG

SEQ ID NO: 16632 - protein, 599 aa, Neisseria
MQNTNPPLPPMPPEITQLLSGLDAAQWAWLSGYAWAKAGNGASAGLPALQTALPTAEPFSVTVLSASQTGNAKSVADKAADSLEAAGIQVSRAELKDYKAKNIAGERRLLLVTSTQGEGEPPEEAVVLHKLLNGKKAPKLDKLQFAVLGLGDSSYPNFCRAGKDFDKRFEELGAKRLLERVDADLDFAAAADGWTDNIAALLKEEAAKNRATPAPQTTPPAGLQTAPDGRYCKADPFPAALLANQKITARQSDKDVRHIEIDLSGSDLHYLPGDALGVWFDNDPALVREILDLLGIDQATEIQAGGKTLPVASALLSHFELTQNTPAFVKGYAPFADDDELDRIAADNAVLQGFVQSTPIADVLHRFPAKLTAEQFAGLLRPLAPRLYSISSSQAEVGDEVHLTVGAVRFEHEGRARAGGASGFLADRLEEDGTVRVFVERNDGFRLPEDSRKPIVMIGSGTGVAPFRAFVQQRAAENAEGKNWLFFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 16633 - protein, 6 aa, Neisseria
NIAIIA

SEQ ID NO: 16634 - protein, 5 aa, Neisseria
DQLLR

SEQ ID NO: 16635 - protein, 6 aa, Neisseria
VDTPGH

SEQ ID NO: 16636 - protein, 14 aa, Neisseria
GGEVERVLGMVDCV

SEQ ID NO: 16637 - protein, 5 aa, Neisseria
KIDKP

SEQ ID NO: 16638 - protein, 10 aa, Neisseria
FELFDNLGAT

SEQ ID NO: 16639 - protein, 16 aa, Neisseria
SGLSGFAKLEETDESN

SEQ ID NO: 16640 - protein, 10 aa, Neisseria
PLFDTILKYT

SEQ ID NO: 16641 - protein, 15 aa, Neisseria
GRINQLLGFKGLERV

SEQ ID NO: 16642 - protein, 7 aa, Neisseria
VIISGIE

SEQ ID NO: 16643 - protein, 9 aa, Neisseria
IRDRLQKEL

SEQ ID NO: 16644 - protein, 5 aa, Neisseria
DTADA

SEQ ID NO: 16645 - protein, 10 aa, Neisseria
CEPYENLTVD

SEQ ID NO: 16646 - protein, 6 aa, Neisseria
LTRGVG

SEQ ID NO: 16647 - protein, 6 aa, Neisseria
MSHVFD

SEQ ID NO: 16648 - protein, 8 aa, Neisseria
KGKKLTNI

SEQ ID NO: 16649 - protein, 7 aa, Neisseria
EAVRLTT

SEQ ID NO: 16650 - protein, 5 aa, Neisseria
MKQIR

SEQ ID NO: 16651 - protein, 8 aa, Neisseria
VDHGKTTL

SEQ ID NO: 16652 - protein, 30 aa, Neisseria; identical to SEQ ID NO: 2616

SEQ ID NO: 16653 - protein, 9 aa, Neisseria
NTAIDYEGY

SEQ ID NO: 16654 - protein, 15 aa, Neisseria
VDTPGHADFGGEVER

SEQ ID NO: 16655 - protein, 14 aa, Neisseria
DAQEGPMPQTRFVT

SEQ ID NO: 16656 - protein, 11 aa, Neisseria
KIDKPSARPSW

SEQ ID NO: 16657 - protein, 8 aa, Neisseria
GATDEQLD

SEQ ID NO: 16658 - protein, 15 aa, Neisseria
AKLEETDESNDMRPL

SEQ ID NO: 16659 - protein, 12 aa, Neisseria
TPAPSGSADETL

SEQ ID NO: 16660 - protein, 8 aa, Neisseria
LDYDNYTG

SEQ ID NO: 16661 - protein, 9 aa, Neisseria
LNGRIKPGQ

SEQ ID NO: 16662 - protein, 7 aa, Neisseria
NHDQQIA

SEQ ID NO: 16663 - protein, 15 aa, Neisseria
KGLERVPLEEAEAGD

SEQ ID NO: 16664 - protein, 6 aa, Neisseria
GIEDIG

SEQ ID NO: 16665 - protein, 11 aa, Neisseria
ITDKDNPKGLP

SEQ ID NO: 16666 - protein, 7 aa, Neisseria
SVDEPTL

SEQ ID NO: 16667 - protein, 26 aa, Neisseria
TSPLAGTEGKFVTSRQIRDRLQKELL

SEQ ID NO: 16668 - protein, 20 aa, Neisseria
LRVEDTADADVFRVSGRGEL

SEQ ID NO: 16669 - protein, 7 aa, Neisseria
NMRREGY

SEQ ID NO: 16670 - protein, 60 aa, Neisseria; identical to SEQ ID NO: 2634

SEQ ID NO: 16671 - protein, 18 aa, Neisseria
VFDDYAPVKPDMPGRHNG

SEQ ID NO: 16672 - protein, 5 aa, Neisseria
QEQGE

SEQ ID NO: 16673 - protein, 17 aa, Neisseria
NLEDRGRMFVSPNDKIY

SEQ ID NO: 16674 - protein, 8 aa, Neisseria
IHSRDNDL

SEQ ID NO: 16675 - protein, 20 aa, Neisseria
PLKGKKLTNIRASGTDEAVR

SEQ ID NO: 16676 - protein, 9 aa, Neisseria
FIDDDELVE

SEQ ID NO: 16677 - protein, 25 aa, Neisseria
TPQSIRLRKRYLSELERRRHFKKLD

SEQ ID NO: 16678 - protein, 5 aa, Neisseria
MKQIR

SEQ ID NO: 16679 - protein, 5 aa, Neisseria
GTFRA

SEQ ID NO: 16680 - protein, 19 aa, Neisseria
QQVDERVMDSNDLEKERGI

SEQ ID NO: 16681 - protein, 7 aa, Neisseria
FGGEVER

SEQ ID NO: 16682 - protein, 8 aa, Neisseria
DAQEGPMP

SEQ ID NO: 16683 - protein, 7 aa, Neisseria
KIDKPSA

SEQ ID NO: 16684 - protein, 8 aa, Neisseria
GATDEQLD

SEQ ID NO: 16685 - protein, 15 aa, Neisseria
AKLEETDESNDMRPL

SEQ ID NO: 16686 - protein, 7 aa, Neisseria
GSADETL

SEQ ID NO: 16687 - protein, 7 aa, Neisseria
LNGRIKP

SEQ ID NO: 16688 - protein, 6 aa, Neisseria
HDQQIA

SEQ ID NO: 16689 - protein, 14 aa, Neisseria
GLERVPLEEAEAGD

SEQ ID NO: 16690 - protein, 6 aa, Neisseria
GIEDIG

SEQ ID NO: 16691 - protein, 9 aa, Neisseria
ITDKDNPKG

SEQ ID NO: 16692 - protein, 7 aa, Neisseria
SVDEPTL

SEQ ID NO: 16693 - protein, 9 aa, Neisseria
AGTEGKFVT

SEQ ID NO: 16694 - protein, 12 aa, Neisseria
RQIRDRLQKELL

SEQ ID NO: 16695 - protein, 20 aa, Neisseria
LRVEDTADADVFRVSGRGEL

SEQ ID NO: 16696 - protein, 7 aa, Neisseria
NMRREGY

SEQ ID NO: 16697 - protein, 20 aa, Neisseria
VGKPRVVYRDIDGQKCEPYE

SEQ ID NO: 16698 - protein, 34 aa, Neisseria; identical to SEQ ID NO: 2662

SEQ ID NO: 16699 - protein, 11 aa, Neisseria
APVKPDMPGRH

SEQ ID NO: 16700 - protein, 5 aa, Neisseria
QEQGE

SEQ ID NO: 16701 - protein, 7 aa, Neisseria
LEDRGRM

SEQ ID NO: 16702 - protein, 6 aa, Neisseria
PNDKIY

SEQ ID NO: 16703 - protein, 7 aa, Neisseria
HSRDNDL

SEQ ID NO: 16704 - protein, 8 aa, Neisseria
LKGKKLTN

SEQ ID NO: 16705 - protein, 10 aa, Neisseria
RASGTDEAVR

SEQ ID NO: 16706 - protein, 9 aa, Neisseria
FIDDDELVE

SEQ ID NO: 16707 - protein, 21 aa, Neisseria
IRLRKRYLSELERRRHFKKLD

SEQ ID NO: 16708 - protein, 6 aa, Neisseria
FPTRLF

SEQ ID NO: 16709 - protein, 31 aa, Neisseria
RFSRFVRGWSGIREYMKNGIPEHVQPGHNPL

SEQ ID NO: 16710 - protein, 5 aa, Neisseria
ALLAA

SEQ ID NO: 16711 - protein, 12 aa, Neisseria
LNHLVSEHTGSL

SEQ ID NO: 16712 - protein, 18 aa, Neisseria
  VARIANT 14: Xaa is any amino acid
FKLLAVFSAVHIAXVAAY

SEQ ID NO: 16713 - protein, 8 aa, Neisseria
MKNKTKVW

SEQ ID NO: 16714 - protein, 8 aa, Neisseria
YSAKTGGD

SEQ ID NO: 16715 - protein, 7 aa, Neisseria
GSDTARF

SEQ ID NO: 16716 - protein, 23 aa, Neisseria
WSGIREYMKNGIPEHVQPGHNPL

SEQ ID NO: 16717 - protein, 5 aa, Neisseria
STNGY

SEQ ID NO: 16718 - protein, 7 aa, Neisseria
HTGSLMR

SEQ ID NO: 16719 - protein, 7 aa, Neisseria
VFKKKNL

SEQ ID NO: 16720 - protein, 7 aa, Neisseria
IEGKTSI

SEQ ID NO: 16721 - protein, 7 aa, Neisseria
MKNKTKV

SEQ ID NO: 16722 - protein, 5 aa, Neisseria
DTARF

SEQ ID NO: 16723 - protein, 5 aa, Neisseria
REYMK

SEQ ID NO: 16724 - protein, 7 aa, Neisseria
VFKKKNL

SEQ ID NO: 16725 - protein, 7 aa, Neisseria
IEGKTSI

SEQ ID NO: 16726 - protein, 16 aa, Neisseria
AASVLSLPEMMRLMVF

SEQ ID NO: 16727 - protein, 13 aa, Neisseria
TLVAYIKLSSVAE

SEQ ID NO: 16728 - protein, 7 aa, Neisseria
VSVPQHW

SEQ ID NO: 16729 - protein, 10 aa, Neisseria
VNTILNGIAY

SEQ ID NO: 16730 - protein, 25 aa, Neisseria
AKKLSHLYRITEAVGRWSMIDIFVI

SEQ ID NO: 16731 - protein, 5 aa, Neisseria
IRKQA

SEQ ID NO: 16732 - protein, 5 aa, Neisseria
VRLRQ

SEQ ID NO: 16733 - protein, 5 aa, Neisseria
AEVRF

SEQ ID NO: 16734 - protein, 19 aa, Neisseria
RLTGDNAVQTASEGKTCCS

SEQ ID NO: 16735 - protein, 11 aa, Neisseria
YFRDSAESPCG

SEQ ID NO: 16736 - protein, 11 aa, Neisseria
ELYRRRPKSLS

SEQ ID NO: 16737 - protein, 6 aa, Neisseria
SNPAAT

SEQ ID NO: 16738 - protein, 6 aa, Neisseria
DEGDRL

SEQ ID NO: 16739 - protein, 6 aa, Neisseria
TGAKKL

SEQ ID NO: 16740 - protein, 12 aa, Neisseria
LLWDKRASDGIA

SEQ ID NO: 16741 - protein, 7 aa, Neisseria
NETEKHD

SEQ ID NO: 16742 - protein, 5 aa, Neisseria
VRLRQ

SEQ ID NO: 16743 - protein, 5 aa, Neisseria
AEVRF

SEQ ID NO: 16744 - protein, 9 aa, Neisseria
TASEGKTCC

SEQ ID NO: 16745 - protein, 6 aa, Neisseria
DSAESP

SEQ ID NO: 16746 - protein, 11 aa, Neisseria
ELYRRRPKSLS

SEQ ID NO: 16747 - protein, 6 aa, Neisseria
DEGDRL

SEQ ID NO: 16748 - protein, 5 aa, Neisseria
GAKKL

SEQ ID NO: 16749 - protein, 9 aa, Neisseria
LLWDKRASD

SEQ ID NO: 16750 - protein, 7 aa, Neisseria
NETEKHD

SEQ ID NO: 16751 - protein, 9 aa, Neisseria
GVTGLGTLL

SEQ ID NO: 16752 - protein, 7 aa, Neisseria
QDIPPVT

SEQ ID NO: 16753 - protein, 9 aa, Neisseria
TKNSKNVKS

SEQ ID NO: 16754 - protein, 5 aa, Neisseria
FKQSV

SEQ ID NO: 16755 - protein, 19 aa, Neisseria
SKEHWKQQFQTALNKGLTA

SEQ ID NO: 16756 - protein, 8 aa, Neisseria
SKMIELND

SEQ ID NO: 16757 - protein, 13 aa, Neisseria
KLADLLDKFDKLP

SEQ ID NO: 16758 - protein, 6 aa, Neisseria
VAELNG

SEQ ID NO: 16759 - protein, 30 aa, Neisseria; identical to SEQ ID NO: 2723

SEQ ID NO: 16760 - protein, 29 aa, Neisseria
IYGDVQNTLQSLDKTLKDVQPVINTLKEK

SEQ ID NO: 16761 - protein, 21 aa, Neisseria
MTDNSPPPNGHAQARVRKNNT

SEQ ID NO: 16762 - protein, 9 aa, Neisseria
KEIRNRGPV

SEQ ID NO: 16763 - protein, 11 aa, Neisseria
DSAEGIEVNNT

SEQ ID NO: 16764 - protein, 18 aa, Neisseria
DVGRVTRIKLRDDQKGVE

SEQ ID NO: 16765 - protein, 11 aa, Neisseria
DVSGLIRSDTQ

SEQ ID NO: 16766 - protein, 9 aa, Neisseria
VKPRIDQSG

SEQ ID NO: 16767 - protein, 13 aa, Neisseria
TPGKSDEAKDVFQ

SEQ ID NO: 16768 - protein, 10 aa, Neisseria
LIGKNDRILN

SEQ ID NO: 16769 - protein, 9 aa, Neisseria
AHFDPSDQS

SEQ ID NO: 16770 - protein, 8 aa, Neisseria
QSPNDKLI

SEQ ID NO: 16771 - protein, 17 aa, Neisseria
ESGINIETTGSGIKLNS

SEQ ID NO: 16772 - protein, 18 aa, Neisseria
SFDSPKTKNSKNVKSEDS

SEQ ID NO: 16773 - protein, 18 aa, Neisseria
TLYDSRSEVANLPDDRSL

SEQ ID NO: 16774 - protein, 6 aa, Neisseria
QSVRGL

SEQ ID NO: 16775 - protein, 7 aa, Neisseria
VEYKGLN

SEQ ID NO: 16776 - protein, 8 aa, Neisseria
PYFDRNDS

SEQ ID NO: 16777 - protein, 24 aa, Neisseria
IRIEPSRLEINADEQSKEHWKQQF

SEQ ID NO: 16778 - protein, 6 aa, Neisseria
ALNKGL

SEQ ID NO: 16779 - protein, 21 aa, Neisseria
LTGSKMIELNDQPSASPKLRP

SEQ ID NO: 16780 - protein, 12 aa, Neisseria
QGGGLDDLQVKL

SEQ ID NO: 16781 - protein, 16 aa, Neisseria
DLLDKFDKLPLDKTVA

SEQ ID NO: 16782 - protein, 15 aa, Neisseria
NGSLAELKSTLKSAN

SEQ ID NO: 16783 - protein, 28 aa, Neisseria
SIDKLVGKPQTQNIPNELNQTLKELRTT

SEQ ID NO: 16784 - protein, 5 aa, Neisseria
VSPQS

SEQ ID NO: 16785 - protein, 10 aa, Neisseria
SLDKTLKDVQ

SEQ ID NO: 16786 - protein, 7 aa, Neisseria
TLKEKPN

SEQ ID NO: 16787 - protein, 13 aa, Neisseria
NSSSKDPIPKGSR

SEQ ID NO: 16788 - protein, 8 aa, Neisseria
MTDNSPPP

SEQ ID NO: 16789 - protein, 9 aa, Neisseria
AQARVRKNN

SEQ ID NO: 16790 - protein, 7 aa, Neisseria
KEIRNRG

SEQ ID NO: 16791 - protein, 7 aa, Neisseria
DSAEGIE

SEQ ID NO: 16792 - protein, 18 aa, Neisseria
DVGRVTRIKLRDDQKGVE

SEQ ID NO: 16793 - protein, 5 aa, Neisseria
IRSDT

SEQ ID NO: 16794 - protein, 5 aa, Neisseria
PRIDQ

SEQ ID NO: 16795 - protein, 11 aa, Neisseria
GKSDEAKDVFQ

SEQ ID NO: 16796 - protein, 7 aa, Neisseria
GKNDRIL

SEQ ID NO: 16797 - protein, 8 aa, Neisseria
AHFDPSDQ

SEQ ID NO: 16798 - protein, 6 aa, Neisseria
PNDKLI

SEQ ID NO: 16799 - protein, 16 aa, Neisseria
DSPKTKNSKNVKSEDS

SEQ ID NO: 16800 - protein, 6 aa, Neisseria
DSRSEV

SEQ ID NO: 16801 - protein, 7 aa, Neisseria
NLPDDRS

SEQ ID NO: 16802 - protein, 5 aa, Neisseria
VEYKG

SEQ ID NO: 16803 - protein, 5 aa, Neisseria
DRNDS

SEQ ID NO: 16804 - protein, 21 aa, Neisseria
IRIEPSRLEINADEQSKEHWK

SEQ ID NO: 16805 - protein, 17 aa, Neisseria
KMIELNDQPSASPKLRP

SEQ ID NO: 16806 - protein, 10 aa, Neisseria
GGLDDLQVKL

SEQ ID NO: 16807 - protein, 16 aa, Neisseria
DLLDKFDKLPLDKTVA

SEQ ID NO: 16808 - protein, 11 aa, Neisseria
AELKSTLKSAN

SEQ ID NO: 16809 - protein, 7 aa, Neisseria
SIDKLVG

SEQ ID NO: 16810 - protein, 5 aa, Neisseria
IPNEL

SEQ ID NO: 16811 - protein, 8 aa, Neisseria
QTLKELRT

SEQ ID NO: 16812 - protein, 10 aa, Neisseria
SLDKTLKDVQ

SEQ ID NO: 16813 - protein, 7 aa, Neisseria
TLKEKPN

SEQ ID NO: 16814 - protein, 11 aa, Neisseria
SSKDPIPKGSR

SEQ ID NO: 16815 - protein, 5 aa, Neisseria
KLGFE

SEQ ID NO: 16816 - protein, 5 aa, Neisseria
AASLD

SEQ ID NO: 16817 - protein, 6 aa, Neisseria
LRAKKV

SEQ ID NO: 16818 - protein, 44 aa, Neisseria
  VARIANT (1)...(44): Xaa is any amino acid
VPRISRAQALDXLSXMANISGYRAVIEAANAFGRXFTGQITAAG

SEQ ID NO: 16819 - protein, 20 aa, Neisseria
VAGLAAIGTANSLGAVVRVF

SEQ ID NO: 16820 - protein, 9 aa, Neisseria
AEQLESMGG

SEQ ID NO: 16821 - protein, 7 aa, Neisseria
DGYAKVM

SEQ ID NO: 16822 - protein, 14 aa, Neisseria
  VARIANT (1)...(14): Xaa is any amino acid
APKXXXKEMVESMK

SEQ ID NO: 16823 - protein, 5 aa, Neisseria
VIVDL

SEQ ID NO: 16824 - protein, 17 aa, Neisseria
GVKIIGYTDMANRLAGQ

SEQ ID NO: 16825 - protein, 11 aa, Neisseria
TNLVNLTKLLS

SEQ ID NO: 16826 - protein, 7 aa, Neisseria
  VARIANT 6: Xaa is any amino acid
KLAPAXI

SEQ ID NO: 16827 - protein, 5 aa, Neisseria
NHFIV

SEQ ID NO: 16828 - protein, 16 aa, Neisseria
LHTPLMSVTNAISGII

SEQ ID NO: 16829 - protein, 5 aa, Neisseria
GALLQ

SEQ ID NO: 16830 - protein, 11 aa, Neisseria
NGFVSLLSFVA

SEQ ID NO: 16831 - protein, 6 aa, Neisseria
INIFGG

SEQ ID NO: 16832 - protein, 13 aa, Neisseria
GIPRESLSGETRV

SEQ ID NO: 16833 - protein, 6 aa, Neisseria
SLDDAA

SEQ ID NO: 16834 - protein, 16 aa, Neisseria
VNAPSEDELPLLKEGQ

SEQ ID NO: 16835 - protein, 8 aa, Neisseria
WPRQNEAL

SEQ ID NO: 16836 - protein, 7 aa, Neisseria
LRAKKVN

SEQ ID NO: 16837 - protein, 7 aa, Neisseria
MVPRISR

SEQ ID NO: 16838 - protein, 8 aa, Neisseria
AAGKVPPA

SEQ ID NO: 16839 - protein, 9 aa, Neisseria
EQLESMGGK

SEQ ID NO: 16840 - protein, 18 aa, Neisseria
DFPQESGGSGDGYAKVMS

SEQ ID NO: 16841 - protein, 10 aa, Neisseria
LFAEQAKEVD

SEQ ID NO: 16842 - protein, 22 aa, Neisseria
  VARIANT (1)...(22): Xaa is any amino acid
IPGKPAPKXXXKEMVESMKPGS

SEQ ID NO: 16843 - protein, 11 aa, Neisseria
GGNCELTKQGE

SEQ ID NO: 16844 - protein, 6 aa, Neisseria
LAGQSS

SEQ ID NO: 16845 - protein, 10 aa, Neisseria
LLSPNKDGEI

SEQ ID NO: 16846 - protein, 7 aa, Neisseria
LDFEDVI

SEQ ID NO: 16847 - protein, 11 aa, Neisseria
TVTRDGEITFP

SEQ ID NO: 16848 - protein, 21 aa, Neisseria
AQPQQTPSEKAAPAAKPEPKP

SEQ ID NO: 16849 - protein, 5 aa, Neisseria
MFRKG

SEQ ID NO: 16850 - protein, 13 aa, Neisseria
GIPRESLSGETRV

SEQ ID NO: 16851 - protein, 6 aa, Neisseria
SLDDAA

SEQ ID NO: 16852 - protein, 14 aa, Neisseria
APSEDELPLLKEGQ

SEQ ID NO: 16853 - protein, 6 aa, Neisseria
RQNEAL

SEQ ID NO: 16854 - protein, 7 aa, Neisseria
LRAKKVN

SEQ ID NO: 16855 - protein, 7 aa, Neisseria
MVPRISR

SEQ ID NO: 16856 - protein, 7 aa, Neisseria
EQLESMG

SEQ ID NO: 16857 - protein, 14 aa, Neisseria
DFPQESGGSGDGYA

SEQ ID NO: 16858 - protein, 10 aa, Neisseria
LFAEQAKEVD

SEQ ID NO: 16859 - protein, 19 aa, Neisseria
  VARIANT (1)...(19): Xaa is any amino acid
PGKPAPKXXXKEMVESMKP

SEQ ID NO: 16860 - protein, 10 aa, Neisseria
GNCELTKQGE

SEQ ID NO: 16861 - protein, 8 aa, Neisseria
SPNKDGEI

SEQ ID NO: 16862 - protein, 7 aa, Neisseria
LDFEDVI

SEQ ID NO: 16863 - protein, 8 aa, Neisseria
TVTRDGEI

SEQ ID NO: 16864 - protein, 17 aa, Neisseria
QTPSEKAAPAAKPEPKP

SEQ ID NO: 16865 - protein, 9 aa, Neisseria
NGFEAFAPF

SEQ ID NO: 16866 - protein, 5 aa, Neisseria
ATVNT

SEQ ID NO: 16867 - protein, 39 aa, Neisseria
YAKKAGGFRFKDNHNPRDFLARTQGTAARAHAAQQNGFE

SEQ ID NO: 16868 - protein, 7 aa, Neisseria
ATGNAGQ

SEQ ID NO: 16869 - protein, 5 aa, Neisseria
DKAAL

SEQ ID NO: 16870 - protein, 21 aa, Neisseria
YAKKAGGFRFKDNHNPRDFLA

SEQ ID NO: 16871 - protein, 10 aa, Neisseria
TQGTAARAHA

SEQ ID NO: 16872 - protein, 5 aa, Neisseria
DKAAL

SEQ ID NO: 16873 - protein, 7 aa, Neisseria
RRELRRA

SEQ ID NO: 16874 - protein, 12 aa, Neisseria
INRLLKRYIKRG

SEQ ID NO: 16875 - protein, 6 aa, Neisseria
FVRAAQ

SEQ ID NO: 16876 - protein, 6 aa, Neisseria
LGQAGG

SEQ ID NO: 16877 - protein, 17 aa, Neisseria
QFVDRLPREPHDLLLDG

SEQ ID NO: 16878 - protein, 28 aa, Neisseria
MRNEEKHALRRELRRARAQMGHQGRLAA

SEQ ID NO: 16879 - protein, 13 aa, Neisseria
RLLKRYIKRGRKI

SEQ ID NO: 16880 - protein, 12 aa, Neisseria
PMGKELRLDGFV

SEQ ID NO: 16881 - protein, 9 aa, Neisseria
AAQKRGAKL

SEQ ID NO: 16882 - protein, 9 aa, Neisseria
IEPRSRRMW

SEQ ID NO: 16883 - protein, 20 aa, Neisseria
PYPESGMERERIRGRAKLNV

SEQ ID NO: 16884 - protein, 8 aa, Neisseria
FAGRKIRV

SEQ ID NO: 16885 - protein, 11 aa, Neisseria
GIDREGYRLGQ

SEQ ID NO: 16886 - protein, 5 aa, Neisseria
YRLQA

SEQ ID NO: 16887 - protein, 14 aa, Neisseria
FVDRLPREPHDLLL

SEQ ID NO: 16888 - protein, 20 aa, Neisseria
MRNEEKHALRRELRRARAQM

SEQ ID NO: 16889 - protein, 13 aa, Neisseria
RLLKRYIKRGRKI

SEQ ID NO: 16890 - protein, 5 aa, Neisseria
KELRL

SEQ ID NO: 16891 - protein, 7 aa, Neisseria
AAQKRGA

SEQ ID NO: 16892 - protein, 7 aa, Neisseria
IEPRSRR

SEQ ID NO: 16893 - protein, 14 aa, Neisseria
SGMERERIRGRAKL

SEQ ID NO: 16894 - protein, 7 aa, Neisseria
AGRKIRV

SEQ ID NO: 16895 - protein, 8 aa, Neisseria
GIDREGYR

SEQ ID NO: 16896 - protein, 5 aa, Neisseria
YRLQA

SEQ ID NO: 16897 - protein, 11 aa, Neisseria
DRLPREPHDLL

SEQ ID NO: 16898 - protein, 8 aa, Neisseria
FSRAAEQL

SEQ ID NO: 16899 - protein, 10 aa, Neisseria
AVSRIVKRLE

SEQ ID NO: 16900 - protein, 8 aa, Neisseria
GVNLLNRT

SEQ ID NO: 16901 - protein, 14 aa, Neisseria
GAQYFRRAQRILQE

SEQ ID NO: 16902 - protein, 8 aa, Neisseria
LAVHEIPQ

SEQ ID NO: 16903 - protein, 5 aa, Neisseria
VIASP

SEQ ID NO: 16904 - protein, 8 aa, Neisseria
TPQSTEEL

SEQ ID NO: 16905 - protein, 17 aa, Neisseria
HQCLGFTEPGSLNTWAV

SEQ ID NO: 16906 - protein, 8 aa, Neisseria
MKTNSEEL

SEQ ID NO: 16907 - protein, 10 aa, Neisseria
ESGSFSRAAE

SEQ ID NO: 16908 - protein, 11 aa, Neisseria
RIVKRLEEKLG

SEQ ID NO: 16909 - protein, 27 aa, Neisseria
LLNRTTRQLSLTEEGAQYFRRAQRILQ

SEQ ID NO: 16910 - protein, 7 aa, Neisseria
AAAETEM

SEQ ID NO: 16911 - protein, 10 aa, Neisseria
IPQGVLRVDS

SEQ ID NO: 16912 - protein, 10 aa, Neisseria
KFNERYPHIR

SEQ ID NO: 16913 - protein, 7 aa, Neisseria
IERKVDI

SEQ ID NO: 16914 - protein, 13 aa, Neisseria
LRAGELDDSGLRA

SEQ ID NO: 16915 - protein, 9 aa, Neisseria
HLFDSRFRV

SEQ ID NO: 16916 - protein, 19 aa, Neisseria
ASPEYLAKHGTPQSTEELA

SEQ ID NO: 16917 - protein, 9 aa, Neisseria
GFTEPGSLN

SEQ ID NO: 16918 - protein, 8 aa, Neisseria
AQGNPYKI

SEQ ID NO: 16919 - protein, 11 aa, Neisseria
PHFTASSGEIL

SEQ ID NO: 16920 - protein, 7 aa, Neisseria
LCLSGCG

SEQ ID NO: 16921 - protein, 11 aa, Neisseria
LVDNDIAEGKL

SEQ ID NO: 16922 - protein, 11 aa, Neisseria
AEQTSNKTHPF

SEQ ID NO: 16923 - protein, 8 aa, Neisseria
YSDKAVNL

SEQ ID NO: 16924 - protein, 8 aa, Neisseria
ELGNNLCG

SEQ ID NO: 16925 - protein, 8 aa, Neisseria
MKTNSEEL

SEQ ID NO: 16926 - protein, 7 aa, Neisseria
SFSRAAE

SEQ ID NO: 16927 - protein, 11 aa, Neisseria
RIVKRLEEKLG

SEQ ID NO: 16928 - protein, 18 aa, Neisseria
SLTEEGAQYFRRAQRILQ

SEQ ID NO: 16929 - protein, 7 aa, Neisseria
AAAETEM

SEQ ID NO: 16930 - protein, 5 aa, Neisseria
LRVDS

SEQ ID NO: 16931 - protein, 7 aa, Neisseria
KFNERYP

SEQ ID NO: 16932 - protein, 7 aa, Neisseria
IERKVDI

SEQ ID NO: 16933 - protein, 13 aa, Neisseria
LRAGELDDSGLRA

SEQ ID NO: 16934 - protein, 5 aa, Neisseria
SRFRV

SEQ ID NO: 16935 - protein, 7 aa, Neisseria
QSTEELA

SEQ ID NO: 16936 - protein, 8 aa, Neisseria
NDIAEGKL

SEQ ID NO: 16937 - protein, 7 aa, Neisseria
QTSNKTH

SEQ ID NO: 16938 - protein, 5 aa, Neisseria
KAVNL

SEQ ID NO: 16939 - protein, 10 aa, Neisseria
KLVDFAQLTG

SEQ ID NO: 16940 - protein, 5 aa, Neisseria
GLGHV

SEQ ID NO: 16941 - protein, 10 aa, Neisseria
ADLMNGLPET

SEQ ID NO: 16942 - protein, 11 aa, Neisseria
GTVSMVNALSS

SEQ ID NO: 16943 - protein, 12 aa, Neisseria
LSGVLKGWQDKR

SEQ ID NO: 16944 - protein, 11 aa, Neisseria
HLIQKVIDKPE

SEQ ID NO: 16945 - protein, 6 aa, Neisseria
MVAAAN

SEQ ID NO: 16946 - protein, 5 aa, Neisseria
LMRRF

SEQ ID NO: 16947 - protein, 8 aa, Neisseria
HAFVNHIR

SEQ ID NO: 16948 - protein, 6 aa, Neisseria
FGKAFK

SEQ ID NO: 16949 - protein, 7 aa, Neisseria
DILDKLV

SEQ ID NO: 16950 - protein, 12 aa, Neisseria
SVRHETLQREGL

SEQ ID NO: 16951 - protein, 15 aa, Neisseria
CIDGETSPRPVSTGD

SEQ ID NO: 16952 - protein, 19 aa, Neisseria
LSHDGKCGESLQPDMRQHG

SEQ ID NO: 16953 - protein, 8 aa, Neisseria
QCGNGQDM

SEQ ID NO: 16954 - protein, 7 aa, Neisseria
FRYDTHA

SEQ ID NO: 16955 - protein, 5 aa, Neisseria
LMNGL

SEQ ID NO: 16956 - protein, 7 aa, Neisseria
LESKKPL

SEQ ID NO: 16957 - protein, 9 aa, Neisseria
LEQDKDVEL

SEQ ID NO: 16958 - protein, 8 aa, Neisseria
GWQDKRLG

SEQ ID NO: 16959 - protein, 15 aa, Neisseria
VIDKPEDEWNVDKMV

SEQ ID NO: 16960 - protein, 15 aa, Neisseria
QLMRRFKSRVGLSPH

SEQ ID NO: 16961 - protein, 10 aa, Neisseria
LLLKKNPDSV

SEQ ID NO: 16962 - protein, 6 aa, Neisseria
QSETHF

SEQ ID NO: 16963 - protein, 5 aa, Neisseria
KAFKR

SEQ ID NO: 16964 - protein, 12 aa, Neisseria
SPGQYRKEGGQK

SEQ ID NO: 16965 - protein, 7 aa, Neisseria
DILDKLV

SEQ ID NO: 16966 - protein, 11 aa, Neisseria
VRHETLQREGL

SEQ ID NO: 16967 - protein, 10 aa, Neisseria
DGETSPRPVS

SEQ ID NO: 16968 - protein, 15 aa, Neisseria
HDGKCGESLQPDMRQ

SEQ ID NO: 16969 - protein, 7 aa, Neisseria
QCGNGQD

SEQ ID NO: 16970 - protein, 7 aa, Neisseria
LESKKPL

SEQ ID NO: 16971 - protein, 9 aa, Neisseria
LEQDKDVEL

SEQ ID NO: 16972 - protein, 7 aa, Neisseria
WQDKRLG

SEQ ID NO: 16973 - protein, 11 aa, Neisseria
VIDKPEDEWNV

SEQ ID NO: 16974 - protein, 11 aa, Neisseria
QLMRRFKSRVG

SEQ ID NO: 16975 - protein, 9 aa, Neisseria
LLLKKNPDS

SEQ ID NO: 16976 - protein, 5 aa, Neisseria
KAFKR

SEQ ID NO: 16977 - protein, 9 aa, Neisseria
QYRKEGGQK

SEQ ID NO: 16978 - protein, 6 aa, Neisseria
SSLGNI

SEQ ID NO: 16979 - protein, 6 aa, Neisseria
LGRDED

SEQ ID NO: 16980 - protein, 11 aa, Neisseria
FGFLSWLAMLF

SEQ ID NO: 16981 - protein, 13 aa, Neisseria
AEPLMHYFSDITA

SEQ ID NO: 16982 - protein, 24 aa, Neisseria
ISGRFGDAIDIMALLATFFGIITT

SEQ ID NO: 16983 - protein, 20 aa, Neisseria
MSLAVVSAISGVGKGVKVLS

SEQ ID NO: 16984 - protein, 15 aa, Neisseria
AFGDNIGNYLGNLVR

SEQ ID NO: 16985 - protein, 13 aa, Neisseria
WCSWAPFVGLFIA

SEQ ID NO: 16986 - protein, 7 aa, Neisseria
LFGVLWF

SEQ ID NO: 16987 - protein, 11 aa, Neisseria
AGGVLEKMTSS

SEQ ID NO: 16988 - protein, 22 aa, Neisseria
TLLFKFFNYLPLPELTSIVSLL

SEQ ID NO: 16989 - protein, 7 aa, Neisseria
WGVLMSA

SEQ ID NO: 16990 - protein, 10 aa, Neisseria
GLGNLQSMTL

SEQ ID NO: 16991 - protein, 12 aa, Neisseria
EQDILKFLKHTA

SEQ ID NO: 16992 - protein, 8 aa, Neisseria
MHELQREL

SEQ ID NO: 16993 - protein, 6 aa, Neisseria
DFMYGI

SEQ ID NO: 16994 - protein, 8 aa, Neisseria
GQDVSDQL

SEQ ID NO: 16995 - protein, 7 aa, Neisseria
ADILKNY

SEQ ID NO: 16996 - protein, 5 aa, Neisseria
DRAKE

SEQ ID NO: 16997 - protein, 10 aa, Neisseria
IRLGRDEDVP

SEQ ID NO: 16998 - protein, 10 aa, Neisseria
TAGTPEHRQQ

SEQ ID NO: 16999 - protein, 14 aa, Neisseria
LKEKISGRFGDAID

SEQ ID NO: 17000 - protein, 6 aa, Neisseria
QLGAGL

SEQ ID NO: 17001 - protein, 8 aa, Neisseria
GVGKGVKV

SEQ ID NO: 17002 - protein, 10 aa, Neisseria
AYEREHKPWF

SEQ ID NO: 17003 - protein, 9 aa, Neisseria
RISKGRTIR

SEQ ID NO: 17004 - protein, 11 aa, Neisseria
VLEKMTSSPET

SEQ ID NO: 17005 - protein, 7 aa, Neisseria
TSADSGI

SEQ ID NO: 17006 - protein, 13 aa, Neisseria
ITSRDKGLSAPRW

SEQ ID NO: 17007 - protein, 7 aa, Neisseria
RSGGLGN

SEQ ID NO: 17008 - protein, 16 aa, Neisseria
LSADKKYFETRVNPTS

SEQ ID NO: 17009 - protein, 9 aa, Neisseria
TGGKWKERL

SEQ ID NO: 17010 - protein, 8 aa, Neisseria
SQTQEQDI

SEQ ID NO: 17011 - protein, 12 aa, Neisseria
ELQRELSEEYGL

SEQ ID NO: 17012 - protein, 13 aa, Neisseria
VRVDKMFHQDEPA

SEQ ID NO: 17013 - protein, 8 aa, Neisseria
VIRKETMR

SEQ ID NO: 17014 - protein, 28 aa, Neisseria
SVGQDVSDQLINDGKLPHIRHQTTYKPY

SEQ ID NO: 17015 - protein, 7 aa, Neisseria
FDGRVGY

SEQ ID NO: 17016 - protein, 8 aa, Neisseria
YMNKDELI

SEQ ID NO: 17017 - protein, 6 aa, Neisseria
ILKNYE

SEQ ID NO: 17018 - protein, 7 aa, Neisseria
EQVELAE

SEQ ID NO: 17019 - protein, 5 aa, Neisseria
DRAKE

SEQ ID NO: 17020 - protein, 9 aa, Neisseria
RLGRDEDVP

SEQ ID NO: 17021 - protein, 7 aa, Neisseria
TPEHRQQ

SEQ ID NO: 17022 - protein, 11 aa, Neisseria
LKEKISGRFGD

SEQ ID NO: 17023 - protein, 7 aa, Neisseria
VGKGVKV

SEQ ID NO: 17024 - protein, 8 aa, Neisseria
AYEREHKP

SEQ ID NO: 17025 - protein, 8 aa, Neisseria
ISKGRTIR

SEQ ID NO: 17026 - protein, 9 aa, Neisseria
VLEKMTSSP

SEQ ID NO: 17027 - protein, 8 aa, Neisseria
TSRDKGLS

SEQ ID NO: 17028 - protein, 9 aa, Neisseria
LSADKKYFE

SEQ ID NO: 17029 - protein, 6 aa, Neisseria
KWKERL

SEQ ID NO: 17030 - protein, 7 aa, Neisseria
QTQEQDI

SEQ ID NO: 17031 - protein, 12 aa, Neisseria
ELQRELSEEYGL

SEQ ID NO: 17032 - protein, 13 aa, Neisseria
VRVDKMFHQDEPA

SEQ ID NO: 17033 - protein, 8 aa, Neisseria
VIRKETMR

SEQ ID NO: 17034 - protein, 8 aa, Neisseria
SVGQDVSD

SEQ ID NO: 17035 - protein, 9 aa, Neisseria
LINDGKLPH

SEQ ID NO: 17036 - protein, 8 aa, Neisseria
YMNKDELI

SEQ ID NO: 17037 - protein, 7 aa, Neisseria
EQVELAE

SEQ ID NO: 17038 - protein, 10 aa, Neisseria
ANFYEMLTAA

SEQ ID NO: 17039 - protein, 8 aa, Neisseria
AYRALKQE

SEQ ID NO: 17040 - protein, 8 aa, Neisseria
AVSAIGAV

SEQ ID NO: 17041 - protein, 6 aa, Neisseria
YILNDC

SEQ ID NO: 17042 - protein, 10 aa, Neisseria
LSKELAGLKA

SEQ ID NO: 17043 - protein, 9 aa, Neisseria
FEDVRRFPE

SEQ ID NO: 17044 - protein, 12 aa, Neisseria
LGRQPRINDLAH

SEQ ID NO: 17045 - protein, 16 aa, Neisseria
YANLFANLNGIERIFK

SEQ ID NO: 17046 - protein, 6 aa, Neisseria
VPAIYT

SEQ ID NO: 17047 - protein, 5 aa, Neisseria
WFNRI

SEQ ID NO: 17048 - protein, 10 aa, Neisseria
AKLLEGYGLS

SEQ ID NO: 17049 - protein, 6 aa, Neisseria
EVGELI

SEQ ID NO: 17050 - protein, 6 aa, Neisseria
MRGYLN

SEQ ID NO: 17051 - protein, 8 aa, Neisseria
TIVNGWLK

SEQ ID NO: 17052 - protein, 9 aa, Neisseria
VYPREIEEE

SEQ ID NO: 17053 - protein, 8 aa, Neisseria
FVQLKEGM

SEQ ID NO: 17054 - protein, 9 aa, Neisseria
EIRRHLRTV

SEQ ID NO: 17055 - protein, 6 aa, Neisseria
FKIPKQ

SEQ ID NO: 17056 - protein, 18 aa, Neisseria
NATGKVLKRVLKEQFDGN

SEQ ID NO: 17057 - protein, 5 aa, Neisseria
MNRTY

SEQ ID NO: 17058 - protein, 8 aa, Neisseria
ACRKNGNG

SEQ ID NO: 17059 - protein, 18 aa, Neisseria
FDGKEKTAYRALKQEAEA

SEQ ID NO: 17060 - protein, 6 aa, Neisseria
VSNSTE

SEQ ID NO: 17061 - protein, 7 aa, Neisseria
TFLKNSE

SEQ ID NO: 17062 - protein, 5 aa, Neisseria
NDCKA

SEQ ID NO: 17063 - protein, 8 aa, Neisseria
GLSKELAG

SEQ ID NO: 17064 - protein, 7 aa, Neisseria
KAQTPVE

SEQ ID NO: 17065 - protein, 36 aa, Neisseria
GQSRPDGEMAEGDAFFEDVRRFPEKPDLGRQPRIND

SEQ ID NO: 17066 - protein, 10 aa, Neisseria
SGTTGHPKGA

SEQ ID NO: 17067 - protein, 16 aa, Neisseria
LNGIERIFKISKRDRF

SEQ ID NO: 17068 - protein, 7 aa, Neisseria
AMSKTKI

SEQ ID NO: 17069 - protein, 7 aa, Neisseria
SGGAPLA

SEQ ID NO: 17070 - protein, 7 aa, Neisseria
FKAKFPR

SEQ ID NO: 17071 - protein, 7 aa, Neisseria
YGLSEAS

SEQ ID NO: 17072 - protein, 9 aa, Neisseria
TPERQKARS

SEQ ID NO: 17073 - protein, 22 aa, Neisseria
LPGLEVKAVDEELVEVPRGEVG

SEQ ID NO: 17074 - protein, 8 aa, Neisseria
IVRGGSVM

SEQ ID NO: 17075 - protein, 7 aa, Neisseria
AATDETI

SEQ ID NO: 17076 - protein, 5 aa, Neisseria
LKTGD

SEQ ID NO: 17077 - protein, 6 aa, Neisseria
TIDEDG

SEQ ID NO: 17078 - protein, 26 aa, Neisseria
VDRKKDLIISKGQNVYPREIEEEIYK

SEQ ID NO: 17079 - protein, 11 aa, Neisseria
GVKDRYADEEI

SEQ ID NO: 17080 - protein, 17 aa, Neisseria
LKEGMDLGENEIRRHLR

SEQ ID NO: 17081 - protein, 28 aa, Neisseria
IHFKDGLPRNATGKVLKRVLKEQFDGNK

SEQ ID NO: 17082 - protein, 7 aa, Neisseria
ACRKNGN

SEQ ID NO: 17083 - protein, 18 aa, Neisseria
FDGKEKTAYRALKQEAEA

SEQ ID NO: 17084 - protein, 8 aa, Neisseria
GLSKELAG

SEQ ID NO: 17085 - protein, 34 aa, Neisseria
SRPDGEMAEGDAFFEDVRRFPEKPDLGRQPRIND

SEQ ID NO: 17086 - protein, 14 aa, Neisseria
GIERIFKISKRDRF

SEQ ID NO: 17087 - protein, 7 aa, Neisseria
FKAKFPR

SEQ ID NO: 17088 - protein, 9 aa, Neisseria
TPERQKARS

SEQ ID NO: 17089 - protein, 19 aa, Neisseria
LEVKAVDEELVEVPRGEVG

SEQ ID NO: 17090 - protein, 7 aa, Neisseria
AATDETI

SEQ ID NO: 17091 - protein, 6 aa, Neisseria
TIDEDG

SEQ ID NO: 17092 - protein, 9 aa, Neisseria
VDRKKDLII

SEQ ID NO: 17093 - protein, 11 aa, Neisseria
YPREIEEEIYK

SEQ ID NO: 17094 - protein, 11 aa, Neisseria
GVKDRYADEEI

SEQ ID NO: 17095 - protein, 17 aa, Neisseria
LKEGMDLGENEIRRHLR

SEQ ID NO: 17096 - protein, 8 aa, Neisseria
DGLPRNAT

SEQ ID NO: 17097 - protein, 15 aa, Neisseria
KVLKRVLKEQFDGNK

SEQ ID NO: 17098 - protein, 10 aa, Neisseria
ATLGVLLKEL

SEQ ID NO: 17099 - protein, 8 aa, Neisseria
TLIERLED

SEQ ID NO: 17100 - protein, 11 aa, Neisseria
IIDPARALNIA

SEQ ID NO: 17101 - protein, 5 aa, Neisseria
QFWAT

SEQ ID NO: 17102 - protein, 5 aa, Neisseria
NAVPH

SEQ ID NO: 17103 - protein, 17 aa, Neisseria
LQKRYDAFKTQKLFENM

SEQ ID NO: 17104 - protein, 12 aa, Neisseria
RLTRQMVKYLQG

SEQ ID NO: 17105 - protein, 13 aa, Neisseria
TEFNRHVEDIKRE

SEQ ID NO: 17106 - protein, 5 aa, Neisseria
KTKEE

SEQ ID NO: 17107 - protein, 7 aa, Neisseria
ASLLEYY

SEQ ID NO: 17108 - protein, 5 aa, Neisseria
RLKEL

SEQ ID NO: 17109 - protein, 6 aa, Neisseria
MAEATD

SEQ ID NO: 17110 - protein, 7 aa, Neisseria
KELEPSW

SEQ ID NO: 17111 - protein, 20 aa, Neisseria
ERLEDVALESSNAWNNAGTG

SEQ ID NO: 17112 - protein, 9 aa, Neisseria
AEGKLEDNS

SEQ ID NO: 17113 - protein, 23 aa, Neisseria
MNEDHCSYLQKRYDAFKTQKLFE

SEQ ID NO: 17114 - protein, 12 aa, Neisseria
MEFSTDRNKISD

SEQ ID NO: 17115 - protein, 10 aa, Neisseria
MMRGRDENQP

SEQ ID NO: 17116 - protein, 19 aa, Neisseria
ANYSAEGTDVDFGRLTRQM

SEQ ID NO: 17117 - protein, 23 aa, Neisseria
LQGKGVKTEFNRHVEDIKRESDG

SEQ ID NO: 17118 - protein, 11 aa, Neisseria
TADTRNPDGQL

SEQ ID NO: 17119 - protein, 12 aa, Neisseria
QKSGIPEGKGYG

SEQ ID NO: 17120 - protein, 13 aa, Neisseria
FRNSNPETAEQHN

SEQ ID NO: 17121 - protein, 12 aa, Neisseria
LDTRNVDGKRHL

SEQ ID NO: 17122 - protein, 9 aa, Neisseria
NFLKQGSLM

SEQ ID NO: 17123 - protein, 10 aa, Neisseria
ELRKTKEERF

SEQ ID NO: 17124 - protein, 10 aa, Neisseria
YPEANPDDWE

SEQ ID NO: 17125 - protein, 11 aa, Neisseria
QIIKKDSEKGG

SEQ ID NO: 17126 - protein, 6 aa, Neisseria
AHADGS

SEQ ID NO: 17127 - protein, 6 aa, Neisseria
SPGAST

SEQ ID NO: 17128 - protein, 19 aa, Neisseria
FPERTPSWEGRLKELVPGY

SEQ ID NO: 17129 - protein, 11 aa, Neisseria
KLNENPERADE

SEQ ID NO: 17130 - protein, 6 aa, Neisseria
MAEATD

SEQ ID NO: 17131 - protein, 5 aa, Neisseria
KELEP

SEQ ID NO: 17132 - protein, 10 aa, Neisseria
ERLEDVALES

SEQ ID NO: 17133 - protein, 9 aa, Neisseria
AEGKLEDNS

SEQ ID NO: 17134 - protein, 6 aa, Neisseria
MNEDHC

SEQ ID NO: 17135 - protein, 10 aa, Neisseria
LQKRYDAFKT

SEQ ID NO: 17136 - protein, 12 aa, Neisseria
MEFSTDRNKISD

SEQ ID NO: 17137 - protein, 9 aa, Neisseria
MRGRDENQP

SEQ ID NO: 17138 - protein, 9 aa, Neisseria
SAEGTDVDF

SEQ ID NO: 17139 - protein, 6 aa, Neisseria
RLTRQM

SEQ ID NO: 17140 - protein, 20 aa, Neisseria
KGVKTEFNRHVEDIKRESDG

SEQ ID NO: 17141 - protein, 9 aa, Neisseria
TADTRNPDG

SEQ ID NO: 17142 - protein, 7 aa, Neisseria
GIPEGKG

SEQ ID NO: 17143 - protein, 10 aa, Neisseria
SNPETAEQHN

SEQ ID NO: 17144 - protein, 10 aa, Neisseria
LDTRNVDGKR

SEQ ID NO: 17145 - protein, 10 aa, Neisseria
ELRKTKEERF

SEQ ID NO: 17146 - protein, 7 aa, Neisseria
ANPDDWE

SEQ ID NO: 17147 - protein, 11 aa, Neisseria
QIIKKDSEKGG

SEQ ID NO: 17148 - protein, 16 aa, Neisseria
FPERTPSWEGRLKELV

SEQ ID NO: 17149 - protein, 11 aa, Neisseria
KLNENPERADE

SEQ ID NO: 17150 - protein, 22 aa, Neisseria
PEQNVVRLTGKHPNDLEAVVGK

SEQ ID NO: 17151 - protein, 18 aa, Neisseria
CHTLFAKLVGNIAEDGGK

SEQ ID NO: 17152 - protein, 5 aa, Neisseria
QPYQA

SEQ ID NO: 17153 - protein, 10 aa, Neisseria
PLKGLPEQNV

SEQ ID NO: 17154 - protein, 13 aa, Neisseria
LTGKHPNDLEAVV

SEQ ID NO: 17155 - protein, 13 aa, Neisseria
KCMETDGKGAPSG

SEQ ID NO: 17156 - protein, 9 aa, Neisseria
IAEDGGKLT

SEQ ID NO: 17157 - protein, 8 aa, Neisseria
YQAGKSGY

SEQ ID NO: 17158 - protein, 5 aa, Neisseria
IDSEG

SEQ ID NO: 17159 - protein, 7 aa, Neisseria
YFRRRHY

SEQ ID NO: 17160 - protein, 13 aa, Neisseria
LTGKHPNDLEAVV

SEQ ID NO: 17161 - protein, 10 aa, Neisseria
KCMETDGKGA

SEQ ID NO: 17162 - protein, 8 aa, Neisseria
IAEDGGKL

SEQ ID NO: 17163 - protein, 6 aa, Neisseria
QAGKSG

SEQ ID NO: 17164 - protein, 5 aa, Neisseria
IDSEG

SEQ ID NO: 17165 - protein, 6 aa, Neisseria
FRRRHY

SEQ ID NO: 17166 - protein, 11 aa, Neisseria
PKQTVRQIQAV

SEQ ID NO: 17167 - protein, 9 aa, Neisseria
ISHIDRTQG

SEQ ID NO: 17168 - protein, 6 aa, Neisseria
CSGMIQ

SEQ ID NO: 17169 - protein, 6 aa, Neisseria
RTARDM

SEQ ID NO: 17170 - protein, 8 aa, Neisseria
SGKTIKTE

SEQ ID NO: 17171 - protein, 7 aa, Neisseria
FPPDKTL

SEQ ID NO: 17172 - protein, 17 aa, Neisseria
GTTSGKHRQPKPKQTVR

SEQ ID NO: 17173 - protein, 10 aa, Neisseria
SHIDRTQGSQ

SEQ ID NO: 17174 - protein, 10 aa, Neisseria
TPYKWGGSST

SEQ ID NO: 17175 - protein, 24 aa, Neisseria
KLPRTARDMAAASRKIPDSRLKAG

SEQ ID NO: 17176 - protein, 8 aa, Neisseria
TGGAHRYS

SEQ ID NO: 17177 - protein, 13 aa, Neisseria
PSSGKTIKTEKLS

SEQ ID NO: 17178 - protein, 14 aa, Neisseria
TSGKHRQPKPKQTV

SEQ ID NO: 17179 - protein, 10 aa, Neisseria
SHIDRTQGSQ

SEQ ID NO: 17180 - protein, 24 aa, Neisseria
KLPRTARDMAAASRKIPDSRLKAG

SEQ ID NO: 17181 - protein, 12 aa, Neisseria
SSGKTIKTEKLS

SEQ ID NO: 17182 - protein, 12 aa, Neisseria
VGNGVDEFGRGA

SEQ ID NO: 17183 - protein, 5 aa, Neisseria
QFERA

SEQ ID NO: 17184 - protein, 10 aa, Neisseria
IEGFDKINPA

SEQ ID NO: 17185 - protein, 30 aa, Neisseria; identical to SEQ ID NO: 3193

SEQ ID NO: 17186 - protein, 7 aa, Neisseria
GASGRAA

SEQ ID NO: 17187 - protein, 6 aa, Neisseria
GEDDVV

SEQ ID NO: 17188 - protein, 9 aa, Neisseria
GFDKINPAV

SEQ ID NO: 17189 - protein, 23 aa, Neisseria
RYHPKLHDGNQNGKRHGKLHHRA

SEQ ID NO: 17190 - protein, 5 aa, Neisseria
CQSAG

SEQ ID NO: 17191 - protein, 7 aa, Neisseria
LGGRNGT

SEQ ID NO: 17192 - protein, 17 aa, Neisseria
GVDEFGRGADNQVEFLE

SEQ ID NO: 17193 - protein, 6 aa, Neisseria
GEDDVV

SEQ ID NO: 17194 - protein, 6 aa, Neisseria
GFDKIN

SEQ ID NO: 17195 - protein, 20 aa, Neisseria
YHPKLHDGNQNGKRHGKLHH

SEQ ID NO: 17196 - protein, 9 aa, Neisseria
WNGIPDIRT

SEQ ID NO: 17197 - protein, 9 aa, Neisseria
DQTIRKHAH

SEQ ID NO: 17198 - protein, 6 aa, Neisseria
FQTAQD

SEQ ID NO: 17199 - protein, 13 aa, Neisseria
CLQFDSINLIEHI

SEQ ID NO: 17200 - protein, 7 aa, Neisseria
TRRLHEH

SEQ ID NO: 17201 - protein, 5 aa, Neisseria
RLLGH

SEQ ID NO: 17202 - protein, 16 aa, Neisseria
HNHLYRSITQAEAEKI

SEQ ID NO: 17203 - protein, 8 aa, Neisseria
YAEPLCGL

SEQ ID NO: 17204 - protein, 7 aa, Neisseria
WNEAEEA

SEQ ID NO: 17205 - protein, 5 aa, Neisseria
DSPDH

SEQ ID NO: 17206 - protein, 15 aa, Neisseria
PLVGALGDIAAMQQT

SEQ ID NO: 17207 - protein, 12 aa, Neisseria
AYANTAHGTRGL

SEQ ID NO: 17208 - protein, 5 aa, Neisseria
ILGLP

SEQ ID NO: 17209 - protein, 7 aa, Neisseria
PLSKRLR

SEQ ID NO: 17210 - protein, 17 aa, Neisseria
PDIRTLDQTIRKHAHPL

SEQ ID NO: 17211 - protein, 8 aa, Neisseria
PDNQIPNF

SEQ ID NO: 17212 - protein, 18 aa, Neisseria
TAQDASDAECRLKHRLDQ

SEQ ID NO: 17213 - protein, 10 aa, Neisseria
PPSRTRRLHE

SEQ ID NO: 17214 - protein, 13 aa, Neisseria
AIPQTESKPDKPW

SEQ ID NO: 17215 - protein, 12 aa, Neisseria
LPQTSERQKPEH

SEQ ID NO: 17216 - protein, 8 aa, Neisseria
LEARKAAQ

SEQ ID NO: 17217 - protein, 6 aa, Neisseria
SGNRQG

SEQ ID NO: 17218 - protein, 11 aa, Neisseria
KISPHDTEQTE

SEQ ID NO: 17219 - protein, 6 aa, Neisseria
GYGYTK

SEQ ID NO: 17220 - protein, 11 aa, Neisseria
LPESETWGGNG

SEQ ID NO: 17221 - protein, 15 aa, Neisseria
NYSRTEQQRNHELGL

SEQ ID NO: 17222 - protein, 6 aa, Neisseria
KHHNHL

SEQ ID NO: 17223 - protein, 10 aa, Neisseria
ITQAEAEKIA

SEQ ID NO: 17224 - protein, 6 aa, Neisseria
LNTPYA

SEQ ID NO: 17225 - protein, 7 aa, Neisseria
LHEDTPL

SEQ ID NO: 17226 - protein, 10 aa, Neisseria
DISHDGEKWI

SEQ ID NO: 17227 - protein, 9 aa, Neisseria
TGANSPYLP

SEQ ID NO: 17228 - protein, 20 aa, Neisseria
RQIRGQTGLTPSTPFSEQLR

SEQ ID NO: 17229 - protein, 5 aa, Neisseria
PSWHG

SEQ ID NO: 17230 - protein, 18 aa, Neisseria
NSSHTGWNEAEEASNRQA

SEQ ID NO: 17231 - protein, 9 aa, Neisseria
NPNPQKHQG

SEQ ID NO: 17232 - protein, 10 aa, Neisseria
IRCDSPDHLP

SEQ ID NO: 17233 - protein, 10 aa, Neisseria
ALDKNYRIDA

SEQ ID NO: 17234 - protein, 8 aa, Neisseria
AHGTRGLA

SEQ ID NO: 17235 - protein, 9 aa, Neisseria
HPLSKRLRH

SEQ ID NO: 17236 - protein, 6 aa, Neisseria
HPNRAI

SEQ ID NO: 17237 - protein, 9 aa, Neisseria
IVRRKDLTP

SEQ ID NO: 17238 - protein, 14 aa, Neisseria
PDIRTLDQTIRKHA

SEQ ID NO: 17239 - protein, 16 aa, Neisseria
QDASDAECRLKHRLDQ

SEQ ID NO: 17240 - protein, 8 aa, Neisseria
SRTRRLHE

SEQ ID NO: 17241 - protein, 11 aa, Neisseria
AIPQTESKPDK

SEQ ID NO: 17242 - protein, 10 aa, Neisseria
QTSERQKPEH

SEQ ID NO: 17243 - protein, 8 aa, Neisseria
LEARKAAQ

SEQ ID NO: 17244 - protein, 9 aa, Neisseria
SPHDTEQTE

SEQ ID NO: 17245 - protein, 5 aa, Neisseria
PESET

SEQ ID NO: 17246 - protein, 10 aa, Neisseria
SRTEQQRNHE

SEQ ID NO: 17247 - protein, 9 aa, Neisseria
TQAEAEKIA

SEQ ID NO: 17248 - protein, 7 aa, Neisseria
LHEDTPL

SEQ ID NO: 17249 - protein, 9 aa, Neisseria
ISHDGEKWI

SEQ ID NO: 17250 - protein, 5 aa, Neisseria
RQIRG

SEQ ID NO: 17251 - protein, 11 aa, Neisseria
NEAEEASNRQA

SEQ ID NO: 17252 - protein, 7 aa, Neisseria
NPQKHQG

SEQ ID NO: 17253 - protein, 7 aa, Neisseria
IRCDSPD

SEQ ID NO: 17254 - protein, 7 aa, Neisseria
KNYRIDA

SEQ ID NO: 17255 - protein, 7 aa, Neisseria
LSKRLRH

SEQ ID NO: 17256 - protein, 9 aa, Neisseria
IVRRKDLTP

SEQ ID NO: 17257 - protein, 7 aa, Neisseria
CKLFVLI

SEQ ID NO: 17258 - protein, 11 aa, Neisseria
VTRGGKGGESV

SEQ ID NO: 17259 - protein, 6 aa, Neisseria
FSQTLD

SEQ ID NO: 17260 - protein, 8 aa, Neisseria
KVQRGGDV

SEQ ID NO: 17261 - protein, 10 aa, Neisseria
TKSGAKSASK

SEQ ID NO: 17262 - protein, 9 aa, Neisseria
LQSDSRQPI

SEQ ID NO: 17263 - protein, 20 aa, Neisseria
IEADQGSLDQANQSTTFSGN

SEQ ID NO: 17264 - protein, 35 aa, Neisseria; identical to SEQ ID NO: 3262

SEQ ID NO: 17265 - protein, 13 aa, Neisseria
GNAKVQRGGDVAE

SEQ ID NO: 17266 - protein, 7 aa, Neisseria
YNTKTEV

SEQ ID NO: 17267 - protein, 18 aa, Neisseria
GSTKSGAKSASKSGRVSV

SEQ ID NO: 17268 - protein, 9 aa, Neisseria
QPSSTQKSE

SEQ ID NO: 17269 - protein, 7 aa, Neisseria
SDSRQPI

SEQ ID NO: 17270 - protein, 12 aa, Neisseria
IEADQGSLDQAN

SEQ ID NO: 17271 - protein, 15 aa, Neisseria
RGGKGGESVRAEGSP

SEQ ID NO: 17272 - protein, 12 aa, Neisseria
LDGGKGTVRGQA

SEQ ID NO: 17273 - protein, 11 aa, Neisseria
AKVQRGGDVAE

SEQ ID NO: 17274 - protein, 15 aa, Neisseria
GSTKSGAKSASKSGR

SEQ ID NO: 17275 - protein, 6 aa, Neisseria
STQKSE

SEQ ID NO: 17276 - protein, 9 aa, Neisseria
SLSAWLGRI

SEQ ID NO: 17277 - protein, 10 aa, Neisseria
SSKGAKQFPE

SEQ ID NO: 17278 - protein, 6 aa, Neisseria
VRWRYG

SEQ ID NO: 17279 - protein, 36 aa, Neisseria; identical to SEQ ID NO: 3277

SEQ ID NO: 17280 - protein, 23 aa, Neisseria
HLSSKGAKQFPESSDIHFDSPHL

SEQ ID NO: 17281 - protein, 17 aa, Neisseria
VGSDEAVYHTENKQVLF

SEQ ID NO: 17282 - protein, 32 aa, Neisseria; identical to SEQ ID NO: 3280

SEQ ID NO: 17283 - protein, 16 aa, Neisseria
ASHGQAGGMTYDHKTG

SEQ ID NO: 17284 - protein, 6 aa, Neisseria
FSSKVK

SEQ ID NO: 17285 - protein, 7 aa, Neisseria
IYDTKDM

SEQ ID NO: 17286 - protein, 18 aa, Neisseria
ISEVEIEEVRLNPDEPQY

SEQ ID NO: 17287 - protein, 10 aa, Neisseria
DGLDGRRFDE

SEQ ID NO: 17288 - protein, 18 aa, Neisseria
HLSSKGAKQFPESSDIHF

SEQ ID NO: 17289 - protein, 8 aa, Neisseria
VGSDEAVY

SEQ ID NO: 17290 - protein, 7 aa, Neisseria
TENKQVL

SEQ ID NO: 17291 - protein, 26 aa, Neisseria
KTADGKRQAGKVEAEKLHVDTESQYA

SEQ ID NO: 17292 - protein, 5 aa, Neisseria
YDHKT

SEQ ID NO: 17293 - protein, 7 aa, Neisseria
IYDTKDM

SEQ ID NO: 17294 - protein, 11 aa, Neisseria
AEGLREIAADL

SEQ ID NO: 17295 - protein, 5 aa, Neisseria
RKMAA

SEQ ID NO: 17296 - protein, 7 aa, Neisseria
LGDALAV

SEQ ID NO: 17297 - protein, 6 aa, Neisseria
VADIMH

SEQ ID NO: 17298 - protein, 7 aa, Neisseria
LGTPLKE

SEQ ID NO: 17299 - protein, 6 aa, Neisseria
GRLKGV

SEQ ID NO: 17300 - protein, 18 aa, Neisseria
GDLRRLFQECDNFTGLSI

SEQ ID NO: 17301 - protein, 10 aa, Neisseria
MHTHPKTISA

SEQ ID NO: 17302 - protein, 6 aa, Neisseria
KVMQAN

SEQ ID NO: 17303 - protein, 11 aa, Neisseria
AGNEKYLDWAR

SEQ ID NO: 17304 - protein, 18 aa, Neisseria
VLHTEAEGLREIAADLDE

SEQ ID NO: 17305 - protein, 5 aa, Neisseria
CKGRV

SEQ ID NO: 17306 - protein, 13 aa, Neisseria
GMGKSGHIGRKMA

SEQ ID NO: 17307 - protein, 7 aa, Neisseria
EAAHGDL

SEQ ID NO: 17308 - protein, 5 aa, Neisseria
VDNDV

SEQ ID NO: 17309 - protein, 9 aa, Neisseria
SNSGESDEI

SEQ ID NO: 17310 - protein, 7 aa, Neisseria
ALKRKDI

SEQ ID NO: 17311 - protein, 13 aa, Neisseria
TARPDSTMARHAD

SEQ ID NO: 17312 - protein, 7 aa, Neisseria
VSKEACP

SEQ ID NO: 17313 - protein, 9 aa, Neisseria
RAFTPDDFA

SEQ ID NO: 17314 - protein, 8 aa, Neisseria
HPAGSLGK

SEQ ID NO: 17315 - protein, 11 aa, Neisseria
DIMHKGGGLPA

SEQ ID NO: 17316 - protein, 9 aa, Neisseria
LGTPLKEAI

SEQ ID NO: 17317 - protein, 6 aa, Neisseria
MSEKGL

SEQ ID NO: 17318 - protein, 10 aa, Neisseria
VTDGQGRLKG

SEQ ID NO: 17319 - protein, 17 aa, Neisseria
FTDGDLRRLFQECDNFT

SEQ ID NO: 17320 - protein, 16 aa, Neisseria
HPKTISAERLATEALK

SEQ ID NO: 17321 - protein, 5 aa, Neisseria
TDADG

SEQ ID NO: 17322 - protein, 10 aa, Neisseria
GNEKYLDWAR

SEQ ID NO: 17323 - protein, 18 aa, Neisseria
VLHTEAEGLREIAADLDE

SEQ ID NO: 17324 - protein, 5 aa, Neisseria
CKGRV

SEQ ID NO: 17325 - protein, 8 aa, Neisseria
GHIGRKMA

SEQ ID NO: 17326 - protein, 8 aa, Neisseria
NSGESDEI

SEQ ID NO: 17327 - protein, 7 aa, Neisseria
ALKRKDI

SEQ ID NO: 17328 - protein, 12 aa, Neisseria
ARPDSTMARHAD

SEQ ID NO: 17329 - protein, 6 aa, Neisseria
VSKEAC

SEQ ID NO: 17330 - protein, 9 aa, Neisseria
RAFTPDDFA

SEQ ID NO: 17331 - protein, 7 aa, Neisseria
TPLKEAI

SEQ ID NO: 17332 - protein, 6 aa, Neisseria
MSEKGL

SEQ ID NO: 17333 - protein, 7 aa, Neisseria
DGQGRLK

SEQ ID NO: 17334 - protein, 12 aa, Neisseria
GDLRRLFQECDN

SEQ ID NO: 17335 - protein, 14 aa, Neisseria
KTISAERLATEALK

SEQ ID NO: 17336 - protein, 5 aa, Neisseria
TDADG

SEQ ID NO: 17337 - protein, 7 aa, Neisseria
AKVVSTM

SEQ ID NO: 17338 - protein, 7 aa, Neisseria
AMDEIHS

SEQ ID NO: 17339 - protein, 20 aa, Neisseria
ARSWWRNLHGAFGTWVSLIL

SEQ ID NO: 17340 - protein, 13 aa, Neisseria
WGGKFVQAWSQFP

SEQ ID NO: 17341 - protein, 24 aa, Neisseria
  VARIANT 15: Xaa is any amino acid
DEPMTLETVDRFARXNRFQRALSA

SEQ ID NO: 17342 - protein, 9 aa, Neisseria
STMPRNQGW

SEQ ID NO: 17343 - protein, 5 aa, Neisseria
GSTGD

SEQ ID NO: 17344 - protein, 8 aa, Neisseria
VKRRGIKA

SEQ ID NO: 17345 - protein, 12 aa, Neisseria
LLPPKGRARSWW

SEQ ID NO: 17346 - protein, 5 aa, Neisseria
HGAFG

SEQ ID NO: 17347 - protein, 12 aa, Neisseria
PAGKWGVEPNPV

SEQ ID NO: 17348 - protein, 9 aa, Neisseria
VLNDGKVKE

SEQ ID NO: 17349 - protein, 14 aa, Neisseria
TVGKDGINPDEPMT

SEQ ID NO: 17350 - protein, 14 aa, Neisseria
  VARIANT 9: Xaa is any amino acid
ETVDRFARXNRFQR

SEQ ID NO: 17351 - protein, 11 aa, Neisseria
FAQRRGRRMDF

SEQ ID NO: 17352 - protein, 6 aa, Neisseria
KRRGIK

SEQ ID NO: 17353 - protein, 5 aa, Neisseria
PKGRA

SEQ ID NO: 17354 - protein, 9 aa, Neisseria
VLNDGKVKE

SEQ ID NO: 17355 - protein, 14 aa, Neisseria
TVGKDGINPDEPMT

SEQ ID NO: 17356 - protein, 14 aa, Neisseria
  VARIANT 9: Xaa is any amino acid
ETVDRFARXNRFQR

SEQ ID NO: 17357 - protein, 11 aa, Neisseria
FAQRRGRRMDF

SEQ ID NO: 17358 - protein, 7 aa, Neisseria
LADELTN

SEQ ID NO: 17359 - protein, 5 aa, Neisseria
ILRQF

SEQ ID NO: 17360 - protein, 5 aa, Neisseria
NAMGL

SEQ ID NO: 17361 - protein, 7 aa, Neisseria
FMQHIFK

SEQ ID NO: 17362 - protein, 13 aa, Neisseria
  VARIANT 5: Xaa is any amino acid
GDMVXFRTLGGSR

SEQ ID NO: 17363 - protein, 5 aa, Neisseria
TGKNI

SEQ ID NO: 17364 - protein, 7 aa, Neisseria
ALADELT

SEQ ID NO: 17365 - protein, 7 aa, Neisseria
SSREQIL

SEQ ID NO: 17366 - protein, 8 aa, Neisseria
FAEDEQPV

SEQ ID NO: 17367 - protein, 15 aa, Neisseria
  VARIANT 3: Xaa is any amino acid
NRXPARRAGNADELI

SEQ ID NO: 17368 - protein, 7 aa, Neisseria
GLNEQPV

SEQ ID NO: 17369 - protein, 13 aa, Neisseria
  VARIANT (1)...(14): Xaa is any amino acid
NRXPARRAGNADX

SEQ ID NO: 17370 - protein, 7 aa, Neisseria
GLNEQPV

SEQ ID NO: 17371 - protein, 15 aa, Neisseria
NRVPARRAGNADELI

SEQ ID NO: 17372 - protein, 7 aa, Neisseria
GLNEQPV

SEQ ID NO: 17373 - protein, 17 aa, Neisseria
PVNRAPARRAGNADELI

SEQ ID NO: 17374 - protein, 7 aa, Neisseria
TGFDCSG

SEQ ID NO: 17375 - protein, 11 aa, Neisseria
LPRTSAEQARM

SEQ ID NO: 17376 - protein, 15 aa, Neisseria
  VARIANT 15: Xaa is any amino acid
TPVARSELQPGDMVX

SEQ ID NO: 17377 - protein, 7 aa, Neisseria
TLGGSRI

SEQ ID NO: 17378 - protein, 10 aa, Neisseria
HAPRTGKNIE

SEQ ID NO: 17379 - protein, 10 aa, Neisseria
SLSHKYWSGK

SEQ ID NO: 17380 - protein, 11 aa, Neisseria
RRVKKNDPSRF

SEQ ID NO: 17381 - protein, 7 aa, Neisseria
ALADELT

SEQ ID NO: 17382 - protein, 7 aa, Neisseria
SSREQIL

SEQ ID NO: 17383 - protein, 7 aa, Neisseria
FAEDEQP

SEQ ID NO: 17384 - protein, 14 aa, Neisseria
  VARIANT 2: Xaa is any amino acid
RXPARRAGNADELI

SEQ ID NO: 17385 - protein, 10 aa, Neisseria
  VARIANT 2: Xaa is any amino acid
RXPARRAGNA

SEQ ID NO: 17386 - protein, 13 aa, Neisseria
VPARRAGNADELI

SEQ ID NO: 17387 - protein, 14 aa, Neisseria
RAPARRAGNADELI

SEQ ID NO: 17388 - protein, 9 aa, Neisseria
RTSAEQARM

SEQ ID NO: 17389 - protein, 8 aa, Neisseria
VARSELQP

SEQ ID NO: 17390 - protein, 7 aa, Neisseria
RTGKNIE

SEQ ID NO: 17391 - protein, 10 aa, Neisseria
RRVKKNDPSR

SEQ ID NO: 17392 - protein, 6 aa, Neisseria
LIAYLK

SEQ ID NO: 17393 - protein, 9 aa, Neisseria
AAQFIDFWL

SEQ ID NO: 17394 - protein, 11 aa, Neisseria
QLAGSVTGIVT

SEQ ID NO: 17395 - protein, 10 aa, Neisseria
RSIGGIPAIT

SEQ ID NO: 17396 - protein, 11 aa, Neisseria
AGLVGQIAGYK

SEQ ID NO: 17397 - protein, 5 aa, Neisseria
ERSRR

SEQ ID NO: 17398 - protein, 7 aa, Neisseria
EILRQPS

SEQ ID NO: 17399 - protein, 8 aa, Neisseria
VRTRTGNI

SEQ ID NO: 17400 - protein, 7 aa, Neisseria
YQNRRKI

SEQ ID NO: 17401 - protein, 6 aa, Neisseria
GAEREV

SEQ ID NO: 17402 - protein, 6 aa, Neisseria
SKSVTN

SEQ ID NO: 17403 - protein, 7 aa, Neisseria
ITRSIGG

SEQ ID NO: 17404 - protein, 7 aa, Neisseria
KMLKNTV

SEQ ID NO: 17405 - protein, 9 aa, Neisseria
SLERSRRMA

SEQ ID NO: 17406 - protein, 5 aa, Neisseria
VRTRT

SEQ ID NO: 17407 - protein, 6 aa, Neisseria
QNRRKI

SEQ ID NO: 17408 - protein, 6 aa, Neisseria
GAEREV

SEQ ID NO: 17409 - protein, 9 aa, Neisseria
SLERSRRMA

SEQ ID NO: 17410 - protein, 9 aa, Neisseria
GVLFALLQA

SEQ ID NO: 17411 - protein, 8 aa, Neisseria
LQQLTDAL

SEQ ID NO: 17412 - protein, 14 aa, Neisseria
VISYLDLIADDWFS

SEQ ID NO: 17413 - protein, 10 aa, Neisseria
EVKEAVQAVE

SEQ ID NO: 17414 - protein, 22 aa, Neisseria
AASAAESAASAVEEAKDQVKDA

SEQ ID NO: 17415 - protein, 29 aa, Neisseria
EAVTEAAKDTLNKAADATQEAADKMKDAA

SEQ ID NO: 17416 - protein, 13 aa, Neisseria
SQEAKQEVKEAVQ

SEQ ID NO: 17417 - protein, 76 aa, Neisseria; identical to SEQ ID NO: 3477

SEQ ID NO: 17418 - protein, 5 aa, Neisseria
EKYRT

SEQ ID NO: 17419 - protein, 6 aa, Neisseria
DHSINN

SEQ ID NO: 17420 - protein, 5 aa, Neisseria
IQNEQ

SEQ ID NO: 17421 - protein, 5 aa, Neisseria
QSLLQ

SEQ ID NO: 17422 - protein, 6 aa, Neisseria
LKQGAK

SEQ ID NO: 17423 - protein, 6 aa, Neisseria
QIKQII

SEQ ID NO: 17424 - protein, 9 aa, Neisseria
FVEEIRDQF

SEQ ID NO: 17425 - protein, 7 aa, Neisseria
QNLVNLV

SEQ ID NO: 17426 - protein, 15 aa, Neisseria
AEQLIRLTQVNRTIR

SEQ ID NO: 17427 - protein, 5 aa, Neisseria
FIAQV

SEQ ID NO: 17428 - protein, 7 aa, Neisseria
DLQKFYN

SEQ ID NO: 17429 - protein, 13 aa, Neisseria
EVKNAFEERVARL

SEQ ID NO: 17430 - protein, 6 aa, Neisseria
VADFNK

SEQ ID NO: 17431 - protein, 13 aa, Neisseria
DDAFNHPSSLAEA

SEQ ID NO: 17432 - protein, 11 aa, Neisseria
SGMPENLINAV

SEQ ID NO: 17433 - protein, 5 aa, Neisseria
LNGGK

SEQ ID NO: 17434 - protein, 6 aa, Neisseria
EAYAEL

SEQ ID NO: 17435 - protein, 9 aa, Neisseria
VRLIGLPAP

SEQ ID NO: 17436 - protein, 12 aa, Neisseria
EVQAVTPPDDIA

SEQ ID NO: 17437 - protein, 7 aa, Neisseria
LLIRYFN

SEQ ID NO: 17438 - protein, 9 aa, Neisseria
SIEKYRTPA

SEQ ID NO: 17439 - protein, 6 aa, Neisseria
SHPGAD

SEQ ID NO: 17440 - protein, 11 aa, Neisseria
VGDEKISDHSI

SEQ ID NO: 17441 - protein, 16 aa, Neisseria
IQNEQADGGGPSRDAV

SEQ ID NO: 17442 - protein, 6 aa, Neisseria
YLKQGA

SEQ ID NO: 17443 - protein, 7 aa, Neisseria
VSSEQIK

SEQ ID NO: 17444 - protein, 15 aa, Neisseria
IVDDPNFHDANGKFD

SEQ ID NO: 17445 - protein, 18 aa, Neisseria
YLSQRHMSEDQFVEEIRD

SEQ ID NO: 17446 - protein, 16 aa, Neisseria
QVNRTIRSHTFNPDEF

SEQ ID NO: 17447 - protein, 7 aa, Neisseria
KVSEADL

SEQ ID NO: 17448 - protein, 9 aa, Neisseria
YNANKKDYL

SEQ ID NO: 17449 - protein, 23 aa, Neisseria
DFADKQTVSETEVKNAFEERVAR

SEQ ID NO: 17450 - protein, 78 aa, Neisseria; identical to SEQ ID NO: 3512

SEQ ID NO: 17451 - protein, 13 aa, Neisseria
FSDDVLKKKHNSE

SEQ ID NO: 17452 - protein, 12 aa, Neisseria
RAKEVREEKTLP

SEQ ID NO: 17453 - protein, 8 aa, Neisseria
AEAKDAVR

SEQ ID NO: 17454 - protein, 19 aa, Neisseria
AYIRTEAAKLAENKAKDVL

SEQ ID NO: 17455 - protein, 7 aa, Neisseria
NGGKAVD

SEQ ID NO: 17456 - protein, 12 aa, Neisseria
QQARQSMPPEAY

SEQ ID NO: 17457 - protein, 11 aa, Neisseria
LKAKPANGKPA

SEQ ID NO: 17458 - protein, 9 aa, Neisseria
AVTPPDDIA

SEQ ID NO: 17459 - protein, 11 aa, Neisseria
ALAQQQSANTF

SEQ ID NO: 17460 - protein, 20 aa, Neisseria
FNGKIKQTKGAQSVDNGDGQ

SEQ ID NO: 17461 - protein, 5 aa, Neisseria
EKYRT

SEQ ID NO: 17462 - protein, 8 aa, Neisseria
VGDEKISD

SEQ ID NO: 17463 - protein, 16 aa, Neisseria
IQNEQADGGGPSRDAV

SEQ ID NO: 17464 - protein, 7 aa, Neisseria
VSSEQIK

SEQ ID NO: 17465 - protein, 7 aa, Neisseria
IVDDPNF

SEQ ID NO: 17466 - protein, 6 aa, Neisseria
ANGKFD

SEQ ID NO: 17467 - protein, 14 aa, Neisseria
RHMSEDQFVEEIRD

SEQ ID NO: 17468 - protein, 7 aa, Neisseria
KVSEADL

SEQ ID NO: 17469 - protein, 8 aa, Neisseria
NANKKDYL

SEQ ID NO: 17470 - protein, 23 aa, Neisseria
DFADKQTVSETEVKNAFEERVAR

SEQ ID NO: 17471 - protein, 42 aa, Neisseria
PANEAKPSFEQEKAAVENELKMKKAVADFNKAKEKLGDDAFN

SEQ ID NO: 17472 - protein, 17 aa, Neisseria
SLAEAAKNSGLKVETQE

SEQ ID NO: 17473 - protein, 9 aa, Neisseria
WLSRQDAQM

SEQ ID NO: 17474 - protein, 9 aa, Neisseria
DVLKKKHNS

SEQ ID NO: 17475 - protein, 12 aa, Neisseria
RAKEVREEKTLP

SEQ ID NO: 17476 - protein, 8 aa, Neisseria
AEAKDAVR

SEQ ID NO: 17477 - protein, 19 aa, Neisseria
AYIRTEAAKLAENKAKDVL

SEQ ID NO: 17478 - protein, 8 aa, Neisseria
QQARQSMP

SEQ ID NO: 17479 - protein, 8 aa, Neisseria
LKAKPANG

SEQ ID NO: 17480 - protein, 7 aa, Neisseria
TPPDDIA

SEQ ID NO: 17481 - protein, 17 aa, Neisseria
KIKQTKGAQSVDNGDGQ

SEQ ID NO: 17482 - protein, 11 aa, Neisseria
INRPYQKPAEL

SEQ ID NO: 17483 - protein, 7 aa, Neisseria
RIFSFPQ

SEQ ID NO: 17484 - protein, 10 aa, Neisseria
AVDNVKGVAV

SEQ ID NO: 17485 - protein, 11 aa, Neisseria
AVAGFRRCSAA

SEQ ID NO: 17486 - protein, 9 aa, Neisseria
LAAVPRITQ

SEQ ID NO: 17487 - protein, 9 aa, Neisseria
KPFHDFFNL

SEQ ID NO: 17488 - protein, 16 aa, Neisseria
MSKRKSINRPYQKPAE

SEQ ID NO: 17489 - protein, 17 aa, Neisseria
PPLQNNPPFYRKNRRLN

SEQ ID NO: 17490 - protein, 17 aa, Neisseria
ADGGCASPQKCRARGFQ

SEQ ID NO: 17491 - protein, 9 aa, Neisseria
PAVRPRRLR

SEQ ID NO: 17492 - protein, 6 aa, Neisseria
MPRRPV

SEQ ID NO: 17493 - protein, 7 aa, Neisseria
FADRNLR

SEQ ID NO: 17494 - protein, 6 aa, Neisseria
EHADAD

SEQ ID NO: 17495 - protein, 8 aa, Neisseria
AFRRRAQV

SEQ ID NO: 17496 - protein, 5 aa, Neisseria
ARTRA

SEQ ID NO: 17497 - protein, 10 aa, Neisseria
RRVDIRHPDF

SEQ ID NO: 17498 - protein, 5 aa, Neisseria
DNVKG

SEQ ID NO: 17499 - protein, 14 aa, Neisseria
GFRRCSAAGGRVGT

SEQ ID NO: 17500 - protein, 20 aa, Neisseria
VPCRAEYVEYGNRRPHRLAA

SEQ ID NO: 17501 - protein, 15 aa, Neisseria
ITQRTQKRQGDGKPF

SEQ ID NO: 17502 - protein, 7 aa, Neisseria
MPMPSEH

SEQ ID NO: 17503 - protein, 8 aa, Neisseria
MSKRKSIN

SEQ ID NO: 17504 - protein, 7 aa, Neisseria
PYQKPAE

SEQ ID NO: 17505 - protein, 7 aa, Neisseria
FYRKNRR

SEQ ID NO: 17506 - protein, 9 aa, Neisseria
SPQKCRARG

SEQ ID NO: 17507 - protein, 7 aa, Neisseria
VRPRRLR

SEQ ID NO: 17508 - protein, 5 aa, Neisseria
PRRPV

SEQ ID NO: 17509 - protein, 7 aa, Neisseria
FADRNLR

SEQ ID NO: 17510 - protein, 6 aa, Neisseria
EHADAD

SEQ ID NO: 17511 - protein, 8 aa, Neisseria
AFRRRAQV

SEQ ID NO: 17512 - protein, 5 aa, Neisseria
ARTRA

SEQ ID NO: 17513 - protein, 7 aa, Neisseria
RRVDIRH

SEQ ID NO: 17514 - protein, 14 aa, Neisseria
GFRRCSAAGGRVGT

SEQ ID NO: 17515 - protein, 7 aa, Neisseria
VPCRAEY

SEQ ID NO: 17516 - protein, 9 aa, Neisseria
EYGNRRPHR

SEQ ID NO: 17517 - protein, 15 aa, Neisseria
ITQRTQKRQGDGKPF

SEQ ID NO: 17518 - protein, 10 aa, Neisseria
QFLGAFNDNV

SEQ ID NO: 17519 - protein, 5 aa, Neisseria
GQMLN

SEQ ID NO: 17520 - protein, 27 aa, Neisseria
SLSGQLGNKFDKAVLARWAKVLEMIIM

SEQ ID NO: 17521 - protein, 8 aa, Neisseria
TLFGPLKY

SEQ ID NO: 17522 - protein, 5 aa, Neisseria
AILFG

SEQ ID NO: 17523 - protein, 17 aa, Neisseria
LGTAVAGVPPYIVGILV

SEQ ID NO: 17524 - protein, 10 aa, Neisseria
VRGTKSLLRE

SEQ ID NO: 17525 - protein, 6 aa, Neisseria
LPTFTQ

SEQ ID NO: 17526 - protein, 6 aa, Neisseria
RFEGLN

SEQ ID NO: 17527 - protein, 21 aa, Neisseria
AVMTLIGFFGGFFSVPLYTWL

SEQ ID NO: 17528 - protein, 16 aa, Neisseria
MYAKKGGLGLVKSRRF

SEQ ID NO: 17529 - protein, 11 aa, Neisseria
LSGQLGNKFDK

SEQ ID NO: 17530 - protein, 10 aa, Neisseria
DYLDDKELMM

SEQ ID NO: 17531 - protein, 10 aa, Neisseria
VPAKAADTQI

SEQ ID NO: 17532 - protein, 15 aa, Neisseria
RGTKSLLRETVRHKP

SEQ ID NO: 17533 - protein, 8 aa, Neisseria
HLGGNDNV

SEQ ID NO: 17534 - protein, 8 aa, Neisseria
KFSRERLR

SEQ ID NO: 17535 - protein, 7 aa, Neisseria
HGHRFEG

SEQ ID NO: 17536 - protein, 10 aa, Neisseria
ASSETFRARA

SEQ ID NO: 17537 - protein, 8 aa, Neisseria
IKRERRFL

SEQ ID NO: 17538 - protein, 6 aa, Neisseria
AIRKKP

SEQ ID NO: 17539 - protein, 6 aa, Neisseria
YAKKGG

SEQ ID NO: 17540 - protein, 6 aa, Neisseria
VKSRRF

SEQ ID NO: 17541 - protein, 5 aa, Neisseria
NKFDK

SEQ ID NO: 17542 - protein, 8 aa, Neisseria
YLDDKELM

SEQ ID NO: 17543 - protein, 9 aa, Neisseria
PAKAADTQI

SEQ ID NO: 17544 - protein, 13 aa, Neisseria
RGTKSLLRETVRH

SEQ ID NO: 17545 - protein, 8 aa, Neisseria
KFSRERLR

SEQ ID NO: 17546 - protein, 5 aa, Neisseria
HRFEG

SEQ ID NO: 17547 - protein, 7 aa, Neisseria
ETFRARA

SEQ ID NO: 17548 - protein, 8 aa, Neisseria
IKRERRFL

SEQ ID NO: 17549 - protein, 6 aa, Neisseria
AIRKKP

SEQ ID NO: 17550 - protein, 7 aa, Neisseria
FADKVQT

SEQ ID NO: 17551 - protein, 7 aa, Neisseria
QVRVWKN

SEQ ID NO: 17552 - protein, 9 aa, Neisseria
NGVAKLLET

SEQ ID NO: 17553 - protein, 12 aa, Neisseria
ALTRLIEQAGNA

SEQ ID NO: 17554 - protein, 13 aa, Neisseria
PVADTLKCADGGN

SEQ ID NO: 17555 - protein, 10 aa, Neisseria
AAENLDGITD

SEQ ID NO: 17556 - protein, 6 aa, Neisseria
MKRKNI

SEQ ID NO: 17557 - protein, 20 aa, Neisseria
ARFGADKPKQYVEIGSKTVL

SEQ ID NO: 17558 - protein, 7 aa, Neisseria
ERHEAVD

SEQ ID NO: 17559 - protein, 11 aa, Neisseria
SPEDTFADKVQ

SEQ ID NO: 17560 - protein, 16 aa, Neisseria
WKNGGQTRAETVRNGV

SEQ ID NO: 17561 - protein, 5 aa, Neisseria
AETDN

SEQ ID NO: 17562 - protein, 5 aa, Neisseria
DAARC

SEQ ID NO: 17563 - protein, 6 aa, Neisseria
LPSEAL

SEQ ID NO: 17564 - protein, 12 aa, Neisseria
LIEQAGNAAEGG

SEQ ID NO: 17565 - protein, 11 aa, Neisseria
DTLKCADGGNI

SEQ ID NO: 17566 - protein, 7 aa, Neisseria
TVERTSL

SEQ ID NO: 17567 - protein, 18 aa, Neisseria
ENLDGITDEASAVEKLGI

SEQ ID NO: 17568 - protein, 15 aa, Neisseria
GDARNLKLTQPQDAY

SEQ ID NO: 17569 - protein, 6 aa, Neisseria
MKRKNI

SEQ ID NO: 17570 - protein, 10 aa, Neisseria
FGADKPKQYV

SEQ ID NO: 17571 - protein, 7 aa, Neisseria
ERHEAVD

SEQ ID NO: 17572 - protein, 11 aa, Neisseria
SPEDTFADKVQ

SEQ ID NO: 17573 - protein, 9 aa, Neisseria
GQTRAETVR

SEQ ID NO: 17574 - protein, 5 aa, Neisseria
AETDN

SEQ ID NO: 17575 - protein, 6 aa, Neisseria
AGNAAE

SEQ ID NO: 17576 - protein, 7 aa, Neisseria
DTLKCAD

SEQ ID NO: 17577 - protein, 18 aa, Neisseria
ENLDGITDEASAVEKLGI

SEQ ID NO: 17578 - protein, 7 aa, Neisseria
GDARNLK

SEQ ID NO: 17579 - protein, 10 aa, Neisseria
RSLEVEKVAS

SEQ ID NO: 17580 - protein, 6 aa, Neisseria
DRLGSQ

SEQ ID NO: 17581 - protein, 13 aa, Neisseria
QQTNRFNVLNRTN

SEQ ID NO: 17582 - protein, 6 aa, Neisseria
GDVTEF

SEQ ID NO: 17583 - protein, 10 aa, Neisseria
AVNSLVQAVD

SEQ ID NO: 17584 - protein, 15 aa, Neisseria
ATESSRSLEVEKVAS

SEQ ID NO: 17585 - protein, 8 aa, Neisseria
TFDNRSSF

SEQ ID NO: 17586 - protein, 13 aa, Neisseria
IFSDGEDRLGSQA

SEQ ID NO: 17587 - protein, 13 aa, Neisseria
QQTNRFNVLNRTN

SEQ ID NO: 17588 - protein, 19 aa, Neisseria
LKQESGISGKAHNLKGADY

SEQ ID NO: 17589 - protein, 13 aa, Neisseria
GDVTEFGRRDVGD

SEQ ID NO: 17590 - protein, 8 aa, Neisseria
LGRGKSQI

SEQ ID NO: 17591 - protein, 5 aa, Neisseria
NTSEI

SEQ ID NO: 17592 - protein, 5 aa, Neisseria
QGAGE

SEQ ID NO: 17593 - protein, 7 aa, Neisseria
ALSNREI

SEQ ID NO: 17594 - protein, 15 aa, Neisseria
GGTSGYDATLNGKVL

SEQ ID NO: 17595 - protein, 10 aa, Neisseria
VDNGAWQPNR

SEQ ID NO: 17596 - protein, 14 aa, Neisseria
ATESSRSLEVEKVA

SEQ ID NO: 17597 - protein, 7 aa, Neisseria
FDNRSSF

SEQ ID NO: 17598 - protein, 13 aa, Neisseria
IFSDGEDRLGSQA

SEQ ID NO: 17599 - protein, 13 aa, Neisseria
LKQESGISGKAHN

SEQ ID NO: 17600 - protein, 12 aa, Neisseria
DVTEFGRRDVGD

SEQ ID NO: 17601 - protein, 5 aa, Neisseria
GRGKS

SEQ ID NO: 17602 - protein, 6 aa, Neisseria
LSNREI

SEQ ID NO: 17603 - protein, 7 aa, Neisseria
LAAVLAL

SEQ ID NO: 17604 - protein, 7 aa, Neisseria
QVQKAPD

SEQ ID NO: 17605 - protein, 7 aa, Neisseria
LTNAADI

SEQ ID NO: 17606 - protein, 10 aa, Neisseria
VRPEKLHQIF

SEQ ID NO: 17607 - protein, 10 aa, Neisseria
SYQILDSVTT

SEQ ID NO: 17608 - protein, 16 aa, Neisseria
GALVSAVVNQIANSLT

SEQ ID NO: 17609 - protein, 12 aa, Neisseria
SKTAAYNLLSPY

SEQ ID NO: 17610 - protein, 17 aa, Neisseria
QKAPDFDYTSFKESKPA

SEQ ID NO: 17611 - protein, 11 aa, Neisseria
PLNESPDVNGT

SEQ ID NO: 17612 - protein, 5 aa, Neisseria
APLSE

SEQ ID NO: 17613 - protein, 10 aa, Neisseria
ETFKQNGLTN

SEQ ID NO: 17614 - protein, 8 aa, Neisseria
HAVRPEKL

SEQ ID NO: 17615 - protein, 31 aa, Neisseria; identical to SEQ ID NO: 3675

SEQ ID NO: 17616 - protein, 13 aa, Neisseria
SLTDRGYQVSKTA

SEQ ID NO: 17617 - protein, 14 aa, Neisseria
GILKGPRFVEEQPK

SEQ ID NO: 17618 - protein, 7 aa, Neisseria
QKAPDFD

SEQ ID NO: 17619 - protein, 7 aa, Neisseria
SFKESKP

SEQ ID NO: 17620 - protein, 7 aa, Neisseria
LNESPDV

SEQ ID NO: 17621 - protein, 8 aa, Neisseria
HAVRPEKL

SEQ ID NO: 17622 - protein, 16 aa, Neisseria
SAKARLVDSRNGKELW

SEQ ID NO: 17623 - protein, 10 aa, Neisseria
ASIREGSNNS

SEQ ID NO: 17624 - protein, 7 aa, Neisseria
LTDRGYQ

SEQ ID NO: 17625 - protein, 9 aa, Neisseria
PRFVEEQPK

SEQ ID NO: 17626 - protein, 9 aa, Neisseria
LCTAFADGF

SEQ ID NO: 17627 - protein, 10 aa, Neisseria
FAGFADCRPF

SEQ ID NO: 17628 - protein, 11 aa, Neisseria
ADDVPRFFAGE

SEQ ID NO: 17629 - protein, 8 aa, Neisseria
RDVVQGGL

SEQ ID NO: 17630 - protein, 7 aa, Neisseria
VEGITRI

SEQ ID NO: 17631 - protein, 14 aa, Neisseria
IRLLHGIFNRIEVA

SEQ ID NO: 17632 - protein, 8 aa, Neisseria
VADGFRHF

SEQ ID NO: 17633 - protein, 8 aa, Neisseria
GFSGNGKF

SEQ ID NO: 17634 - protein, 8 aa, Neisseria
RHQQSKAQ

SEQ ID NO: 17635 - protein, 18 aa, Neisseria
FFRRGNFGFGLQGRTDGF

SEQ ID NO: 17636 - protein, 8 aa, Neisseria
QRLDGGGY

SEQ ID NO: 17637 - protein, 8 aa, Neisseria
GFADCRPF

SEQ ID NO: 17638 - protein, 12 aa, Neisseria
VDGRELVPSMEK

SEQ ID NO: 17639 - protein, 6 aa, Neisseria
AADDVP

SEQ ID NO: 17640 - protein, 21 aa, Neisseria
EAQNRCNQENQAARDVVQGGL

SEQ ID NO: 17641 - protein, 15 aa, Neisseria
IEVERAQVFRAERNH

SEQ ID NO: 17642 - protein, 8 aa, Neisseria
GKVEGITR

SEQ ID NO: 17643 - protein, 8 aa, Neisseria
KITGNAFL

SEQ ID NO: 17644 - protein, 7 aa, Neisseria
GKQKAQG

SEQ ID NO: 17645 - protein, 13 aa, Neisseria
IGGCRPQAQDVRA

SEQ ID NO: 17646 - protein, 10 aa, Neisseria
FLRRDDVADG

SEQ ID NO: 17647 - protein, 5 aa, Neisseria
GRTDG

SEQ ID NO: 17648 - protein, 7 aa, Neisseria
QRLDGGG

SEQ ID NO: 17649 - protein, 11 aa, Neisseria
DGRELVPSMEK

SEQ ID NO: 17650 - protein, 6 aa, Neisseria
AADDVP

SEQ ID NO: 17651 - protein, 16 aa, Neisseria
AQNRCNQENQAARDVV

SEQ ID NO: 17652 - protein, 15 aa, Neisseria
IEVERAQVFRAERNH

SEQ ID NO: 17653 - protein, 7 aa, Neisseria
KVEGITR

SEQ ID NO: 17654 - protein, 7 aa, Neisseria
GKQKAQG

SEQ ID NO: 17655 - protein, 10 aa, Neisseria
CRPQAQDVRA

SEQ ID NO: 17656 - protein, 9 aa, Neisseria
LRRDDVADG

SEQ ID NO: 17657 - protein, 7 aa, Neisseria
FRLIQSC

SEQ ID NO: 17658 - protein, 6 aa, Neisseria
NAHRKQ

SEQ ID NO: 17659 - protein, 10 aa, Neisseria
PGFNALPAIF

SEQ ID NO: 17660 - protein, 5 aa, Neisseria
SSNEW

SEQ ID NO: 17661 - protein, 10 aa, Neisseria
FCATICASLR

SEQ ID NO: 17662 - protein, 9 aa, Neisseria
GIARNRRME

SEQ ID NO: 17663 - protein, 15 aa, Neisseria
CRRPDRFVVRQTRLL

SEQ ID NO: 17664 - protein, 8 aa, Neisseria
IQSCEVEP

SEQ ID NO: 17665 - protein, 16 aa, Neisseria
HNGKSGNAHRKQQKEI

SEQ ID NO: 17666 - protein, 11 aa, Neisseria
PAVRSATRKTA

SEQ ID NO: 17667 - protein, 10 aa, Neisseria
FRGGSGKSAS

SEQ ID NO: 17668 - protein, 9 aa, Neisseria
AAQRGRGAC

SEQ ID NO: 17669 - protein, 7 aa, Neisseria
RSSNEWK

SEQ ID NO: 17670 - protein, 28 aa, Neisseria
TAKRPPSFRRHMTCGNTAPTSSSSRLIK

SEQ ID NO: 17671 - protein, 12 aa, Neisseria
VAGSCPRSRVRT

SEQ ID NO: 17672 - protein, 8 aa, Neisseria
WRLNRSSP

SEQ ID NO: 17673 - protein, 9 aa, Neisseria
GIARNRRME

SEQ ID NO: 17674 - protein, 12 aa, Neisseria
RRPDRFVVRQTR

SEQ ID NO: 17675 - protein, 15 aa, Neisseria
NGKSGNAHRKQQKEI

SEQ ID NO: 17676 - protein, 9 aa, Neisseria
VRSATRKTA

SEQ ID NO: 17677 - protein, 7 aa, Neisseria
GSGKSAS

SEQ ID NO: 17678 - protein, 7 aa, Neisseria
QRGRGAC

SEQ ID NO: 17679 - protein, 6 aa, Neisseria
SSNEWK

SEQ ID NO: 17680 - protein, 12 aa, Neisseria
TAKRPPSFRRHM

SEQ ID NO: 17681 - protein, 8 aa, Neisseria
SSSSRLIK

SEQ ID NO: 17682 - protein, 10 aa, Neisseria
GSCPRSRVRT

SEQ ID NO: 17683 - protein, 5 aa, Neisseria
NRSSP

SEQ ID NO: 17684 - protein, 8 aa, Neisseria
ADVGRFLH

SEQ ID NO: 17685 - protein, 7 aa, Neisseria
IQCLRNH

SEQ ID NO: 17686 - protein, 8 aa, Neisseria
APLFAVCP

SEQ ID NO: 17687 - protein, 13 aa, Neisseria
QGEDFPRAGIQNH

SEQ ID NO: 17688 - protein, 15 aa, Neisseria
VFRGFIARGVQAVHN

SEQ ID NO: 17689 - protein, 6 aa, Neisseria
FKRKFQ

SEQ ID NO: 17690 - protein, 9 aa, Neisseria
GTETRRQFA

SEQ ID NO: 17691 - protein, 11 aa, Neisseria
IAHGRRSDFIR

SEQ ID NO: 17692 - protein, 13 aa, Neisseria
RNHKRFDCRTGFD

SEQ ID NO: 17693 - protein, 23 aa, Neisseria
VGGRIGQGEDFPRAGIQNHHRSG

SEQ ID NO: 17694 - protein, 13 aa, Neisseria
QGLNPLIEGKDDV

SEQ ID NO: 17695 - protein, 7 aa, Neisseria
VPQNDFR

SEQ ID NO: 17696 - protein, 6 aa, Neisseria
VFKRKF

SEQ ID NO: 17697 - protein, 10 aa, Neisseria
NIGKSDDVCK

SEQ ID NO: 17698 - protein, 8 aa, Neisseria
TETRRQFA

SEQ ID NO: 17699 - protein, 9 aa, Neisseria
HGRRSDFIR

SEQ ID NO: 17700 - protein, 8 aa, Neisseria
RNHKRFDC

SEQ ID NO: 17701 - protein, 9 aa, Neisseria
IGQGEDFPR

SEQ ID NO: 17702 - protein, 7 aa, Neisseria
IEGKDDV

SEQ ID NO: 17703 - protein, 6 aa, Neisseria
VFKRKF

SEQ ID NO: 17704 - protein, 8 aa, Neisseria
GKSDDVCK

SEQ ID NO: 17705 - protein, 6 aa, Neisseria
TRAAKH

SEQ ID NO: 17706 - protein, 10 aa, Neisseria
THTPHEPASS

SEQ ID NO: 17707 - protein, 10 aa, Neisseria
KMPSEMEQTL

SEQ ID NO: 17708 - protein, 15 aa, Neisseria
FLIGCIAHTFNRSLK

SEQ ID NO: 17709 - protein, 10 aa, Neisseria
FHACQRMVAV

SEQ ID NO: 17710 - protein, 12 aa, Neisseria
HIDRIAGILTVQ

SEQ ID NO: 17711 - protein, 11 aa, Neisseria
FVQKLIVGIIH

SEQ ID NO: 17712 - protein, 17 aa, Neisseria
MPTRPTRAAKHPTPPTW

SEQ ID NO: 17713 - protein, 36 aa, Neisseria
CPRPPYRPPSVQTHTPHEPASSTCAAKSANRRENFH

SEQ ID NO: 17714 - protein, 26 aa, Neisseria
PSNKMPSEMEQTLFRRHQIPPSCRQS

SEQ ID NO: 17715 - protein, 8 aa, Neisseria
NRSLKADF

SEQ ID NO: 17716 - protein, 7 aa, Neisseria
TIDDNIA

SEQ ID NO: 17717 - protein, 9 aa, Neisseria
FDFNREHAR

SEQ ID NO: 17718 - protein, 6 aa, Neisseria
FNTDQL

SEQ ID NO: 17719 - protein, 13 aa, Neisseria
RIVGRKRHIDRIA

SEQ ID NO: 17720 - protein, 7 aa, Neisseria
FHQRENA

SEQ ID NO: 17721 - protein, 5 aa, Neisseria
RNHGI

SEQ ID NO: 17722 - protein, 13 aa, Neisseria
DSHICPFRNSRLI

SEQ ID NO: 17723 - protein, 13 aa, Neisseria
MPTRPTRAAKHPT

SEQ ID NO: 17724 - protein, 7 aa, Neisseria
TPHEPAS

SEQ ID NO: 17725 - protein, 13 aa, Neisseria
CAAKSANRRENFH

SEQ ID NO: 17726 - protein, 13 aa, Neisseria
NKMPSEMEQTLFR

SEQ ID NO: 17727 - protein, 7 aa, Neisseria
RSLKADF

SEQ ID NO: 17728 - protein, 9 aa, Neisseria
FDFNREHAR

SEQ ID NO: 17729 - protein, 13 aa, Neisseria
RIVGRKRHIDRIA

SEQ ID NO: 17730 - protein, 7 aa, Neisseria
FHQRENA

SEQ ID NO: 17731 - protein, 12 aa, Neisseria
  VARIANT 5: Xaa is any amino acid
PEVAXQFVDFVE

SEQ ID NO: 17732 - protein, 11 aa, Neisseria
GFCHILQNLTG

SEQ ID NO: 17733 - protein, 11 aa, Neisseria
NPFFDFFQAVV

SEQ ID NO: 17734 - protein, 9 aa, Neisseria
HQSGFGDVF

SEQ ID NO: 17735 - protein, 5 aa, Neisseria
FEQGV

SEQ ID NO: 17736 - protein, 10 aa, Neisseria
FGHTRLFDIC

SEQ ID NO: 17737 - protein, 15 aa, Neisseria
HPFADFGNFQNLLAL

SEQ ID NO: 17738 - protein, 10 aa, Neisseria
HFEQRAGGIA

SEQ ID NO: 17739 - protein, 5 aa, Neisseria
TGHGA

SEQ ID NO: 17740 - protein, 20 aa, Neisseria
SHADIFPPRCFGDGFAQRGF

SEQ ID NO: 17741 - protein, 10 aa, Neisseria
WRADQAQNRA

SEQ ID NO: 17742 - protein, 5 aa, Neisseria
HQSGF

SEQ ID NO: 17743 - protein, 9 aa, Neisseria
LPRQFEQGV

SEQ ID NO: 17744 - protein, 13 aa, Neisseria
AYDGGFGRHRRHH

SEQ ID NO: 17745 - protein, 7 aa, Neisseria
MRCDRIG

SEQ ID NO: 17746 - protein, 9 aa, Neisseria
HFEQRAGGI

SEQ ID NO: 17747 - protein, 10 aa, Neisseria
WRADQAQNRA

SEQ ID NO: 17748 - protein, 6 aa, Neisseria
QFEQGV

SEQ ID NO: 17749 - protein, 9 aa, Neisseria
GFGRHRRHH

SEQ ID NO: 17750 - protein, 7 aa, Neisseria
MRCDRIG

SEQ ID NO: 17751 - protein, 5 aa, Neisseria
IFSML

SEQ ID NO: 17752 - protein, 21 aa, Neisseria
ITRLARKAVQRLTASHIQRFL

SEQ ID NO: 17753 - protein, 11 aa, Neisseria
DSSRITSTISS

SEQ ID NO: 17754 - protein, 6 aa, Neisseria
LPSNAP

SEQ ID NO: 17755 - protein, 8 aa, Neisseria
RLARKAVQ

SEQ ID NO: 17756 - protein, 17 aa, Neisseria
LTESKTGANKSSSSCKP

SEQ ID NO: 17757 - protein, 8 aa, Neisseria
SASDSSRI

SEQ ID NO: 17758 - protein, 9 aa, Neisseria
STTGAVTKS

SEQ ID NO: 17759 - protein, 8 aa, Neisseria
RLARKAVQ

SEQ ID NO: 17760 - protein, 16 aa, Neisseria
LTESKTGANKSSSSCK

SEQ ID NO: 17761 - protein, 7 aa, Neisseria
ASDSSRI

SEQ ID NO: 17762 - protein, 6 aa, Neisseria
IAALLR

SEQ ID NO: 17763 - protein, 13 aa, Neisseria
NALQEINQIIPQT

SEQ ID NO: 17764 - protein, 9 aa, Neisseria
FACHRLHRL

SEQ ID NO: 17765 - protein, 8 aa, Neisseria
KCFLQLVQ

SEQ ID NO: 17766 - protein, 5 aa, Neisseria
HLHAH

SEQ ID NO: 17767 - protein, 9 aa, Neisseria
ISRLCGSLF

SEQ ID NO: 17768 - protein, 9 aa, Neisseria
CLDGFHRLH

SEQ ID NO: 17769 - protein, 5 aa, Neisseria
NRFFT

SEQ ID NO: 17770 - protein, 15 aa, Neisseria
YPRKIRTFSRNFKQR

SEQ ID NO: 17771 - protein, 12 aa, Neisseria
MPSEARQAGSDG

SEQ ID NO: 17772 - protein, 6 aa, Neisseria
VYTQNA

SEQ ID NO: 17773 - protein, 5 aa, Neisseria
QTPSG

SEQ ID NO: 17774 - protein, 9 aa, Neisseria
HRNHSRAQH

SEQ ID NO: 17775 - protein, 5 aa, Neisseria
MDIRI

SEQ ID NO: 17776 - protein, 7 aa, Neisseria
FRIDFLD

SEQ ID NO: 17777 - protein, 5 aa, Neisseria
IQKRH

SEQ ID NO: 17778 - protein, 17 aa, Neisseria
LDRQHFHGKLLSGELVR

SEQ ID NO: 17779 - protein, 7 aa, Neisseria
QLGNPRL

SEQ ID NO: 17780 - protein, 40 aa, Neisseria
LKTNWKSKSSYYPRKIRTFSRNFKQRQRISNSFSNPLPKK

SEQ ID NO: 17781 - protein, 12 aa, Neisseria
MPSEARQAGSDG

SEQ ID NO: 17782 - protein, 7 aa, Neisseria
NHSRAQH

SEQ ID NO: 17783 - protein, 5 aa, Neisseria
MDIRI

SEQ ID NO: 17784 - protein, 7 aa, Neisseria
FRIDFLD

SEQ ID NO: 17785 - protein, 7 aa, Neisseria
TNWKSKS

SEQ ID NO: 17786 - protein, 16 aa, Neisseria
RKIRTFSRNFKQRQRI

SEQ ID NO: 17787 - protein, 9 aa, Neisseria
AVNIAQCFT

SEQ ID NO: 17788 - protein, 15 aa, Neisseria
RCAEVLVEQFANLFF

SEQ ID NO: 17789 - protein, 5 aa, Neisseria
DMGRF

SEQ ID NO: 17790 - protein, 20 aa, Neisseria
FGCDDVVDDFAGFGRCFRPV

SEQ ID NO: 17791 - protein, 8 aa, Neisseria
QLGQVFFQ

SEQ ID NO: 17792 - protein, 9 aa, Neisseria
MHGRNGGTQ

SEQ ID NO: 17793 - protein, 21 aa, Neisseria
QTQRTCFSNGEVHATQTDIGS

SEQ ID NO: 17794 - protein, 9 aa, Neisseria
DCGHHDMGR

SEQ ID NO: 17795 - protein, 6 aa, Neisseria
LDDELA

SEQ ID NO: 17796 - protein, 17 aa, Neisseria
GCDDVVDDFAGFGRCFR

SEQ ID NO: 17797 - protein, 8 aa, Neisseria
QQGRQFRQ

SEQ ID NO: 17798 - protein, 7 aa, Neisseria
MHGRNGG

SEQ ID NO: 17799 - protein, 6 aa, Neisseria
LDDELA

SEQ ID NO: 17800 - protein, 5 aa, Neisseria
DVVDD

SEQ ID NO: 17801 - protein, 5 aa, Neisseria
RQFRQ

SEQ ID NO: 17802 - protein, 20 aa, Neisseria
VVSSCSKIAKPGKKISTLQE

SEQ ID NO: 17803 - protein, 5 aa, Neisseria
FDSST

SEQ ID NO: 17804 - protein, 9 aa, Neisseria
ESTDIKYPG

SEQ ID NO: 17805 - protein, 8 aa, Neisseria
IDDLDASA

SEQ ID NO: 17806 - protein, 20 aa, Neisseria
SCSKIAKPGKKISTLQEAKS

SEQ ID NO: 17807 - protein, 16 aa, Neisseria
ITNDDKQNGNITRQRH

SEQ ID NO: 17808 - protein, 7 aa, Neisseria
IAGEEGL

SEQ ID NO: 17809 - protein, 11 aa, Neisseria
FQLDDKGKWGN

SEQ ID NO: 17810 - protein, 7 aa, Neisseria
KKIRHMK

SEQ ID NO: 17811 - protein, 27 aa, Neisseria
SDCPEDDDAGKEEKFKYTGTFDSSTNA

SEQ ID NO: 17812 - protein, 14 aa, Neisseria
SGTDTKIAASSDNH

SEQ ID NO: 17813 - protein, 14 aa, Neisseria
ATIRGGNVCANRTL

SEQ ID NO: 17814 - protein, 6 aa, Neisseria
ESTDIK

SEQ ID NO: 17815 - protein, 8 aa, Neisseria
IDDLDASA

SEQ ID NO: 17816 - protein, 12 aa, Neisseria
SKIAKPGKKIST

SEQ ID NO: 17817 - protein, 5 aa, Neisseria
QEAKS

SEQ ID NO: 17818 - protein, 15 aa, Neisseria
TNDDKQNGNITRQRH

SEQ ID NO: 17819 - protein, 7 aa, Neisseria
IAGEEGL

SEQ ID NO: 17820 - protein, 9 aa, Neisseria
QLDDKGKWG

SEQ ID NO: 17821 - protein, 7 aa, Neisseria
KKIRHMK

SEQ ID NO: 17822 - protein, 16 aa, Neisseria
DCPEDDDAGKEEKFKY

SEQ ID NO: 17823 - protein, 5 aa, Neisseria
FDSST

SEQ ID NO: 17824 - protein, 11 aa, Neisseria
GTDTKIAASSD

SEQ ID NO: 17825 - protein, 7 aa, Neisseria
ENCGKGL

SEQ ID NO: 17826 - protein, 6 aa, Neisseria
VEAVKR

SEQ ID NO: 17827 - protein, 13 aa, Neisseria
TQSVSKMPRYIIE

SEQ ID NO: 17828 - protein, 14 aa, Neisseria
ENVYRVTAKAWGKN

SEQ ID NO: 17829 - protein, 8 aa, Neisseria
MRKQNTLT

SEQ ID NO: 17830 - protein, 8 aa, Neisseria
PTSDGQRG

SEQ ID NO: 17831 - protein, 19 aa, Neisseria
QSYNTEQRISANESDRKLA

SEQ ID NO: 17832 - protein, 9 aa, Neisseria
AALREGELQ

SEQ ID NO: 17833 - protein, 19 aa, Neisseria
LEYDTDSKVTFSENCGKGL

SEQ ID NO: 17834 - protein, 12 aa, Neisseria
NVRTNNDNEEAF

SEQ ID NO: 17835 - protein, 20 aa, Neisseria
QGKPTVEAVKRSCTAKSTGL

SEQ ID NO: 17836 - protein, 21 aa, Neisseria
IDNKGMEYKKGTQSVSKMPRY

SEQ ID NO: 17837 - protein, 10 aa, Neisseria
LGVKNGENVY

SEQ ID NO: 17838 - protein, 8 aa, Neisseria
AWGKNANT

SEQ ID NO: 17839 - protein, 6 aa, Neisseria
VSNNDE

SEQ ID NO: 17840 - protein, 6 aa, Neisseria
MRKQNT

SEQ ID NO: 17841 - protein, 7 aa, Neisseria
PTSDGQR

SEQ ID NO: 17842 - protein, 17 aa, Neisseria
YNTEQRISANESDRKLA

SEQ ID NO: 17843 - protein, 9 aa, Neisseria
AALREGELQ

SEQ ID NO: 17844 - protein, 11 aa, Neisseria
LEYDTDSKVTF

SEQ ID NO: 17845 - protein, 10 aa, Neisseria
RTNNDNEEAF

SEQ ID NO: 17846 - protein, 14 aa, Neisseria
PTVEAVKRSCTAKS

SEQ ID NO: 17847 - protein, 19 aa, Neisseria
IDNKGMEYKKGTQSVSKMP

SEQ ID NO: 17848 - protein, 7 aa, Neisseria
KNGENVY

SEQ ID NO: 17849 - protein, 5 aa, Neisseria
SNNDE

SEQ ID NO: 17850 - protein, 5 aa, Neisseria
CFRLK

SEQ ID NO: 17851 - protein, 9 aa, Neisseria
GMALIEVLV

SEQ ID NO: 17852 - protein, 8 aa, Neisseria
TVASVREA

SEQ ID NO: 17853 - protein, 14 aa, Neisseria
TIVSQITQNLMEGM

SEQ ID NO: 17854 - protein, 15 aa, Neisseria
MKNNDCFRLKNPQSG

SEQ ID NO: 17855 - protein, 8 aa, Neisseria
ASVREAET

SEQ ID NO: 17856 - protein, 12 aa, Neisseria
PTIDSDSNKKNY

SEQ ID NO: 17857 - protein, 6 aa, Neisseria
VDGDFQ

SEQ ID NO: 17858 - protein, 9 aa, Neisseria
AIKTKTQLA

SEQ ID NO: 17859 - protein, 9 aa, Neisseria
VCKDSSGVA

SEQ ID NO: 17860 - protein, 12 aa, Neisseria
SNCDGSANGDTL

SEQ ID NO: 17861 - protein, 19 aa, Neisseria
DSAGDSDIARTNLETNGNN

SEQ ID NO: 17862 - protein, 7 aa, Neisseria
ARVGGRE

SEQ ID NO: 17863 - protein, 13 aa, Neisseria
MKNNDCFRLKNPQ

SEQ ID NO: 17864 - protein, 8 aa, Neisseria
ASVREAET

SEQ ID NO: 17865 - protein, 9 aa, Neisseria
IDSDSNKKN

SEQ ID NO: 17866 - protein, 6 aa, Neisseria
VDGDFQ

SEQ ID NO: 17867 - protein, 9 aa, Neisseria
AIKTKTQLA

SEQ ID NO: 17868 - protein, 7 aa, Neisseria
VCKDSSG

SEQ ID NO: 17869 - protein, 8 aa, Neisseria
NCDGSANG

SEQ ID NO: 17870 - protein, 16 aa, Neisseria
SAGDSDIARTNLETNG

SEQ ID NO: 17871 - protein, 5 aa, Neisseria
VGGRE

SEQ ID NO: 17872 - protein, 10 aa, Neisseria
RNEFIRGIKE

SEQ ID NO: 17873 - protein, 6 aa, Neisseria
FAGGSE

SEQ ID NO: 17874 - protein, 9 aa, Neisseria
ATVNLWAEP

SEQ ID NO: 17875 - protein, 15 aa, Neisseria
SSPRNEFIRGIKESS

SEQ ID NO: 17876 - protein, 9 aa, Neisseria
MQGGQKGMS

SEQ ID NO: 17877 - protein, 6 aa, Neisseria
FAGGSE

SEQ ID NO: 17878 - protein, 19 aa, Neisseria
  VARIANT 2: Xaa is any amino acid
GXGTCPAPERNTAEKSRAR

SEQ ID NO: 17879 - protein, 15 aa, Neisseria
SSPRNEFIRGIKESS

SEQ ID NO: 17880 - protein, 14 aa, Neisseria
PAPERNTAEKSRAR

SEQ ID NO: 17881 - protein, 14 aa, Neisseria
QAADLPRNHISPAY

SEQ ID NO: 17882 - protein, 5 aa, Neisseria
RRIGA

SEQ ID NO: 17883 - protein, 12 aa, Neisseria
QVVADFGGIEGF

SEQ ID NO: 17884 - protein, 13 aa, Neisseria
RTVGRTVRLLKMI

SEQ ID NO: 17885 - protein, 8 aa, Neisseria
ARTVFRAH

SEQ ID NO: 17886 - protein, 6 aa, Neisseria
LGQECR

SEQ ID NO: 17887 - protein, 18 aa, Neisseria
RHIARVESLLRVFEYAAD

SEQ ID NO: 17888 - protein, 18 aa, Neisseria
QPRADIRPPAQTDIVPNC

SEQ ID NO: 17889 - protein, 8 aa, Neisseria
DAARRAVR

SEQ ID NO: 17890 - protein, 8 aa, Neisseria
DLPRNHIS

SEQ ID NO: 17891 - protein, 9 aa, Neisseria
GGFRGRFRR

SEQ ID NO: 17892 - protein, 10 aa, Neisseria
IRVKAVKTEI

SEQ ID NO: 17893 - protein, 5 aa, Neisseria
RLVGT

SEQ ID NO: 17894 - protein, 7 aa, Neisseria
TVGRTVR

SEQ ID NO: 17895 - protein, 7 aa, Neisseria
PVVREAG

SEQ ID NO: 17896 - protein, 8 aa, Neisseria
VKHARTVF

SEQ ID NO: 17897 - protein, 19 aa, Neisseria
IKNRLGQECRNRHIARVES

SEQ ID NO: 17898 - protein, 12 aa, Neisseria
KTKTRAEQPRSA

SEQ ID NO: 17899 - protein, 10 aa, Neisseria
PRADIRPPAQ

SEQ ID NO: 17900 - protein, 8 aa, Neisseria
DAARRAVR

SEQ ID NO: 17901 - protein, 7 aa, Neisseria
FRGRFRR

SEQ ID NO: 17902 - protein, 10 aa, Neisseria
IRVKAVKTEI

SEQ ID NO: 17903 - protein, 7 aa, Neisseria
TVGRTVR

SEQ ID NO: 17904 - protein, 7 aa, Neisseria
PVVREAG

SEQ ID NO: 17905 - protein, 8 aa, Neisseria
VKHARTVF

SEQ ID NO: 17906 - protein, 17 aa, Neisseria
NRLGQECRNRHIARVES

SEQ ID NO: 17907 - protein, 9 aa, Neisseria
TKTRAEQPR

SEQ ID NO: 17908 - protein, 7 aa, Neisseria
RFNTYSH

SEQ ID NO: 17909 - protein, 7 aa, Neisseria
GHGDGYR

SEQ ID NO: 17910 - protein, 7 aa, Neisseria
KLKSILK

SEQ ID NO: 17911 - protein, 11 aa, Neisseria
VLAVMKSLTAS

SEQ ID NO: 17912 - protein, 10 aa, Neisseria
YTGERFNTYS

SEQ ID NO: 17913 - protein, 7 aa, Neisseria
GHGDGYR

SEQ ID NO: 17914 - protein, 12 aa, Neisseria
GKLKSILKKTDH

SEQ ID NO: 17915 - protein, 7 aa, Neisseria
SLRNGPG

SEQ ID NO: 17916 - protein, 11 aa, Neisseria
TIGRKSEKRLL

SEQ ID NO: 17917 - protein, 10 aa, Neisseria
NDEKIRHGHG

SEQ ID NO: 17918 - protein, 12 aa, Neisseria
GKLKSILKKTDH

SEQ ID NO: 17919 - protein, 11 aa, Neisseria
TIGRKSEKRLL

SEQ ID NO: 17920 - protein, 7 aa, Neisseria
NDEKIRH

SEQ ID NO: 17921 - protein, 18 aa, Neisseria
VKTCADFHAFDGVDAHHG

SEQ ID NO: 17922 - protein, 7 aa, Neisseria
GIQGFAH

SEQ ID NO: 17923 - protein, 5 aa, Neisseria
AGGGF

SEQ ID NO: 17924 - protein, 6 aa, Neisseria
GVGDFG

SEQ ID NO: 17925 - protein, 9 aa, Neisseria
AQADGDVGG

SEQ ID NO: 17926 - protein, 7 aa, Neisseria
LRADGIQ

SEQ ID NO: 17927 - protein, 8 aa, Neisseria
VGGKKRIL

SEQ ID NO: 17928 - protein, 9 aa, Neisseria
GNVGGDFRA

SEQ ID NO: 17929 - protein, 11 aa, Neisseria
FFGNGSGGNAG

SEQ ID NO: 17930 - protein, 5 aa, Neisseria
GGTPA

SEQ ID NO: 17931 - protein, 5 aa, Neisseria
ADGDV

SEQ ID NO: 17932 - protein, 5 aa, Neisseria
LRADG

SEQ ID NO: 17933 - protein, 7 aa, Neisseria
GGKKRIL

SEQ ID NO: 17934 - protein, 5 aa, Neisseria
GDFRA

SEQ ID NO: 17935 - protein, 13 aa, Neisseria
GVVVHFRSCGGVA

SEQ ID NO: 17936 - protein, 8 aa, Neisseria
RYREIYAV

SEQ ID NO: 17937 - protein, 10 aa, Neisseria
NALAKYLGEQ

SEQ ID NO: 17938 - protein, 10 aa, Neisseria
RFDSGITRLL

SEQ ID NO: 17939 - protein, 9 aa, Neisseria
RSLQGFQTA

SEQ ID NO: 17940 - protein, 20 aa, Neisseria
AAGCKTLGEFDDRFTAPLHG

SEQ ID NO: 17941 - protein, 15 aa, Neisseria
YYRQTSCKPLLKHVA

SEQ ID NO: 17942 - protein, 7 aa, Neisseria
PRADEVS

SEQ ID NO: 17943 - protein, 7 aa, Neisseria
TPPDTPF

SEQ ID NO: 17944 - protein, 10 aa, Neisseria
LRNGNADTIA

SEQ ID NO: 17945 - protein, 35 aa, Neisseria
FLQRSAPAYRRELLPDSTGKTKTAYDFSDGISPDA

SEQ ID NO: 17946 - protein, 7 aa, Neisseria
LEGGSGS

SEQ ID NO: 17947 - protein, 8 aa, Neisseria
AVRDRGWN

SEQ ID NO: 17948 - protein, 7 aa, Neisseria
SCGGVAN

SEQ ID NO: 17949 - protein, 5 aa, Neisseria
GDTAE

SEQ ID NO: 17950 - protein, 7 aa, Neisseria
LAARYRE

SEQ ID NO: 17951 - protein, 9 aa, Neisseria
LGEQGENAL

SEQ ID NO: 17952 - protein, 14 aa, Neisseria
VDAEAAGNRFDSGI

SEQ ID NO: 17953 - protein, 9 aa, Neisseria
LIPKARSLQ

SEQ ID NO: 17954 - protein, 10 aa, Neisseria
TLGEFDDRFT

SEQ ID NO: 17955 - protein, 17 aa, Neisseria
FADRHDYYRQTSCKPLL

SEQ ID NO: 17956 - protein, 16 aa, Neisseria
PFLPPEALPRADEVSE

SEQ ID NO: 17957 - protein, 6 aa, Neisseria
STGGRL

SEQ ID NO: 17958 - protein, 8 aa, Neisseria
DSFRTNRR

SEQ ID NO: 17959 - protein, 11 aa, Neisseria
SAPAYRRELLP

SEQ ID NO: 17960 - protein, 7 aa, Neisseria
STGKTKT

SEQ ID NO: 17961 - protein, 6 aa, Neisseria
VRDRGW

SEQ ID NO: 17962 - protein, 7 aa, Neisseria
LAARYRE

SEQ ID NO: 17963 - protein, 9 aa, Neisseria
LGEQGENAL

SEQ ID NO: 17964 - protein, 14 aa, Neisseria
VDAEAAGNRFDSGI

SEQ ID NO: 17965 - protein, 7 aa, Neisseria
LIPKARS

SEQ ID NO: 17966 - protein, 10 aa, Neisseria
TLGEFDDRFT

SEQ ID NO: 17967 - protein, 9 aa, Neisseria
FADRHDYYR

SEQ ID NO: 17968 - protein, 10 aa, Neisseria
ALPRADEVSE

SEQ ID NO: 17969 - protein, 6 aa, Neisseria
FRTNRR

SEQ ID NO: 17970 - protein, 5 aa, Neisseria
SFLPN

SEQ ID NO: 17971 - protein, 17 aa, Neisseria
DLVNKVLAEVARLEKMF

SEQ ID NO: 17972 - protein, 17 aa, Neisseria
SPPADFLELLSLAVIFT

SEQ ID NO: 17973 - protein, 10 aa, Neisseria
MGRHFGRRRF

SEQ ID NO: 17974 - protein, 16 aa, Neisseria
AADDEKRNKDEKRNEN

SEQ ID NO: 17975 - protein, 5 aa, Neisseria
GSGAE

SEQ ID NO: 17976 - protein, 11 aa, Neisseria
GVDDRRAADLV

SEQ ID NO: 17977 - protein, 5 aa, Neisseria
ARLEK

SEQ ID NO: 17978 - protein, 23 aa, Neisseria
YREDSLISRLNRDGYLTSPPADF

SEQ ID NO: 17979 - protein, 7 aa, Neisseria
HFGRRRF

SEQ ID NO: 17980 - protein, 15 aa, Neisseria
AADDEKRNKDEKRNE

SEQ ID NO: 17981 - protein, 11 aa, Neisseria
GVDDRRAADLV

SEQ ID NO: 17982 - protein, 5 aa, Neisseria
ARLEK

SEQ ID NO: 17983 - protein, 7 aa, Neisseria
YREDSLI

SEQ ID NO: 17984 - protein, 7 aa, Neisseria
RLNRDGY

SEQ ID NO: 17985 - protein, 12 aa, Neisseria
YGRVFADIFELS

SEQ ID NO: 17986 - protein, 21 aa, Neisseria
AFKGMLKLTAEYKNIFGDACR

SEQ ID NO: 17987 - protein, 12 aa, Neisseria
NQALQEISKTSE

SEQ ID NO: 17988 - protein, 9 aa, Neisseria
KAYTEELPP

SEQ ID NO: 17989 - protein, 18 aa, Neisseria
SARSKAKAEKFYREKMIQ

SEQ ID NO: 17990 - protein, 5 aa, Neisseria
LEHKP

SEQ ID NO: 17991 - protein, 15 aa, Neisseria
KNHGKGMAEQVRFKA

SEQ ID NO: 17992 - protein, 12 aa, Neisseria
VLPDDEDARTIA

SEQ ID NO: 17993 - protein, 14 aa, Neisseria
GTDAVASGETYGRV

SEQ ID NO: 17994 - protein, 6 aa, Neisseria
LEGRAF

SEQ ID NO: 17995 - protein, 9 aa, Neisseria
DACRSETAL

SEQ ID NO: 17996 - protein, 11 aa, Neisseria
EISKTSEKSKR

SEQ ID NO: 17997 - protein, 7 aa, Neisseria
AYTEELP

SEQ ID NO: 17998 - protein, 17 aa, Neisseria
ARSKAKAEKFYREKMIQ

SEQ ID NO: 17999 - protein, 5 aa, Neisseria
LEHKP

SEQ ID NO: 18000 - protein, 14 aa, Neisseria
NHGKGMAEQVRFKA

SEQ ID NO: 18001 - protein, 12 aa, Neisseria
VLPDDEDARTIA

SEQ ID NO: 18002 - protein, 6 aa, Neisseria
LEGRAF

SEQ ID NO: 18003 - protein, 9 aa, Neisseria
DACRSETAL

SEQ ID NO: 18004 - protein, 11 aa, Neisseria
EISKTSEKSKR

SEQ ID NO: 18005 - protein, 10 aa, Neisseria
PFSSLFRALF

SEQ ID NO: 18006 - protein, 16 aa, Neisseria
FIDSVGQVAARLFQAF

SEQ ID NO: 18007 - protein, 13 aa, Neisseria
VQINQVGIVDLIP

SEQ ID NO: 18008 - protein, 17 aa, Neisseria
ATGCTGICPKCPTGCRP

SEQ ID NO: 18009 - protein, 8 aa, Neisseria
LFEDRVGI

SEQ ID NO: 18010 - protein, 7 aa, Neisseria
GAHDAAE

SEQ ID NO: 18011 - protein, 9 aa, Neisseria
DFLPEEFTR

SEQ ID NO: 18012 - protein, 14 aa, Neisseria
PAFRAREQARRGSG

SEQ ID NO: 18013 - protein, 23 aa, Neisseria
AGNDLRVPHKDAVEVDIDGGNTV

SEQ ID NO: 18014 - protein, 8 aa, Neisseria
THFDDGDA

SEQ ID NO: 18015 - protein, 5 aa, Neisseria
AEARF

SEQ ID NO: 18016 - protein, 10 aa, Neisseria
PKCPTGCRPV

SEQ ID NO: 18017 - protein, 8 aa, Neisseria
LFEDRVGI

SEQ ID NO: 18018 - protein, 7 aa, Neisseria
GAHDAAE

SEQ ID NO: 18019 - protein, 11 aa, Neisseria
FRAREQARRGS

SEQ ID NO: 18020 - protein, 17 aa, Neisseria
NDLRVPHKDAVEVDIDG

SEQ ID NO: 18021 - protein, 7 aa, Neisseria
HFDDGDA

SEQ ID NO: 18022 - protein, 5 aa, Neisseria
AEARF

SEQ ID NO: 18023 - protein, 8 aa, Neisseria
CPTGCRPV

SEQ ID NO: 18024 - protein, 5 aa, Neisseria
QIFRQ

SEQ ID NO: 18025 - protein, 9 aa, Neisseria
DTARAFAAA

SEQ ID NO: 18026 - protein, 7 aa, Neisseria
GLLADIV

SEQ ID NO: 18027 - protein, 7 aa, Neisseria
VHGFDKH

SEQ ID NO: 18028 - protein, 11 aa, Neisseria
AVYKGIRNAVF

SEQ ID NO: 18029 - protein, 7 aa, Neisseria
QGIVRNL

SEQ ID NO: 18030 - protein, 6 aa, Neisseria
DVFAPV

SEQ ID NO: 18031 - protein, 7 aa, Neisseria
CLNQAGG

SEQ ID NO: 18032 - protein, 6 aa, Neisseria
AADDAV

SEQ ID NO: 18033 - protein, 11 aa, Neisseria
HFVRQRPSLRL

SEQ ID NO: 18034 - protein, 7 aa, Neisseria
HQRRVDL

SEQ ID NO: 18035 - protein, 14 aa, Neisseria
RQIKGNVHGFDKHV

SEQ ID NO: 18036 - protein, 9 aa, Neisseria
AHARDDVPY

SEQ ID NO: 18037 - protein, 10 aa, Neisseria
NRGIEQEKRV

SEQ ID NO: 18038 - protein, 6 aa, Neisseria
SFDGGG

SEQ ID NO: 18039 - protein, 5 aa, Neisseria
RNPAG

SEQ ID NO: 18040 - protein, 7 aa, Neisseria
LESNGLD

SEQ ID NO: 18041 - protein, 17 aa, Neisseria
NQAGGRILTARKDDQGF

SEQ ID NO: 18042 - protein, 6 aa, Neisseria
AADDAV

SEQ ID NO: 18043 - protein, 9 aa, Neisseria
HFVRQRPSL

SEQ ID NO: 18044 - protein, 7 aa, Neisseria
HQRRVDL

SEQ ID NO: 18045 - protein, 6 aa, Neisseria
GFDKHV

SEQ ID NO: 18046 - protein, 7 aa, Neisseria
HARDDVP

SEQ ID NO: 18047 - protein, 9 aa, Neisseria
RGIEQEKRV

SEQ ID NO: 18048 - protein, 9 aa, Neisseria
LTARKDDQG

SEQ ID NO: 18049 - protein, 9 aa, Neisseria
NLIGVLSNA

SEQ ID NO: 18050 - protein, 19 aa, Neisseria
EALAFYQEVGKLNAANSLT

SEQ ID NO: 18051 - protein, 7 aa, Neisseria
KLATLKK

SEQ ID NO: 18052 - protein, 10 aa, Neisseria
KAARALAAGE

SEQ ID NO: 18053 - protein, 9 aa, Neisseria
LGALAAFTQ

SEQ ID NO: 18054 - protein, 9 aa, Neisseria
EELKAFFDA

SEQ ID NO: 18055 - protein, 14 aa, Neisseria
VALATLCNYVNNLG

SEQ ID NO: 18056 - protein, 13 aa, Neisseria
ETAPEAAKARVEA

SEQ ID NO: 18057 - protein, 5 aa, Neisseria
LSNAP

SEQ ID NO: 18058 - protein, 7 aa, Neisseria
ARTNQCG

SEQ ID NO: 18059 - protein, 7 aa, Neisseria
QSVKAAR

SEQ ID NO: 18060 - protein, 8 aa, Neisseria
GEFDDAKL

SEQ ID NO: 18061 - protein, 14 aa, Neisseria
MAKKGAVSDEELKA

SEQ ID NO: 18062 - protein, 9 aa, Neisseria
GQTEINPEL

SEQ ID NO: 18063 - protein, 12 aa, Neisseria
TAPEAAKARVEA

SEQ ID NO: 18064 - protein, 7 aa, Neisseria
QSVKAAR

SEQ ID NO: 18065 - protein, 8 aa, Neisseria
GEFDDAKL

SEQ ID NO: 18066 - protein, 14 aa, Neisseria
MAKKGAVSDEELKA

SEQ ID NO: 18067 - protein, 8 aa, Neisseria
VAEFTQTG

SEQ ID NO: 18068 - protein, 11 aa, Neisseria
IPSYVRVTNTK

SEQ ID NO: 18069 - protein, 7 aa, Neisseria
NRIIDVS

SEQ ID NO: 18070 - protein, 11 aa, Neisseria
LNQAAQNLASS

SEQ ID NO: 18071 - protein, 29 aa, Neisseria
AVVRAEKLHASANRSYKVAGKRYTPKNQV

SEQ ID NO: 18072 - protein, 10 aa, Neisseria
EFTQTGNASW

SEQ ID NO: 18073 - protein, 16 aa, Neisseria
GGRFHGRKTSGGERYD

SEQ ID NO: 18074 - protein, 9 aa, Neisseria
TNTKNGKSV

SEQ ID NO: 18075 - protein, 21 aa, Neisseria
RVNDRGPFHGNRIIDVSKAAA

SEQ ID NO: 18076 - protein, 16 aa, Neisseria
VPGQSAPVAENKDIFI

SEQ ID NO: 18077 - protein, 10 aa, Neisseria
LKSFGTEHEA

SEQ ID NO: 18078 - protein, 17 aa, Neisseria
SSASNPNLSVEKRRYEY

SEQ ID NO: 18079 - protein, 13 aa, Neisseria
ASQERAAEAEAQA

SEQ ID NO: 18080 - protein, 25 aa, Neisseria
AVVRAEKLHASANRSYKVAGKRYTP

SEQ ID NO: 18081 - protein, 13 aa, Neisseria
FHGRKTSGGERYD

SEQ ID NO: 18082 - protein, 7 aa, Neisseria
TNTKNGK

SEQ ID NO: 18083 - protein, 8 aa, Neisseria
VNDRGPFH

SEQ ID NO: 18084 - protein, 10 aa, Neisseria
RIIDVSKAAA

SEQ ID NO: 18085 - protein, 10 aa, Neisseria
PVAENKDIFI

SEQ ID NO: 18086 - protein, 9 aa, Neisseria
KSFGTEHEA

SEQ ID NO: 18087 - protein, 10 aa, Neisseria
LSVEKRRYEY

SEQ ID NO: 18088 - protein, 13 aa, Neisseria
ASQERAAEAEAQA

SEQ ID NO: 18089 - protein, 18 aa, Neisseria
NAFRRHRRRQCPNRKPAM

SEQ ID NO: 18090 - protein, 7 aa, Neisseria
PLKRKHF

SEQ ID NO: 18091 - protein, 12 aa, Neisseria
SRAGAVHDQGWE

SEQ ID NO: 18092 - protein, 7 aa, Neisseria
WHTRNRE

SEQ ID NO: 18093 - protein, 18 aa, Neisseria
NAFRRHRRRQCPNRKPAM

SEQ ID NO: 18094 - protein, 7 aa, Neisseria
PLKRKHF

SEQ ID NO: 18095 - protein, 7 aa, Neisseria
SRAGAVH

SEQ ID NO: 18096 - protein, 13 aa, Neisseria
DGLHKFKHICSAA

SEQ ID NO: 18097 - protein, 7 aa, Neisseria
IKEPLDK

SEQ ID NO: 18098 - protein, 9 aa, Neisseria
QEVDRVSEW

SEQ ID NO: 18099 - protein, 15 aa, Neisseria
EFEQFWKGLPQTVQN

SEQ ID NO: 18100 - protein, 11 aa, Neisseria
SQKTWKSGMDK

SEQ ID NO: 18101 - protein, 7 aa, Neisseria
ETPNGIK

SEQ ID NO: 18102 - protein, 7 aa, Neisseria
VQSRYDG

SEQ ID NO: 18103 - protein, 24 aa, Neisseria
LIKEPLDKAKQRNEELEAAEEAAA

SEQ ID NO: 18104 - protein, 25 aa, Neisseria
ALGREQEVDRVSEWEERYKLSRSEF

SEQ ID NO: 18105 - protein, 33 aa, Neisseria
VQNKLQASQKTWKSGMDKICANNAKAEGETPNG

SEQ ID NO: 18106 - protein, 40 aa, Neisseria
ELACKTAETEARLEELHNRKKALLDEMAREADKKELPKRL

SEQ ID NO: 18107 - protein, 5 aa, Neisseria
SRYDG

SEQ ID NO: 18108 - protein, 24 aa, Neisseria
LIKEPLDKAKQRNEELEAAEEAAA

SEQ ID NO: 18109 - protein, 25 aa, Neisseria
ALGREQEVDRVSEWEERYKLSRSEF

SEQ ID NO: 18110 - protein, 11 aa, Neisseria
KTWKSGMDKIC

SEQ ID NO: 18111 - protein, 10 aa, Neisseria
NAKAEGETPN

SEQ ID NO: 18112 - protein, 40 aa, Neisseria; identical to SEQ ID NO: 18106

SEQ ID NO: 18113 - protein, 7 aa, Neisseria
WDFIQNT

SEQ ID NO: 18114 - protein, 12 aa, Neisseria
FKTRALGRFSSP

SEQ ID NO: 18115 - protein, 5 aa, Neisseria
PASSA

SEQ ID NO: 18116 - protein, 7 aa, Neisseria
TASPKVS

SEQ ID NO: 18117 - protein, 12 aa, Neisseria
FKTRALGRFSSP

SEQ ID NO: 18118 - protein, 10 aa, Neisseria
LSGRGVKKPL

SEQ ID NO: 18119 - protein, 6 aa, Neisseria
QVDTSA

SEQ ID NO: 18120 - protein, 5 aa, Neisseria
ASPKV

SEQ ID NO: 18121 - protein, 7 aa, Neisseria
FKTRALG

SEQ ID NO: 18122 - protein, 7 aa, Neisseria
RGVKKPL

SEQ ID NO: 18123 - protein, 6 aa, Neisseria
DLTEGC

SEQ ID NO: 18124 - protein, 5 aa, Neisseria
PDGSR

SEQ ID NO: 18125 - protein, 6 aa, Neisseria
QPSGTW

SEQ ID NO: 18126 - protein, 7 aa, Neisseria
MNKNRKL

SEQ ID NO: 18127 - protein, 25 aa, Neisseria
DLTEGCTLPDGSRVRAAAVSTKKPF

SEQ ID NO: 18128 - protein, 7 aa, Neisseria
HAPAGTE

SEQ ID NO: 18129 - protein, 7 aa, Neisseria
KNMDMGF

SEQ ID NO: 18130 - protein, 11 aa, Neisseria
YMPHERQPSGT

SEQ ID NO: 18131 - protein, 9 aa, Neisseria
VEGRRDFTA

SEQ ID NO: 18132 - protein, 6 aa, Neisseria
IGSRTF

SEQ ID NO: 18133 - protein, 7 aa, Neisseria
MNKNRKL

SEQ ID NO: 18134 - protein, 8 aa, Neisseria
PDGSRVRA

SEQ ID NO: 18135 - protein, 6 aa, Neisseria
STKKPF

SEQ ID NO: 18136 - protein, 5 aa, Neisseria
PAGTE

SEQ ID NO: 18137 - protein, 6 aa, Neisseria
MFERQP

SEQ ID NO: 18138 - protein, 9 aa, Neisseria
VEGRRDFTA

SEQ ID NO: 18139 - protein, 5 aa, Neisseria
MARIW

SEQ ID NO: 18140 - protein, 5 aa, Neisseria
SPCPA

SEQ ID NO: 18141 - protein, 8 aa, Neisseria
PKSLAKCA

SEQ ID NO: 18142 - protein, 9 aa, Neisseria
TTKPKSLAK

SEQ ID NO: 18143 - protein, 5 aa, Neisseria
RSNCL

SEQ ID NO: 18144 - protein, 11 aa, Neisseria
CSSTTGAPTSR

SEQ ID NO: 18145 - protein, 14 aa, Neisseria
SASINKDTRMPASV

SEQ ID NO: 18146 - protein, 10 aa, Neisseria
CCANTSKPPS

SEQ ID NO: 18147 - protein, 7 aa, Neisseria
TKPKSLA

SEQ ID NO: 18148 - protein, 8 aa, Neisseria
SINKDTRM

SEQ ID NO: 18149 - protein, 6 aa, Neisseria
NTSKPP

SEQ ID NO: 18150 - protein, 7 aa, Neisseria
ITRITDE

SEQ ID NO: 18151 - protein, 8 aa, Neisseria
AEEFSSTN

SEQ ID NO: 18152 - protein, 6 aa, Neisseria
FRAITS

SEQ ID NO: 18153 - protein, 9 aa, Neisseria
IITIEDPIE

SEQ ID NO: 18154 - protein, 13 aa, Neisseria
NWMAALKNTLRQA

SEQ ID NO: 18155 - protein, 9 aa, Neisseria
NQALDRIIN

SEQ ID NO: 18156 - protein, 11 aa, Neisseria
GNIHEIKEVMK

SEQ ID NO: 18157 - protein, 6 aa, Neisseria
DQHLYQ

SEQ ID NO: 18158 - protein, 9 aa, Neisseria
QDALKNADS

SEQ ID NO: 18159 - protein, 12 aa, Neisseria
FTDENMTAKEEL

SEQ ID NO: 18160 - protein, 9 aa, Neisseria
HMNKNKGSD

SEQ ID NO: 18161 - protein, 21 aa, Neisseria
MKLDGKITRITDEPLTAEKCM

SEQ ID NO: 18162 - protein, 11 aa, Neisseria
KQAEEFSSTNE

SEQ ID NO: 18163 - protein, 9 aa, Neisseria
LPDTSRFRV

SEQ ID NO: 18164 - protein, 12 aa, Neisseria
ITSKIPKFESLN

SEQ ID NO: 18165 - protein, 7 aa, Neisseria
VALKKRG

SEQ ID NO: 18166 - protein, 9 aa, Neisseria
TGSGKSTSL

SEQ ID NO: 18167 - protein, 10 aa, Neisseria
IDYRNENSFG

SEQ ID NO: 18168 - protein, 5 aa, Neisseria
IEDPI

SEQ ID NO: 18169 - protein, 6 aa, Neisseria
HEHKNC

SEQ ID NO: 18170 - protein, 11 aa, Neisseria
TQREVGVDTEN

SEQ ID NO: 18171 - protein, 10 aa, Neisseria
LKNTLRQAPD

SEQ ID NO: 18172 - protein, 8 aa, Neisseria
EIRDRETM

SEQ ID NO: 18173 - protein, 9 aa, Neisseria
NSTNQALDR

SEQ ID NO: 18174 - protein, 10 aa, Neisseria
FPEERREQLL

SEQ ID NO: 18175 - protein, 13 aa, Neisseria
LVPRDGGKGRVAA

SEQ ID NO: 18176 - protein, 11 aa, Neisseria
HEIKEVMKKST

SEQ ID NO: 18177 - protein, 7 aa, Neisseria
EKGEISL

SEQ ID NO: 18178 - protein, 12 aa, Neisseria
DALKNADSAHDL

SEQ ID NO: 18179 - protein, 16 aa, Neisseria
LRSRQAQSSGPDLELL

SEQ ID NO: 18180 - protein, 12 aa, Neisseria
FTDENMTAKEEL

SEQ ID NO: 18181 - protein, 8 aa, Neisseria
MNKNKGSD

SEQ ID NO: 18182 - protein, 21 aa, Neisseria
MKLDGKITRITDEPLTAEKCM

SEQ ID NO: 18183 - protein, 8 aa, Neisseria
KQAEEFSS

SEQ ID NO: 18184 - protein, 7 aa, Neisseria
DTSRFRV

SEQ ID NO: 18185 - protein, 7 aa, Neisseria
KIPKFES

SEQ ID NO: 18186 - protein, 7 aa, Neisseria
VALKKRG

SEQ ID NO: 18187 - protein, 7 aa, Neisseria
GSGKSTS

SEQ ID NO: 18188 - protein, 7 aa, Neisseria
DYRNENS

SEQ ID NO: 18189 - protein, 5 aa, Neisseria
IEDPI

SEQ ID NO: 18190 - protein, 5 aa, Neisseria
HEHKN

SEQ ID NO: 18191 - protein, 9 aa, Neisseria
TQREVGVDT

SEQ ID NO: 18192 - protein, 7 aa, Neisseria
NTLRQAP

SEQ ID NO: 18193 - protein, 8 aa, Neisseria
EIRDRETM

SEQ ID NO: 18194 - protein, 5 aa, Neisseria
QALDR

SEQ ID NO: 18195 - protein, 9 aa, Neisseria
PEERREQLL

SEQ ID NO: 18196 - protein, 13 aa, Neisseria
LVPRDGGKGRVAA

SEQ ID NO: 18197 - protein, 11 aa, Neisseria
HEIKEVMKKST

SEQ ID NO: 18198 - protein, 7 aa, Neisseria
EKGEISL

SEQ ID NO: 18199 - protein, 12 aa, Neisseria
DALKNADSAHDL

SEQ ID NO: 18200 - protein, 15 aa, Neisseria
LRSRQAQSSGPDLEL

SEQ ID NO: 18201 - protein, 5 aa, Neisseria
YKDGK

SEQ ID NO: 18202 - protein, 9 aa, Neisseria
EAVFKTLSP

SEQ ID NO: 18203 - protein, 14 aa, Neisseria
LVTDDYYKDGKHID

SEQ ID NO: 18204 - protein, 13 aa, Neisseria
QLHRDEEAVRRHI

SEQ ID NO: 18205 - protein, 5 aa, Neisseria
PDMNA

SEQ ID NO: 18206 - protein, 8 aa, Neisseria
GEFDGKQP

SEQ ID NO: 18207 - protein, 11 aa, Neisseria
HPTRKADDQTV

SEQ ID NO: 18208 - protein, 12 aa, Neisseria
PVGSAQNGRAEY

SEQ ID NO: 18209 - protein, 6 aa, Neisseria
LSPTNH

SEQ ID NO: 18210 - protein, 7 aa, Neisseria
RVEDAAG

SEQ ID NO: 18211 - protein, 28 aa, Neisseria
VENKWITSQGNAVDLTPMDKLFNNTESK

SEQ ID NO: 18212 - protein, 10 aa, Neisseria
DYYKDGKHID

SEQ ID NO: 18213 - protein, 13 aa, Neisseria
QLHRDEEAVRRHI

SEQ ID NO: 18214 - protein, 6 aa, Neisseria
EFDGKQ

SEQ ID NO: 18215 - protein, 10 aa, Neisseria
PTRKADDQTV

SEQ ID NO: 18216 - protein, 7 aa, Neisseria
QNGRAEY

SEQ ID NO: 18217 - protein, 7 aa, Neisseria
RVEDAAG

SEQ ID NO: 18218 - protein, 8 aa, Neisseria
TPMDKLFN

SEQ ID NO: 18219 - protein, 17 aa, Neisseria
MMRSAPSMVVRRWATMM

SEQ ID NO: 18220 - protein, 6 aa, Neisseria
SFKMAR

SEQ ID NO: 18221 - protein, 7 aa, Neisseria
PFDPMGW

SEQ ID NO: 18222 - protein, 9 aa, Neisseria
GRLYRTFSN

SEQ ID NO: 18223 - protein, 7 aa, Neisseria
TKRGSRL

SEQ ID NO: 18224 - protein, 13 aa, Neisseria
STSTLRKLMRPST

SEQ ID NO: 18225 - protein, 8 aa, Neisseria
MRSAPSMV

SEQ ID NO: 18226 - protein, 18 aa, Neisseria
FSIRRSSACWTRRSDSLS

SEQ ID NO: 18227 - protein, 6 aa, Neisseria
SSNNNI

SEQ ID NO: 18228 - protein, 14 aa, Neisseria
MATRCRCPPDKLLP

SEQ ID NO: 18229 - protein, 5 aa, Neisseria
DPMGW

SEQ ID NO: 18230 - protein, 9 aa, Neisseria
SPSGDASIR

SEQ ID NO: 18231 - protein, 16 aa, Neisseria
WRADRTSASPASGRLY

SEQ ID NO: 18232 - protein, 26 aa, Neisseria
FSNRVSSNRNTSWETRANWARRQSSL

SEQ ID NO: 18233 - protein, 15 aa, Neisseria
LPADGSTKRGSRLTT

SEQ ID NO: 18234 - protein, 48 aa, Neisseria
PLPERPTRATRSPCLMSRLKPSRALMPSERYSTSTLRKLMRPSTRCGA

SEQ ID NO: 18235 - protein, 17 aa, Neisseria
CSGGVSRNAHTPSAARN

SEQ ID NO: 18236 - protein, 7 aa, Neisseria
FSIRRSS

SEQ ID NO: 18237 - protein, 8 aa, Neisseria
WTRRSDSL

SEQ ID NO: 18238 - protein, 11 aa, Neisseria
MATRCRCPPDK

SEQ ID NO: 18239 - protein, 7 aa, Neisseria
SGDASIR

SEQ ID NO: 18240 - protein, 7 aa, Neisseria
RADRTSA

SEQ ID NO: 18241 - protein, 12 aa, Neisseria
RVSSNRNTSWET

SEQ ID NO: 18242 - protein, 9 aa, Neisseria
ANWARRQSS

SEQ ID NO: 18243 - protein, 9 aa, Neisseria
DGSTKRGSR

SEQ ID NO: 18244 - protein, 11 aa, Neisseria
PLPERPTRATR

SEQ ID NO: 18245 - protein, 7 aa, Neisseria
SRLKPSR

SEQ ID NO: 18246 - protein, 8 aa, Neisseria
LMPSERYS

SEQ ID NO: 18247 - protein, 12 aa, Neisseria
TLRKLMRPSTRC

SEQ ID NO: 18248 - protein, 7 aa, Neisseria
GVSRNAH

SEQ ID NO: 18249 - protein, 12 aa, Neisseria
FEVVGGLFDFVL

SEQ ID NO: 18250 - protein, 13 aa, Neisseria
CPNEVIDVFHALQ

SEQ ID NO: 18251 - protein, 30 aa, Neisseria
AFDAVGDFAEYGGAVDAADLLEIGELGYFH

SEQ ID NO: 18252 - protein, 8 aa, Neisseria
AVGVVAVA

SEQ ID NO: 18253 - protein, 16 aa, Neisseria
PRFEDKLVGRQGEGGV

SEQ ID NO: 18254 - protein, 6 aa, Neisseria
FCPNEV

SEQ ID NO: 18255 - protein, 5 aa, Neisseria
AEYGG

SEQ ID NO: 18256 - protein, 15 aa, Neisseria
VEPDFPAQTPRAEGG

SEQ ID NO: 18257 - protein, 5 aa, Neisseria
FDKAD

SEQ ID NO: 18258 - protein, 11 aa, Neisseria
DIGGSGLEGDL

SEQ ID NO: 18259 - protein, 11 aa, Neisseria
LDVGGKPRLGA

SEQ ID NO: 18260 - protein, 9 aa, Neisseria
CAQTGGGMG

SEQ ID NO: 18261 - protein, 5 aa, Neisseria
GTDFH

SEQ ID NO: 18262 - protein, 6 aa, Neisseria
GLDDGA

SEQ ID NO: 18263 - protein, 14 aa, Neisseria
LQFEDDLLEGKHGL

SEQ ID NO: 18264 - protein, 13 aa, Neisseria
PRFEDKLVGRQGE

SEQ ID NO: 18265 - protein, 5 aa, Neisseria
VEPDF

SEQ ID NO: 18266 - protein, 6 aa, Neisseria
TPRAEG

SEQ ID NO: 18267 - protein, 5 aa, Neisseria
FDKAD

SEQ ID NO: 18268 - protein, 6 aa, Neisseria
GLEGDL

SEQ ID NO: 18269 - protein, 9 aa, Neisseria
VGGKPRLGA

SEQ ID NO: 18270 - protein, 6 aa, Neisseria
GLDDGA

SEQ ID NO: 18271 - protein, 14 aa, Neisseria
LQFEDDLLEGKHGL

SEQ ID NO: 18272 - protein, 7 aa, Neisseria
GAIFSIG

SEQ ID NO: 18273 - protein, 9 aa, Neisseria
IGPLPSIGR

SEQ ID NO: 18274 - protein, 5 aa, Neisseria
TGTSK

SEQ ID NO: 18275 - protein, 9 aa, Neisseria
RTIPSVTEI

SEQ ID NO: 18276 - protein, 12 aa, Neisseria
FSILALIKSLIS

SEQ ID NO: 18277 - protein, 17 aa, Neisseria
LYRQIQNLITHFNFYAA

SEQ ID NO: 18278 - protein, 12 aa, Neisseria
ETLIQHLRQLAD

SEQ ID NO: 18279 - protein, 25 aa, Neisseria
SIGRPNASTTRPTSSRPTGTSKIRP

SEQ ID NO: 18280 - protein, 16 aa, Neisseria
SPNTTAPTESRSRFIA

SEQ ID NO: 18281 - protein, 10 aa, Neisseria
PKVLPGNSSI

SEQ ID NO: 18282 - protein, 9 aa, Neisseria
IASDKPWMR

SEQ ID NO: 18283 - protein, 15 aa, Neisseria
TVPRVRTSAFTDRFS

SEQ ID NO: 18284 - protein, 8 aa, Neisseria
RHSRVQGT

SEQ ID NO: 18285 - protein, 7 aa, Neisseria
FDFDRDF

SEQ ID NO: 18286 - protein, 11 aa, Neisseria
TVNDGRFDMVE

SEQ ID NO: 18287 - protein, 23 aa, Neisseria
GRPNASTTRPTSSRPTGTSKIRP

SEQ ID NO: 18288 - protein, 11 aa, Neisseria
APTESRSRFIA

SEQ ID NO: 18289 - protein, 7 aa, Neisseria
IASDKPW

SEQ ID NO: 18290 - protein, 7 aa, Neisseria
TVPRVRT

SEQ ID NO: 18291 - protein, 6 aa, Neisseria
RHSRVQ

SEQ ID NO: 18292 - protein, 7 aa, Neisseria
FDFDRDF

SEQ ID NO: 18293 - protein, 9 aa, Neisseria
NDGRFDMVE

SEQ ID NO: 18294 - protein, 5 aa, Neisseria
GCLIS

SEQ ID NO: 18295 - protein, 9 aa, Neisseria
AASIARSTA

SEQ ID NO: 18296 - protein, 6 aa, Neisseria
LPAITT

SEQ ID NO: 18297 - protein, 7 aa, Neisseria
TTSSCAD

SEQ ID NO: 18298 - protein, 5 aa, Neisseria
  VARIANT 1: Xaa is any amino acid
XRASA

SEQ ID NO: 18299 - protein, 14 aa, Neisseria
WEGTDTGSGRARLA

SEQ ID NO: 18300 - protein, 8 aa, Neisseria
CPGELKLT

SEQ ID NO: 18301 - protein, 8 aa, Neisseria
TTSSCADS

SEQ ID NO: 18302 - protein, 8 aa, Neisseria
CSSSKPRI

SEQ ID NO: 18303 - protein, 18 aa, Neisseria
  VARIANT 14: Xaa is any amino acid
TPCGTADCISSARXRTSL

SEQ ID NO: 18304 - protein, 9 aa, Neisseria
ASAKSNAPA

SEQ ID NO: 18305 - protein, 5 aa, Neisseria
PPASE

SEQ ID NO: 18306 - protein, 5 aa, Neisseria
  VARIANT 1: Xaa is any amino acid
XRASA

SEQ ID NO: 18307 - protein, 14 aa, Neisseria
WEGTDTGSGRARLA

SEQ ID NO: 18308 - protein, 5 aa, Neisseria
GELKL

SEQ ID NO: 18309 - protein, 7 aa, Neisseria
SSSKPRI

SEQ ID NO: 18310 - protein, 9 aa, Neisseria
  VARIANT 5: Xaa is any amino acid
SSARXRTSL

SEQ ID NO: 18311 - protein, 7 aa, Neisseria
ASAKSNA

SEQ ID NO: 18312 - protein, 10 aa, Neisseria
SFSILGDVAK

SEQ ID NO: 18313 - protein, 8 aa, Neisseria
DIKKIRSA

SEQ ID NO: 18314 - protein, 7 aa, Neisseria
DIQRAVK

SEQ ID NO: 18315 - protein, 12 aa, Neisseria
YAEATKGIQPLK

SEQ ID NO: 18316 - protein, 12 aa, Neisseria
AYAQNVAEALIK

SEQ ID NO: 18317 - protein, 9 aa, Neisseria
VAAIIRQIK

SEQ ID NO: 18318 - protein, 9 aa, Neisseria
EGIKAVFTE

SEQ ID NO: 18319 - protein, 13 aa, Neisseria
KDTRMVDRIAKET

SEQ ID NO: 18320 - protein, 15 aa, Neisseria
LYSDALGNAPADTYI

SEQ ID NO: 18321 - protein, 5 aa, Neisseria
MKHPK

SEQ ID NO: 18322 - protein, 7 aa, Neisseria
IGGERVS

SEQ ID NO: 18323 - protein, 6 aa, Neisseria
ANQDTH

SEQ ID NO: 18324 - protein, 12 aa, Neisseria
TSGDIKKIRSAK

SEQ ID NO: 18325 - protein, 24 aa, Neisseria
EAADIQRAVKQSKVSYAEATKGIQ

SEQ ID NO: 18326 - protein, 39 aa, Neisseria
LKAEEEGGHHHDHDHDHDHDHEGHHHDHGEYDPHVWNDP

SEQ ID NO: 18327 - protein, 12 aa, Neisseria
LIKADPEGKVYY

SEQ ID NO: 18328 - protein, 9 aa, Neisseria
QLKKLHSDA

SEQ ID NO: 18329 - protein, 9 aa, Neisseria
PAAKRKVLT

SEQ ID NO: 18330 - protein, 6 aa, Neisseria
MGKRYH

SEQ ID NO: 18331 - protein, 15 aa, Neisseria
APQGVSSEAEPSAKQ

SEQ ID NO: 18332 - protein, 8 aa, Neisseria
RQIKREGI

SEQ ID NO: 18333 - protein, 18 aa, Neisseria
ENIKDTRMVDRIAKETGV

SEQ ID NO: 18334 - protein, 7 aa, Neisseria
VSGKLYS

SEQ ID NO: 18335 - protein, 5 aa, Neisseria
APADT

SEQ ID NO: 18336 - protein, 5 aa, Neisseria
YRHNI

SEQ ID NO: 18337 - protein, 5 aa, Neisseria
MKHPK

SEQ ID NO: 18338 - protein, 7 aa, Neisseria
IGGERVS

SEQ ID NO: 18339 - protein, 10 aa, Neisseria
GDIKKIRSAK

SEQ ID NO: 18340 - protein, 13 aa, Neisseria
EAADIQRAVKQSK

SEQ ID NO: 18341 - protein, 5 aa, Neisseria
EATKG

SEQ ID NO: 18342 - protein, 32 aa, Neisseria
LKAEEEGGHHHDHDHDHDHDHEGHHHDHGEYD

SEQ ID NO: 18343 - protein, 8 aa, Neisseria
LIKADPEG

SEQ ID NO: 18344 - protein, 9 aa, Neisseria
QLKKLHSDA

SEQ ID NO: 18345 - protein, 9 aa, Neisseria
PAAKRKVLT

SEQ ID NO: 18346 - protein, 11 aa, Neisseria
VSSEAEPSAKQ

SEQ ID NO: 18347 - protein, 8 aa, Neisseria
RQIKREGI

SEQ ID NO: 18348 - protein, 18 aa, Neisseria
ENIKDTRMVDRIAKETGV

SEQ ID NO: 18349 - protein, 16 aa, Neisseria
AAGMLMALLAGLVSRF

SEQ ID NO: 18350 - protein, 11 aa, Neisseria
LQLIAAVSTLT

SEQ ID NO: 18351 - protein, 6 aa, Neisseria
LAVIYR

SEQ ID NO: 18352 - protein, 14 aa, Neisseria
LVSGFQALGTLMSV

SEQ ID NO: 18353 - protein, 5 aa, Neisseria
WAKHM

SEQ ID NO: 18354 - protein, 9 aa, Neisseria
SVLTALLCG

SEQ ID NO: 18355 - protein, 5 aa, Neisseria
RRMSL

SEQ ID NO: 18356 - protein, 8 aa, Neisseria
TTLKEDAN

SEQ ID NO: 18357 - protein, 7 aa, Neisseria
SKNGSSV

SEQ ID NO: 18358 - protein, 7 aa, Neisseria
SVGGKGG

SEQ ID NO: 18359 - protein, 5 aa, Neisseria
IPSGP

SEQ ID NO: 18360 - protein, 7 aa, Neisseria
LGKEGGI

SEQ ID NO: 18361 - protein, 10 aa, Neisseria
WLKNHRHHTT

SEQ ID NO: 18362 - protein, 5 aa, Neisseria
RRMSL

SEQ ID NO: 18363 - protein, 8 aa, Neisseria
TTLKEDAN

SEQ ID NO: 18364 - protein, 5 aa, Neisseria
KNGSS

SEQ ID NO: 18365 - protein, 7 aa, Neisseria
LGKEGGI

SEQ ID NO: 18366 - protein, 8 aa, Neisseria
LKNHRHHT

SEQ ID NO: 18367 - protein, 15 aa, Neisseria
LIVAFLVLINPFSAL

SEQ ID NO: 18368 - protein, 15 aa, Neisseria
VFAVIAVFALIGGTL

SEQ ID NO: 18369 - protein, 6 aa, Neisseria
VRPARN

SEQ ID NO: 18370 - protein, 5 aa, Neisseria
VSRLL

SEQ ID NO: 18371 - protein, 9 aa, Neisseria
TILNRIMGM

SEQ ID NO: 18372 - protein, 14 aa, Neisseria
TNGHSTKERRKVAR

SEQ ID NO: 18373 - protein, 28 aa, Neisseria
NGNDNPAKQNLGAQPETGQVRPARNAGA

SEQ ID NO: 18374 - protein, 11 aa, Neisseria
HSTKERRKVAR

SEQ ID NO: 18375 - protein, 11 aa, Neisseria
NGNDNPAKQNL

SEQ ID NO: 18376 - protein, 13 aa, Neisseria
AQPETGQVRPARN

SEQ ID NO: 18377 - protein, 7 aa, Neisseria
TLASFLP

SEQ ID NO: 18378 - protein, 13 aa, Neisseria
GGNSYSDVPKQLH

SEQ ID NO: 18379 - protein, 7 aa, Neisseria
ADAGKRT

SEQ ID NO: 18380 - protein, 22 aa, Neisseria
WKDGGGNSYSDVPKQLHPDQSQ

SEQ ID NO: 18381 - protein, 65 aa, Neisseria; identical to SEQ ID NO: 4508

SEQ ID NO: 18382 - protein, 24 aa, Neisseria
GNSNAKNKDDLIRKYNNAVNKYCR

SEQ ID NO: 18383 - protein, 7 aa, Neisseria
SYSDVPK

SEQ ID NO: 18384 - protein, 7 aa, Neisseria
LHPDQSQ

SEQ ID NO: 18385 - protein, 14 aa, Neisseria
SNAKNKDDLIRKYN

SEQ ID NO: 18386 - protein, 10 aa, Neisseria
EAFAGFFETV

SEQ ID NO: 18387 - protein, 6 aa, Neisseria
TFAARF

SEQ ID NO: 18388 - protein, 6 aa, Neisseria
VDFDVF

SEQ ID NO: 18389 - protein, 12 aa, Neisseria
VVFRLFRQVVVD

SEQ ID NO: 18390 - protein, 9 aa, Neisseria
DTACGNVGG

SEQ ID NO: 18391 - protein, 9 aa, Neisseria
AAAFAQIHQ

SEQ ID NO: 18392 - protein, 12 aa, Neisseria
FVQFIRDDFGHG

SEQ ID NO: 18393 - protein, 12 aa, Neisseria
FRVFGQFARQFA

SEQ ID NO: 18394 - protein, 14 aa, Neisseria
FRRGFDDGFDVVDK

SEQ ID NO: 18395 - protein, 10 aa, Neisseria
AALHQVHQTA

SEQ ID NO: 18396 - protein, 10 aa, Neisseria
GDNQIDRFAQ

SEQ ID NO: 18397 - protein, 17 aa, Neisseria
ARAFARFFAAFGQSLQS

SEQ ID NO: 18398 - protein, 9 aa, Neisseria
MPSETRNRF

SEQ ID NO: 18399 - protein, 5 aa, Neisseria
FDGQF

SEQ ID NO: 18400 - protein, 11 aa, Neisseria
HFGKRNRNTRA

SEQ ID NO: 18401 - protein, 6 aa, Neisseria
GAPDAV

SEQ ID NO: 18402 - protein, 20 aa, Neisseria
NVGNGRYVDTACGNVGGNQN

SEQ ID NO: 18403 - protein, 5 aa, Neisseria
AVGGE

SEQ ID NO: 18404 - protein, 17 aa, Neisseria
FIRDDFGHGFGGRENHA

SEQ ID NO: 18405 - protein, 6 aa, Neisseria
DFDDFR

SEQ ID NO: 18406 - protein, 15 aa, Neisseria
QFADRAVPSGGEQQS

SEQ ID NO: 18407 - protein, 17 aa, Neisseria
VFRRGFDDGFDVVDKAH

SEQ ID NO: 18408 - protein, 14 aa, Neisseria
QTARRGDNQIDRFA

SEQ ID NO: 18409 - protein, 20 aa, Neisseria
GAGLVAERCTTDDADGTEPT

SEQ ID NO: 18410 - protein, 12 aa, Neisseria
FAGRRQHQRARA

SEQ ID NO: 18411 - protein, 6 aa, Neisseria
QSLQSR

SEQ ID NO: 18412 - protein, 9 aa, Neisseria
MPSETRNRF

SEQ ID NO: 18413 - protein, 9 aa, Neisseria
GKRNRNTRA

SEQ ID NO: 18414 - protein, 6 aa, Neisseria
IRDDFG

SEQ ID NO: 18415 - protein, 7 aa, Neisseria
GGRENHA

SEQ ID NO: 18416 - protein, 14 aa, Neisseria
QFADRAVPSGGEQQ

SEQ ID NO: 18417 - protein, 14 aa, Neisseria
RGFDDGFDVVDKAH

SEQ ID NO: 18418 - protein, 14 aa, Neisseria
QTARRGDNQIDRFA

SEQ ID NO: 18419 - protein, 14 aa, Neisseria
VAERCTTDDADGTE

SEQ ID NO: 18420 - protein, 12 aa, Neisseria
FAGRRQHQRARA

SEQ ID NO: 18421 - protein, 5 aa, Neisseria
VCFLG

SEQ ID NO: 18422 - protein, 5 aa, Neisseria
QIPSW

SEQ ID NO: 18423 - protein, 8 aa, Neisseria
GTLLDGFD

SEQ ID NO: 18424 - protein, 9 aa, Neisseria
SLPDSIDLP

SEQ ID NO: 18425 - protein, 5 aa, Neisseria
HSTAR

SEQ ID NO: 18426 - protein, 15 aa, Neisseria
HPFAESLDKTLEEVL

SEQ ID NO: 18427 - protein, 5 aa, Neisseria
VPSLP

SEQ ID NO: 18428 - protein, 7 aa, Neisseria
AIPSFSD

SEQ ID NO: 18429 - protein, 5 aa, Neisseria
QVLGS

SEQ ID NO: 18430 - protein, 7 aa, Neisseria
IGKAADI

SEQ ID NO: 18431 - protein, 5 aa, Neisseria
PDTSR

SEQ ID NO: 18432 - protein, 6 aa, Neisseria
GAEVVD

SEQ ID NO: 18433 - protein, 9 aa, Neisseria
GINRELTRW

SEQ ID NO: 18434 - protein, 12 aa, Neisseria
IAELHNFFKPPF

SEQ ID NO: 18435 - protein, 5 aa, Neisseria
ARGYL

SEQ ID NO: 18436 - protein, 7 aa, Neisseria
FGGNMAN

SEQ ID NO: 18437 - protein, 12 aa, Neisseria
RITASLPDLGTL

SEQ ID NO: 18438 - protein, 10 aa, Neisseria
QNITGSLNAA

SEQ ID NO: 18439 - protein, 5 aa, Neisseria
GSIAD

SEQ ID NO: 18440 - protein, 5 aa, Neisseria
TAELS

SEQ ID NO: 18441 - protein, 6 aa, Neisseria
VTGMIK

SEQ ID NO: 18442 - protein, 12 aa, Neisseria
SGGSVRGVGTVR

SEQ ID NO: 18443 - protein, 9 aa, Neisseria
TVSFVGPLN

SEQ ID NO: 18444 - protein, 10 aa, Neisseria
AGVEILGSLN

SEQ ID NO: 18445 - protein, 5 aa, Neisseria
LAGQI

SEQ ID NO: 18446 - protein, 19 aa, Neisseria
VKLIYRLTRAIQAVARIGS

SEQ ID NO: 18447 - protein, 32 aa, Neisseria; identical to SEQ ID NO: 4572

SEQ ID NO: 18448 - protein, 11 aa, Neisseria
KPSELMRRSLH

SEQ ID NO: 18449 - protein, 19 aa, Neisseria
KPTPPKEERPPLSLPDSID

SEQ ID NO: 18450 - protein, 20 aa, Neisseria
DRFETGKISMGKAFDKQTVY

SEQ ID NO: 18451 - protein, 32 aa, Neisseria
ERLDASYRYDRKGHRLDLKAADTPWSSSSGSA

SEQ ID NO: 18452 - protein, 7 aa, Neisseria
GLKKPFA

SEQ ID NO: 18453 - protein, 10 aa, Neisseria
TKGGLEGKTI

SEQ ID NO: 18454 - protein, 14 aa, Neisseria
STARLSGSLKDVRA

SEQ ID NO: 18455 - protein, 14 aa, Neisseria
LAIDGGNIRLSGKS

SEQ ID NO: 18456 - protein, 8 aa, Neisseria
ESLDKTLE

SEQ ID NO: 18457 - protein, 5 aa, Neisseria
SLPDA

SEQ ID NO: 18458 - protein, 9 aa, Neisseria
GSLDLENTK

SEQ ID NO: 18459 - protein, 10 aa, Neisseria
GFADRNGIPV

SEQ ID NO: 18460 - protein, 8 aa, Neisseria
IRQDGTVH

SEQ ID NO: 18461 - protein, 18 aa, Neisseria
GRGGIRLSGKIDTEKDIL

SEQ ID NO: 18462 - protein, 8 aa, Neisseria
SVGAEDVL

SEQ ID NO: 18463 - protein, 10 aa, Neisseria
AFKGRLDGSI

SEQ ID NO: 18464 - protein, 6 aa, Neisseria
TASPKI

SEQ ID NO: 18465 - protein, 8 aa, Neisseria
TARTDGSL

SEQ ID NO: 18466 - protein, 11 aa, Neisseria
SDPANGQRKLV

SEQ ID NO: 18467 - protein, 6 aa, Neisseria
GQGSLT

SEQ ID NO: 18468 - protein, 25 aa, Neisseria
LFKDRLLKLDIRSRAFDPSRIDPQL

SEQ ID NO: 18469 - protein, 10 aa, Neisseria
ELAKEKFTGK

SEQ ID NO: 18470 - protein, 13 aa, Neisseria
IVYESRHLPRAAV

SEQ ID NO: 18471 - protein, 22 aa, Neisseria
LRLGRNIIKTDGGFGKKGDRLN

SEQ ID NO: 18472 - protein, 8 aa, Neisseria
APDLSRFG

SEQ ID NO: 18473 - protein, 25 aa, Neisseria
NVRGHLSGDLDGGIRTFETDLSGAA

SEQ ID NO: 18474 - protein, 7 aa, Neisseria
KAADIRS

SEQ ID NO: 18475 - protein, 41 aa, Neisseria
LKGSPDTSRPIRADIKGSRLSLSGGAEVVDTADLMLDGTGV

SEQ ID NO: 18476 - protein, 5 aa, Neisseria
HRIRT

SEQ ID NO: 18477 - protein, 28 aa, Neisseria
TLDGKPFKFDLDASGGINRELTRWKGSI

SEQ ID NO: 18478 - protein, 7 aa, Neisseria
LQNRMTL

SEQ ID NO: 18479 - protein, 7 aa, Neisseria
AGAERVA

SEQ ID NO: 18480 - protein, 14 aa, Neisseria
SWDKKTGISAKGGA

SEQ ID NO: 18481 - protein, 5 aa, Neisseria
LNGDW

SEQ ID NO: 18482 - protein, 7 aa, Neisseria
YGRNARG

SEQ ID NO: 18483 - protein, 10 aa, Neisseria
ISRQSGDAVL

SEQ ID NO: 18484 - protein, 12 aa, Neisseria
SLKTRFQNDRIG

SEQ ID NO: 18485 - protein, 16 aa, Neisseria
LDGGARFGRINADLDI

SEQ ID NO: 18486 - protein, 7 aa, Neisseria
PLGGRIT

SEQ ID NO: 18487 - protein, 8 aa, Neisseria
GRVGSPSV

SEQ ID NO: 18488 - protein, 12 aa, Neisseria
VNGSSNYGKING

SEQ ID NO: 18489 - protein, 17 aa, Neisseria
VGQSRSFDTAPLGGRLN

SEQ ID NO: 18490 - protein, 7 aa, Neisseria
QTVKGSL

SEQ ID NO: 18491 - protein, 9 aa, Neisseria
SIADPHLGG

SEQ ID NO: 18492 - protein, 12 aa, Neisseria
INGDKLYYRNQT

SEQ ID NO: 18493 - protein, 7 aa, Neisseria
LDNGSLR

SEQ ID NO: 18494 - protein, 7 aa, Neisseria
IAGRKWV

SEQ ID NO: 18495 - protein, 13 aa, Neisseria
LKFRHEGTAELSG

SEQ ID NO: 18496 - protein, 12 aa, Neisseria
VGMENSGPDVDI

SEQ ID NO: 18497 - protein, 14 aa, Neisseria
DKYRILSRPNRRLT

SEQ ID NO: 18498 - protein, 13 aa, Neisseria
GNTRLRYSPQKGI

SEQ ID NO: 18499 - protein, 22 aa, Neisseria
IKTDQGLFGSQKSSMPSVGDDV

SEQ ID NO: 18500 - protein, 7 aa, Neisseria
EVKKEAA

SEQ ID NO: 18501 - protein, 7 aa, Neisseria
DLNDGIR

SEQ ID NO: 18502 - protein, 10 aa, Neisseria
QSGGSVRGVG

SEQ ID NO: 18503 - protein, 20 aa, Neisseria
RVIKGRYKAYGQDLDITKGT

SEQ ID NO: 18504 - protein, 19 aa, Neisseria
PLNDPNLNIRAERRLSPVG

SEQ ID NO: 18505 - protein, 7 aa, Neisseria
SLNSPRI

SEQ ID NO: 18506 - protein, 11 aa, Neisseria
ANEPMSEKDKL

SEQ ID NO: 18507 - protein, 11 aa, Neisseria
AGSGSSGDNAA

SEQ ID NO: 18508 - protein, 9 aa, Neisseria
GQINDRIGL

SEQ ID NO: 18509 - protein, 22 aa, Neisseria
DDLGFTSKRSRNAQTGELNPAE

SEQ ID NO: 18510 - protein, 7 aa, Neisseria
GKQLTGK

SEQ ID NO: 18511 - protein, 7 aa, Neisseria
SSAEQSV

SEQ ID NO: 18512 - protein, 10 aa, Neisseria
IGSRSSGGEL

SEQ ID NO: 18513 - protein, 20 aa, Neisseria
RFDRFSGSDKKDSAGNSKGK

SEQ ID NO: 18514 - protein, 19 aa, Neisseria
FDGDNWSIETEGADLKISR

SEQ ID NO: 18515 - protein, 8 aa, Neisseria
ELMRRSLH

SEQ ID NO: 18516 - protein, 10 aa, Neisseria
PTPPKEERPP

SEQ ID NO: 18517 - protein, 7 aa, Neisseria
DRFETGK

SEQ ID NO: 18518 - protein, 5 aa, Neisseria
KAFDK

SEQ ID NO: 18519 - protein, 5 aa, Neisseria
ERLDA

SEQ ID NO: 18520 - protein, 16 aa, Neisseria
YRYDRKGHRLDLKAAD

SEQ ID NO: 18521 - protein, 8 aa, Neisseria
GGLEGKTI

SEQ ID NO: 18522 - protein, 8 aa, Neisseria
GSLKDVRA

SEQ ID NO: 18523 - protein, 8 aa, Neisseria
ESLDKTLE

SEQ ID NO: 18524 - protein, 9 aa, Neisseria
GSLDLENTK

SEQ ID NO: 18525 - protein, 9 aa, Neisseria
GFADRNGIP

SEQ ID NO: 18526 - protein, 5 aa, Neisseria
IRQDG

SEQ ID NO: 18527 - protein, 12 aa, Neisseria
LSGKIDTEKDIL

SEQ ID NO: 18528 - protein, 6 aa, Neisseria
GAEDVL

SEQ ID NO: 18529 - protein, 7 aa, Neisseria
FKGRLDG

SEQ ID NO: 18530 - protein, 5 aa, Neisseria
ARTDG

SEQ ID NO: 18531 - protein, 10 aa, Neisseria
DPANGQRKLV

SEQ ID NO: 18532 - protein, 23 aa, Neisseria
LFKDRLLKLDIRSRAFDPSRIDP

SEQ ID NO: 18533 - protein, 9 aa, Neisseria
ELAKEKFTG

SEQ ID NO: 18534 - protein, 9 aa, Neisseria
IVYESRHLP

SEQ ID NO: 18535 - protein, 22 aa, Neisseria
LRLGRNIIKTDGGFGKKGDRLN

SEQ ID NO: 18536 - protein, 18 aa, Neisseria
GDLDGGIRTFETDLSGAA

SEQ ID NO: 18537 - protein, 7 aa, Neisseria
KAADIRS

SEQ ID NO: 18538 - protein, 20 aa, Neisseria
GSPDTSRPIRADIKGSRLSL

SEQ ID NO: 18539 - protein, 10 aa, Neisseria
EVVDTADLML

SEQ ID NO: 18540 - protein, 5 aa, Neisseria
HRIRT

SEQ ID NO: 18541 - protein, 12 aa, Neisseria
LDGKPFKFDLDA

SEQ ID NO: 18542 - protein, 12 aa, Neisseria
GGINRELTRWKG

SEQ ID NO: 18543 - protein, 7 aa, Neisseria
AGAERVA

SEQ ID NO: 18544 - protein, 14 aa, Neisseria
SWDKKTGISAKGGA

SEQ ID NO: 18545 - protein, 5 aa, Neisseria
SRQSG

SEQ ID NO: 18546 - protein, 8 aa, Neisseria
TRFQNDRI

SEQ ID NO: 18547 - protein, 14 aa, Neisseria
GGARFGRINADLDI

SEQ ID NO: 18548 - protein, 11 aa, Neisseria
LKFRHEGTAEL

SEQ ID NO: 18549 - protein, 10 aa, Neisseria
MENSGPDVDI

SEQ ID NO: 18550 - protein, 14 aa, Neisseria
DKYRILSRPNRRLT

SEQ ID NO: 18551 - protein, 7 aa, Neisseria
TRLRYSP

SEQ ID NO: 18552 - protein, 5 aa, Neisseria
IKTDQ

SEQ ID NO: 18553 - protein, 5 aa, Neisseria
QKSSM

SEQ ID NO: 18554 - protein, 7 aa, Neisseria
EVKKEAA

SEQ ID NO: 18555 - protein, 7 aa, Neisseria
DLNDGIR

SEQ ID NO: 18556 - protein, 18 aa, Neisseria
RVIKGRYKAYGQDLDITK

SEQ ID NO: 18557 - protein, 8 aa, Neisseria
IRAERRLS

SEQ ID NO: 18558 - protein, 9 aa, Neisseria
EPMSEKDKL

SEQ ID NO: 18559 - protein, 11 aa, Neisseria
AGSGSSGDNAA

SEQ ID NO: 18560 - protein, 7 aa, Neisseria
INDRIGL

SEQ ID NO: 18561 - protein, 17 aa, Neisseria
GFTSKRSRNAQTGELNP

SEQ ID NO: 18562 - protein, 6 aa, Neisseria
SAEQSV

SEQ ID NO: 18563 - protein, 8 aa, Neisseria
IGSRSSGG

SEQ ID NO: 18564 - protein, 20 aa, Neisseria
RFDRFSGSDKKDSAGNSKGK

SEQ ID NO: 18565 - protein, 6 aa, Neisseria
EIKDMV

SEQ ID NO: 18566 - protein, 6 aa, Neisseria
PDNVKT

SEQ ID NO: 18567 - protein, 6 aa, Neisseria
VAILGD

SEQ ID NO: 18568 - protein, 18 aa, Neisseria
LAEYYRNALENWQQPVGS

SEQ ID NO: 18569 - protein, 7 aa, Neisseria
PLAKLGN

SEQ ID NO: 18570 - protein, 19 aa, Neisseria
TQRYPEQIVSGLARFQPGT

SEQ ID NO: 18571 - protein, 8 aa, Neisseria
DYYNLFNK

SEQ ID NO: 18572 - protein, 5 aa, Neisseria
ISQPR

SEQ ID NO: 18573 - protein, 5 aa, Neisseria
TTQNL

SEQ ID NO: 18574 - protein, 9 aa, Neisseria
TASWKRQLL

SEQ ID NO: 18575 - protein, 5 aa, Neisseria
TLGAF

SEQ ID NO: 18576 - protein, 5 aa, Neisseria
GASSV

SEQ ID NO: 18577 - protein, 15 aa, Neisseria
LSGAVFHDMGDAAAN

SEQ ID NO: 18578 - protein, 6 aa, Neisseria
RWFSPL

SEQ ID NO: 18579 - protein, 8 aa, Neisseria
MHDTRTMM

SEQ ID NO: 18580 - protein, 8 aa, Neisseria
ADLSENKA

SEQ ID NO: 18581 - protein, 19 aa, Neisseria
FKNKSPDTESVKLKPKFPV

SEQ ID NO: 18582 - protein, 16 aa, Neisseria
IDTQDSEIKDMVEEHL

SEQ ID NO: 18583 - protein, 12 aa, Neisseria
QQQEEVLDKEQT

SEQ ID NO: 18584 - protein, 31 aa, Neisseria; identical to SEQ ID NO: 4712

SEQ ID NO: 18585 - protein, 8 aa, Neisseria
TPGPRTKI

SEQ ID NO: 18586 - protein, 19 aa, Neisseria
ILSDGNLAEYYRNALENWQ

SEQ ID NO: 18587 - protein, 17 aa, Neisseria
VGSDFDQDSWENSKTSV

SEQ ID NO: 18588 - protein, 7 aa, Neisseria
VTRKAYP

SEQ ID NO: 18589 - protein, 16 aa, Neisseria
KLGNTRAAVNPDTATA

SEQ ID NO: 18590 - protein, 7 aa, Neisseria
DSGRPIA

SEQ ID NO: 18591 - protein, 12 aa, Neisseria
EITGTQRYPEQI

SEQ ID NO: 18592 - protein, 9 aa, Neisseria
FQPGTPYDL

SEQ ID NO: 18593 - protein, 9 aa, Neisseria
LEQNGHYSG

SEQ ID NO: 18594 - protein, 13 aa, Neisseria
ADFDRLQGDRVPV

SEQ ID NO: 18595 - protein, 24 aa, Neisseria
SVTEVKRHKLETGIRLDSEYGLGG

SEQ ID NO: 18596 - protein, 7 aa, Neisseria
DMDKYET

SEQ ID NO: 18597 - protein, 11 aa, Neisseria
SQPRNYRGNYW

SEQ ID NO: 18598 - protein, 20 aa, Neisseria
NVSYNRSTTQNLEKRAFSGG

SEQ ID NO: 18599 - protein, 12 aa, Neisseria
VRDRAGIDARLG

SEQ ID NO: 18600 - protein, 20 aa, Neisseria
FLAEGRKIPGSDIDLGNSHA

SEQ ID NO: 18601 - protein, 6 aa, Neisseria
SWKRQL

SEQ ID NO: 18602 - protein, 12 aa, Neisseria
HPENGHYLDGKI

SEQ ID NO: 18603 - protein, 6 aa, Neisseria
TSARAG

SEQ ID NO: 18604 - protein, 8 aa, Neisseria
FTPENKKL

SEQ ID NO: 18605 - protein, 9 aa, Neisseria
VARDNANVP

SEQ ID NO: 18606 - protein, 16 aa, Neisseria
FRSGGASSVRGYELDS

SEQ ID NO: 18607 - protein, 7 aa, Neisseria
VLPERAL

SEQ ID NO: 18608 - protein, 5 aa, Neisseria
DMGDA

SEQ ID NO: 18609 - protein, 14 aa, Neisseria
ANFKRMKLKHGSGL

SEQ ID NO: 18610 - protein, 9 aa, Neisseria
YGHSDKKIR

SEQ ID NO: 18611 - protein, 8 aa, Neisseria
MHDTRTMM

SEQ ID NO: 18612 - protein, 8 aa, Neisseria
ADLSENKA

SEQ ID NO: 18613 - protein, 18 aa, Neisseria
KNKSPDTESVKLKPKFPV

SEQ ID NO: 18614 - protein, 16 aa, Neisseria
IDTQDSEIKDMVEEHL

SEQ ID NO: 18615 - protein, 11 aa, Neisseria
QQEEVLDKEQT

SEQ ID NO: 18616 - protein, 15 aa, Neisseria
LAEEAPDNVKTMLRS

SEQ ID NO: 18617 - protein, 9 aa, Neisseria
VSLTEKDGA

SEQ ID NO: 18618 - protein, 7 aa, Neisseria
PGPRTKI

SEQ ID NO: 18619 - protein, 13 aa, Neisseria
SDFDQDSWENSKT

SEQ ID NO: 18620 - protein, 7 aa, Neisseria
VTRKAYP

SEQ ID NO: 18621 - protein, 10 aa, Neisseria
RAAVNPDTAT

SEQ ID NO: 18622 - protein, 5 aa, Neisseria
QRYPE

SEQ ID NO: 18623 - protein, 13 aa, Neisseria
ADFDRLQGDRVPV

SEQ ID NO: 18624 - protein, 20 aa, Neisseria
SVTEVKRHKLETGIRLDSEY

SEQ ID NO: 18625 - protein, 7 aa, Neisseria
DMDKYET

SEQ ID NO: 18626 - protein, 12 aa, Neisseria
RSTTQNLEKRAF

SEQ ID NO: 18627 - protein, 11 aa, Neisseria
RDRAGIDARLG

SEQ ID NO: 18628 - protein, 15 aa, Neisseria
FLAEGRKIPGSDIDL

SEQ ID NO: 18629 - protein, 6 aa, Neisseria
PENKKL

SEQ ID NO: 18630 - protein, 7 aa, Neisseria
VARDNAN

SEQ ID NO: 18631 - protein, 7 aa, Neisseria
RGYELDS

SEQ ID NO: 18632 - protein, 7 aa, Neisseria
VLPERAL

SEQ ID NO: 18633 - protein, 5 aa, Neisseria
DMGDA

SEQ ID NO: 18634 - protein, 10 aa, Neisseria
ANFKRMKLKH

SEQ ID NO: 18635 - protein, 7 aa, Neisseria
HSDKKIR

SEQ ID NO: 18636 - protein, 11 aa, Neisseria
KSADTLSKPAA

SEQ ID NO: 18637 - protein, 5 aa, Neisseria
GGQDM

SEQ ID NO: 18638 - protein, 6 aa, Neisseria
NDMPQN

SEQ ID NO: 18639 - protein, 32 aa, Neisseria
MPTRDMGNQAPDAGESAQPANQPDMANAADGM

SEQ ID NO: 18640 - protein, 16 aa, Neisseria
ENAGNTADQAANQAEN

SEQ ID NO: 18641 - protein, 5 aa, Neisseria
SQNPA

SEQ ID NO: 18642 - protein, 5 aa, Neisseria
GGSDF

SEQ ID NO: 18643 - protein, 6 aa, Neisseria
INVANG

SEQ ID NO: 18644 - protein, 12 aa, Neisseria
LSDEEKINKYKK

SEQ ID NO: 18645 - protein, 6 aa, Neisseria
FRRSAR

SEQ ID NO: 18646 - protein, 9 aa, Neisseria
KSVDGIIDS

SEQ ID NO: 18647 - protein, 6 aa, Neisseria
FKGTWT

SEQ ID NO: 18648 - protein, 6 aa, Neisseria
VSGRFY

SEQ ID NO: 18649 - protein, 22 aa, Neisseria
ACGGGGGGSPDVKSADTLSKPA

SEQ ID NO: 18650 - protein, 40 aa, Neisseria
VTEDVGEEVLPKEKKDEEAVSGAPQADTQDATAGKGGQDM

SEQ ID NO: 18651 - protein, 128 aa, Neisseria
SAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGR

SEQ ID NO: 18652 - protein, 15 aa, Neisseria
NVANGIKLDSGSENV

SEQ ID NO: 18653 - protein, 43 aa, Neisseria
HCKDKVCDRDFLDEEAPPKSEFEKLSDEEKINKYKKDEQRENF

SEQ ID NO: 18654 - protein, 12 aa, Neisseria
VADRVEKNGTNK

SEQ ID NO: 18655 - protein, 26 aa, Neisseria
IYKDKSASSSSARFRRSARSRRSLPA

SEQ ID NO: 18656 - protein, 6 aa, Neisseria
IVDGEA

SEQ ID NO: 18657 - protein, 5 aa, Neisseria
GHSGN

SEQ ID NO: 18658 - protein, 9 aa, Neisseria
APEGNYRYL

SEQ ID NO: 18659 - protein, 9 aa, Neisseria
GAEKLSGGS

SEQ ID NO: 18660 - protein, 9 aa, Neisseria
QGEPAKGEM

SEQ ID NO: 18661 - protein, 16 aa, Neisseria
HMENGRPSPSGGRFAA

SEQ ID NO: 18662 - protein, 25 aa, Neisseria
VDFGSKSVDGIIDSGDDLHMGTQKF

SEQ ID NO: 18663 - protein, 20 aa, Neisseria
IDGNGFKGTWTENGGGDVSG

SEQ ID NO: 18664 - protein, 25 aa, Neisseria
FYGPAGEEVAGKYSYRPTDAEKGGF

SEQ ID NO: 18665 - protein, 7 aa, Neisseria
AGKKEQD

SEQ ID NO: 18666 - protein, 17 aa, Neisseria
GGGSPDVKSADTLSKPA

SEQ ID NO: 18667 - protein, 21 aa, Neisseria
VTEDVGEEVLPKEKKDEEAVS

SEQ ID NO: 18668 - protein, 16 aa, Neisseria
PQADTQDATAGKGGQD

SEQ ID NO: 18669 - protein, 6 aa, Neisseria
SAENTG

SEQ ID NO: 18670 - protein, 28 aa, Neisseria
ATTDNPENKDEGPQNDMPQNAADTDSST

SEQ ID NO: 18671 - protein, 18 aa, Neisseria
MPTRDMGNQAPDAGESAQ

SEQ ID NO: 18672 - protein, 38 aa, Neisseria
NQPDMANAADGMQGDDPSAGENAGNTADQAANQAENNQ

SEQ ID NO: 18673 - protein, 5 aa, Neisseria
QNPAS

SEQ ID NO: 18674 - protein, 7 aa, Neisseria
GGSDFGR

SEQ ID NO: 18675 - protein, 8 aa, Neisseria
IKLDSGSE

SEQ ID NO: 18676 - protein, 43 aa, Neisseria; identical to SEQ ID NO: 18653

SEQ ID NO: 18677 - protein, 10 aa, Neisseria
VADRVEKNGT

SEQ ID NO: 18678 - protein, 24 aa, Neisseria
YKDKSASSSSARFRRSARSRRSLP

SEQ ID NO: 18679 - protein, 6 aa, Neisseria
IVDGEA

SEQ ID NO: 18680 - protein, 6 aa, Neisseria
GAEKLS

SEQ ID NO: 18681 - protein, 9 aa, Neisseria
QGEPAKGEM

SEQ ID NO: 18682 - protein, 10 aa, Neisseria
ENGRPSPSGG

SEQ ID NO: 18683 - protein, 19 aa, Neisseria
VDFGSKSVDGIIDSGDDLH

SEQ ID NO: 18684 - protein, 6 aa, Neisseria
GGGDVS

SEQ ID NO: 18685 - protein, 7 aa, Neisseria
AGEEVAG

SEQ ID NO: 18686 - protein, 12 aa, Neisseria
YSYRPTDAEKGG

SEQ ID NO: 18687 - protein, 7 aa, Neisseria
AGKKEQD

SEQ ID NO: 18688 - protein, 5 aa, Neisseria
VSRVL

SEQ ID NO: 18689 - protein, 6 aa, Neisseria
IVTKCA

SEQ ID NO: 18690 - protein, 11 aa, Neisseria
RPYRTFSPLPV

SEQ ID NO: 18691 - protein, 5 aa, Neisseria
HSTLR

SEQ ID NO: 18692 - protein, 12 aa, Neisseria
ALFQAGFDKAVQ

SEQ ID NO: 18693 - protein, 5 aa, Neisseria
HTGQA

SEQ ID NO: 18694 - protein, 9 aa, Neisseria
NLPERSAGS

SEQ ID NO: 18695 - protein, 11 aa, Neisseria
CAVRPYRTFSP

SEQ ID NO: 18696 - protein, 7 aa, Neisseria
LPKQPSA

SEQ ID NO: 18697 - protein, 21 aa, Neisseria
LPRPAVNRHSTLRSPDFPPRM

SEQ ID NO: 18698 - protein, 7 aa, Neisseria
IRGDCLP

SEQ ID NO: 18699 - protein, 22 aa, Neisseria
IITRNAKMPSETVQVSDGIQPK

SEQ ID NO: 18700 - protein, 6 aa, Neisseria
GFDKAV

SEQ ID NO: 18701 - protein, 7 aa, Neisseria
NLPERSA

SEQ ID NO: 18702 - protein, 5 aa, Neisseria
CAVRP

SEQ ID NO: 18703 - protein, 10 aa, Neisseria
STLRSPDFPP

SEQ ID NO: 18704 - protein, 5 aa, Neisseria
IRGDC

SEQ ID NO: 18705 - protein, 15 aa, Neisseria
IITRNAKMPSETVQV

SEQ ID NO: 18706 - protein, 6 aa, Neisseria
GFDKAV

SEQ ID NO: 18707 - protein, 11 aa, Neisseria
KILTPFTVLPL

SEQ ID NO: 18708 - protein, 5 aa, Neisseria
GKSVA

SEQ ID NO: 18709 - protein, 6 aa, Neisseria
VLSVSE

SEQ ID NO: 18710 - protein, 7 aa, Neisseria
PVKGIYE

SEQ ID NO: 18711 - protein, 6 aa, Neisseria
ERAADL

SEQ ID NO: 18712 - protein, 11 aa, Neisseria
PLDKAIKEVRG

SEQ ID NO: 18713 - protein, 16 aa, Neisseria
FCKRLEHEFEKMTDVT

SEQ ID NO: 18714 - protein, 8 aa, Neisseria
KAWTDWMR

SEQ ID NO: 18715 - protein, 6 aa, Neisseria
ICDNPV

SEQ ID NO: 18716 - protein, 5 aa, Neisseria
MKTKL

SEQ ID NO: 18717 - protein, 21 aa, Neisseria
TPVSNANAEPAVKAESAGKSV

SEQ ID NO: 18718 - protein, 15 aa, Neisseria
LKARLEKTYSAQDLK

SEQ ID NO: 18719 - protein, 8 aa, Neisseria
SETPVKGI

SEQ ID NO: 18720 - protein, 8 aa, Neisseria
YTDAEGGY

SEQ ID NO: 18721 - protein, 19 aa, Neisseria
INIDTRKNLTEERAADLNK

SEQ ID NO: 18722 - protein, 17 aa, Neisseria
PLDKAIKEVRGNGKLKV

SEQ ID NO: 18723 - protein, 9 aa, Neisseria
VFSDPDCPF

SEQ ID NO: 18724 - protein, 12 aa, Neisseria
KRLEHEFEKMTD

SEQ ID NO: 18725 - protein, 8 aa, Neisseria
HPDAARKA

SEQ ID NO: 18726 - protein, 8 aa, Neisseria
CQPDRAKA

SEQ ID NO: 18727 - protein, 9 aa, Neisseria
WMRKGKFPV

SEQ ID NO: 18728 - protein, 16 aa, Neisseria
GSICDNPVAETTSLGE

SEQ ID NO: 18729 - protein, 12 aa, Neisseria
FPNGRSQSGYSP

SEQ ID NO: 18730 - protein, 11 aa, Neisseria
PQLEEIIRKNQ

SEQ ID NO: 18731 - protein, 5 aa, Neisseria
MKTKL

SEQ ID NO: 18732 - protein, 16 aa, Neisseria
ANAEPAVKAESAGKSV

SEQ ID NO: 18733 - protein, 10 aa, Neisseria
LKARLEKTYS

SEQ ID NO: 18734 - protein, 19 aa, Neisseria
INIDTRKNLTEERAADLNK

SEQ ID NO: 18735 - protein, 16 aa, Neisseria
PLDKAIKEVRGNGKLK

SEQ ID NO: 18736 - protein, 7 aa, Neisseria
SDPDCPF

SEQ ID NO: 18737 - protein, 12 aa, Neisseria
KRLEHEFEKMTD

SEQ ID NO: 18738 - protein, 6 aa, Neisseria
DAARKA

SEQ ID NO: 18739 - protein, 7 aa, Neisseria
QPDRAKA

SEQ ID NO: 18740 - protein, 7 aa, Neisseria
WMRKGKF

SEQ ID NO: 18741 - protein, 5 aa, Neisseria
GRSQS

SEQ ID NO: 18742 - protein, 11 aa, Neisseria
PQLEEIIRKNQ

SEQ ID NO: 18743 - protein, 10 aa, Neisseria
RFPAAFRRYS

SEQ ID NO: 18744 - protein, 5 aa, Neisseria
KPAGT

SEQ ID NO: 18745 - protein, 13 aa, Neisseria
WHRVRRFKSNRRT

SEQ ID NO: 18746 - protein, 10 aa, Neisseria
GGKPLKKTYR

SEQ ID NO: 18747 - protein, 23 aa, Neisseria
NIAERARESPRRYGKRYADIGDD

SEQ ID NO: 18748 - protein, 8 aa, Neisseria
AVAHIVHL

SEQ ID NO: 18749 - protein, 5 aa, Neisseria
AMSYR

SEQ ID NO: 18750 - protein, 12 aa, Neisseria
SILGEPFATSFG

SEQ ID NO: 18751 - protein, 8 aa, Neisseria
AFSVLAHF

SEQ ID NO: 18752 - protein, 11 aa, Neisseria
TVGWSKYIHTV

SEQ ID NO: 18753 - protein, 9 aa, Neisseria
AVRTSSNRF

SEQ ID NO: 18754 - protein, 8 aa, Neisseria
FRRYSAFR

SEQ ID NO: 18755 - protein, 44 aa, Neisseria
PKPAGTPWHRVRRFKSNRRTRGGKPLKKTYRPRRAECRCRRART

SEQ ID NO: 18756 - protein, 27 aa, Neisseria
IAERARESPRRYGKRYADIGDDSDTIR

SEQ ID NO: 18757 - protein, 7 aa, Neisseria
RVFRLEY

SEQ ID NO: 18758 - protein, 18 aa, Neisseria
HTGRVSCEARREVEKAMS

SEQ ID NO: 18759 - protein, 5 aa, Neisseria
KMARS

SEQ ID NO: 18760 - protein, 8 aa, Neisseria
AVRTSSNR

SEQ ID NO: 18761 - protein, 36 aa, Neisseria
HRVRRFKSNRRTRGGKPLKKTYRPRRAECRCRRART

SEQ ID NO: 18762 - protein, 27 aa, Neisseria
IAERARESPRRYGKRYADIGDDSDTIR

SEQ ID NO: 18763 - protein, 7 aa, Neisseria
RVFRLEY

SEQ ID NO: 18764 - protein, 14 aa, Neisseria
VSCEARREVEKAMS

SEQ ID NO: 18765 - protein, 5 aa, Neisseria
FRQPR

SEQ ID NO: 18766 - protein, 6 aa, Neisseria
RFFRQP

SEQ ID NO: 18767 - protein, 6 aa, Neisseria
AFLHQI

SEQ ID NO: 18768 - protein, 6 aa, Neisseria
NLRGFP

SEQ ID NO: 18769 - protein, 13 aa, Neisseria
HQQRRIGKTLPQL

SEQ ID NO: 18770 - protein, 14 aa, Neisseria
TLAPMRPICRGTSG

SEQ ID NO: 18771 - protein, 8 aa, Neisseria
YIIKPLEH

SEQ ID NO: 18772 - protein, 9 aa, Neisseria
MARHDDQQG

SEQ ID NO: 18773 - protein, 6 aa, Neisseria
LPRRQQ

SEQ ID NO: 18774 - protein, 10 aa, Neisseria
FKLPRQRFHL

SEQ ID NO: 18775 - protein, 15 aa, Neisseria
HGCRAQFRQPRRIRL

SEQ ID NO: 18776 - protein, 15 aa, Neisseria
QTARQRSGGRTDQAA

SEQ ID NO: 18777 - protein, 14 aa, Neisseria
FRQPRIRQKQRHTR

SEQ ID NO: 18778 - protein, 5 aa, Neisseria
GPDFG

SEQ ID NO: 18779 - protein, 7 aa, Neisseria
QNAEHRA

SEQ ID NO: 18780 - protein, 28 aa, Neisseria
CIRKQNLRGFPSRRGHLRHQQRRIGKTL

SEQ ID NO: 18781 - protein, 25 aa, Neisseria
LGGTRFPDRNGVYPNRAGNGIRIRL

SEQ ID NO: 18782 - protein, 8 aa, Neisseria
PICRGTSG

SEQ ID NO: 18783 - protein, 11 aa, Neisseria
PYPYRRKQPQY

SEQ ID NO: 18784 - protein, 21 aa, Neisseria
SCKTNAVRTVRTAFRQRNQIS

SEQ ID NO: 18785 - protein, 8 aa, Neisseria
ARHDDQQG

SEQ ID NO: 18786 - protein, 6 aa, Neisseria
LPRRQQ

SEQ ID NO: 18787 - protein, 11 aa, Neisseria
AQFRQPRRIRL

SEQ ID NO: 18788 - protein, 13 aa, Neisseria
ARQRSGGRTDQAA

SEQ ID NO: 18789 - protein, 11 aa, Neisseria
PRIRQKQRHTR

SEQ ID NO: 18790 - protein, 5 aa, Neisseria
AEHRA

SEQ ID NO: 18791 - protein, 7 aa, Neisseria
CIRKQNL

SEQ ID NO: 18792 - protein, 17 aa, Neisseria
FPSRRGHLRHQQRRIGK

SEQ ID NO: 18793 - protein, 7 aa, Neisseria
RFPDRNG

SEQ ID NO: 18794 - protein, 5 aa, Neisseria
IRIRL

SEQ ID NO: 18795 - protein, 6 aa, Neisseria
PICRGT

SEQ ID NO: 18796 - protein, 7 aa, Neisseria
PYRRKQP

SEQ ID NO: 18797 - protein, 13 aa, Neisseria
RTVRTAFRQRNQI

SEQ ID NO: 18798 - protein, 5 aa, Neisseria
RTERV

SEQ ID NO: 18799 - protein, 11 aa, Neisseria
QPGDSLADVLA

SEQ ID NO: 18800 - protein, 10 aa, Neisseria
DEIARITEKY

SEQ ID NO: 18801 - protein, 5 aa, Neisseria
LPTLR

SEQ ID NO: 18802 - protein, 6 aa, Neisseria
LKEGDA

SEQ ID NO: 18803 - protein, 8 aa, Neisseria
LVYTRISS

SEQ ID NO: 18804 - protein, 16 aa, Neisseria
HANGVETLYAHLSAFS

SEQ ID NO: 18805 - protein, 7 aa, Neisseria
AKHRKYA

SEQ ID NO: 18806 - protein, 18 aa, Neisseria
STERTERVRPQRVEQKLP

SEQ ID NO: 18807 - protein, 6 aa, Neisseria
SWGGSG

SEQ ID NO: 18808 - protein, 9 aa, Neisseria
AVQPGDSLA

SEQ ID NO: 18809 - protein, 33 aa, Neisseria; identical to SEQ ID NO: 4930

SEQ ID NO: 18810 - protein, 9 aa, Neisseria
GGDGGAREV

SEQ ID NO: 18811 - protein, 30 aa, Neisseria; identical to SEQ ID NO: 4932

SEQ ID NO: 18812 - protein, 21 aa, Neisseria
TSARGSLARAEVPVEIRESLS

SEQ ID NO: 18813 - protein, 12 aa, Neisseria
FSLDGLKEGDAV

SEQ ID NO: 18814 - protein, 9 aa, Neisseria
EVVKGGTRH

SEQ ID NO: 18815 - protein, 29 aa, Neisseria
YYRSDKEGGGGGNYYDEDGRVLQEKGGFN

SEQ ID NO: 18816 - protein, 8 aa, Neisseria
RISSPFGY

SEQ ID NO: 18817 - protein, 7 aa, Neisseria
HTGIDYA

SEQ ID NO: 18818 - protein, 12 aa, Neisseria
PQGTPVRASADG

SEQ ID NO: 18819 - protein, 9 aa, Neisseria
FKGRKGGYG

SEQ ID NO: 18820 - protein, 6 aa, Neisseria
HANGVE

SEQ ID NO: 18821 - protein, 9 aa, Neisseria
AEGNVRGGE

SEQ ID NO: 18822 - protein, 10 aa, Neisseria
STGRSTGPHL

SEQ ID NO: 18823 - protein, 11 aa, Neisseria
YEARINGQPVN

SEQ ID NO: 18824 - protein, 12 aa, Neisseria
PTPELTQADKAA

SEQ ID NO: 18825 - protein, 8 aa, Neisseria
QKQKADAL

SEQ ID NO: 18826 - protein, 5 aa, Neisseria
VSQSD

SEQ ID NO: 18827 - protein, 7 aa, Neisseria
AKHRKYA

SEQ ID NO: 18828 - protein, 17 aa, Neisseria
STERTERVRPQRVEQKL

SEQ ID NO: 18829 - protein, 8 aa, Neisseria
VQPGDSLA

SEQ ID NO: 18830 - protein, 27 aa, Neisseria
GMARDEIARITEKYGGEADLRHLRADQ

SEQ ID NO: 18831 - protein, 6 aa, Neisseria
DGGARE

SEQ ID NO: 18832 - protein, 30 aa, Neisseria; identical to SEQ ID NO: 4932

SEQ ID NO: 18833 - protein, 20 aa, Neisseria
TSARGSLARAEVPVEIRESL

SEQ ID NO: 18834 - protein, 12 aa, Neisseria
FSLDGLKEGDAV

SEQ ID NO: 18835 - protein, 8 aa, Neisseria
EVVKGGTR

SEQ ID NO: 18836 - protein, 8 aa, Neisseria
RSDKEGGG

SEQ ID NO: 18837 - protein, 15 aa, Neisseria
YYDEDGRVLQEKGGF

SEQ ID NO: 18838 - protein, 7 aa, Neisseria
TPVRASA

SEQ ID NO: 18839 - protein, 7 aa, Neisseria
KGRKGGY

SEQ ID NO: 18840 - protein, 9 aa, Neisseria
AEGNVRGGE

SEQ ID NO: 18841 - protein, 6 aa, Neisseria
TGRSTG

SEQ ID NO: 18842 - protein, 5 aa, Neisseria
ARING

SEQ ID NO: 18843 - protein, 9 aa, Neisseria
ELTQADKAA

SEQ ID NO: 18844 - protein, 8 aa, Neisseria
QKQKADAL

SEQ ID NO: 18845 - protein, 13 aa, Neisseria
SLFASILMSALIA

SEQ ID NO: 18846 - protein, 7 aa, Neisseria
INAYWQQ

SEQ ID NO: 18847 - protein, 5 aa, Neisseria
PLAAY

SEQ ID NO: 18848 - protein, 8 aa, Neisseria
LSDGIKAF

SEQ ID NO: 18849 - protein, 6 aa, Neisseria
GSADMP

SEQ ID NO: 18850 - protein, 6 aa, Neisseria
VQKSLK

SEQ ID NO: 18851 - protein, 21 aa, Neisseria
SYPSFFDWPKTIEETLKKHPE

SEQ ID NO: 18852 - protein, 5 aa, Neisseria
NDPWD

SEQ ID NO: 18853 - protein, 16 aa, Neisseria
AQEYLKRVDRILEAAH

SEQ ID NO: 18854 - protein, 13 aa, Neisseria
QMRYLDKLLSEYL

SEQ ID NO: 18855 - protein, 5 aa, Neisseria
RYTDS

SEQ ID NO: 18856 - protein, 6 aa, Neisseria
AKIMEK

SEQ ID NO: 18857 - protein, 8 aa, Neisseria
SQNPINAY

SEQ ID NO: 18858 - protein, 9 aa, Neisseria
YHRNSPLEP

SEQ ID NO: 18859 - protein, 11 aa, Neisseria
GWWRSGAALQE

SEQ ID NO: 18860 - protein, 40 aa, Neisseria
LSGETPPTAQDGGSADMPSEAAAPETAPQTGETEWKQNTE

SEQ ID NO: 18861 - protein, 5 aa, Neisseria
RTGDK

SEQ ID NO: 18862 - protein, 20 aa, Neisseria
KSLKQQYGIESVNLSKQSTG

SEQ ID NO: 18863 - protein, 16 aa, Neisseria
FDWPKTIEETLKKHPE

SEQ ID NO: 18864 - protein, 6 aa, Neisseria
GPNDPW

SEQ ID NO: 18865 - protein, 7 aa, Neisseria
PVGKRYL

SEQ ID NO: 18866 - protein, 6 aa, Neisseria
ASDEWA

SEQ ID NO: 18867 - protein, 10 aa, Neisseria
YLKRVDRILE

SEQ ID NO: 18868 - protein, 15 aa, Neisseria
YMKKAKLDGQMRYLD

SEQ ID NO: 18869 - protein, 27 aa, Neisseria
LSGGKDRYTDSVNVNGKPVRYRSKDGI

SEQ ID NO: 18870 - protein, 10 aa, Neisseria
PSTQPSSTQP

SEQ ID NO: 18871 - protein, 37 aa, Neisseria
ETPPTAQDGGSADMPSEAAAPETAPQTGETEWKQNTE

SEQ ID NO: 18872 - protein, 7 aa, Neisseria
NLSKQST

SEQ ID NO: 18873 - protein, 12 aa, Neisseria
KTIEETLKKHPE

SEQ ID NO: 18874 - protein, 10 aa, Neisseria
YLKRVDRILE

SEQ ID NO: 18875 - protein, 15 aa, Neisseria
YMKKAKLDGQMRYLD

SEQ ID NO: 18876 - protein, 9 aa, Neisseria
SGGKDRYTD

SEQ ID NO: 18877 - protein, 16 aa, Neisseria
VNVNGKPVRYRSKDGI

SEQ ID NO: 18878 - protein, 9 aa, Neisseria
STQPSSTQP

SEQ ID NO: 18879 - protein, 15 aa, Neisseria
ASPWMKKLQSVAQGS

SEQ ID NO: 18880 - protein, 8 aa, Neisseria
TFRILQIG

SEQ ID NO: 18881 - protein, 16 aa, Neisseria
DFFTDSLRKRLQKTWG

SEQ ID NO: 18882 - protein, 8 aa, Neisseria
QLTQWSKW

SEQ ID NO: 18883 - protein, 10 aa, Neisseria
ADRMNDLAQT

SEQ ID NO: 18884 - protein, 15 aa, Neisseria
EQKWLDTVRQIRDSL

SEQ ID NO: 18885 - protein, 7 aa, Neisseria
ESLKNTL

SEQ ID NO: 18886 - protein, 15 aa, Neisseria
RLTEVQQMQRRIARQ

SEQ ID NO: 18887 - protein, 22 aa, Neisseria
YQRSAEMLADSLEELVRSAAIR

SEQ ID NO: 18888 - protein, 5 aa, Neisseria
MNPKH

SEQ ID NO: 18889 - protein, 11 aa, Neisseria
PSAPYTDTNGL

SEQ ID NO: 18890 - protein, 15 aa, Neisseria
DYGNASASPWMKKLQ

SEQ ID NO: 18891 - protein, 7 aa, Neisseria
AQGSGET

SEQ ID NO: 18892 - protein, 26 aa, Neisseria
GDSHTAGDFFTDSLRKRLQKTWGDGG

SEQ ID NO: 18893 - protein, 7 aa, Neisseria
ANVKGQR

SEQ ID NO: 18894 - protein, 20 aa, Neisseria
RHNGNWQSLTSRNNTGDFPL

SEQ ID NO: 18895 - protein, 11 aa, Neisseria
ASDGIASKQRV

SEQ ID NO: 18896 - protein, 10 aa, Neisseria
GNTVSANGGG

SEQ ID NO: 18897 - protein, 6 aa, Neisseria
ENPAGG

SEQ ID NO: 18898 - protein, 18 aa, Neisseria
QWSKWRADRMNDLAQTGA

SEQ ID NO: 18899 - protein, 19 aa, Neisseria
GTNEAFGDNIDIADTEQKW

SEQ ID NO: 18900 - protein, 11 aa, Neisseria
DTVRQIRDSLP

SEQ ID NO: 18901 - protein, 8 aa, Neisseria
APESLKNT

SEQ ID NO: 18902 - protein, 21 aa, Neisseria
RPVRLTEVQQMQRRIARQGQT

SEQ ID NO: 18903 - protein, 8 aa, Neisseria
GWAAKDGV

SEQ ID NO: 18904 - protein, 21 aa, Neisseria
SAKGYQRSAEMLADSLEELVR

SEQ ID NO: 18905 - protein, 5 aa, Neisseria
AAIRQ

SEQ ID NO: 18906 - protein, 5 aa, Neisseria
GSGET

SEQ ID NO: 18907 - protein, 11 aa, Neisseria
SLRKRLQKTWG

SEQ ID NO: 18908 - protein, 5 aa, Neisseria
VKGQR

SEQ ID NO: 18909 - protein, 7 aa, Neisseria
TSRNNTG

SEQ ID NO: 18910 - protein, 9 aa, Neisseria
DGIASKQRV

SEQ ID NO: 18911 - protein, 8 aa, Neisseria
WRADRMND

SEQ ID NO: 18912 - protein, 15 aa, Neisseria
AFGDNIDIADTEQKW

SEQ ID NO: 18913 - protein, 9 aa, Neisseria
VRQIRDSLP

SEQ ID NO: 18914 - protein, 7 aa, Neisseria
RPVRLTE

SEQ ID NO: 18915 - protein, 11 aa, Neisseria
QQMQRRIARQG

SEQ ID NO: 18916 - protein, 6 aa, Neisseria
AAKDGV

SEQ ID NO: 18917 - protein, 18 aa, Neisseria
GYQRSAEMLADSLEELVR

SEQ ID NO: 18918 - protein, 5 aa, Neisseria
AAIRQ

SEQ ID NO: 18919 - protein, 18 aa, Neisseria
DGRFLRTVEWLGNMLPHP

SEQ ID NO: 18920 - protein, 34 aa, Neisseria
VVSLLDADGLIKILTHTVKNFTGFAPLGTVLVSL

SEQ ID NO: 18921 - protein, 5 aa, Neisseria
SALMR

SEQ ID NO: 18922 - protein, 17 aa, Neisseria
GRHPLAGLAAAFAGVSG

SEQ ID NO: 18923 - protein, 14 aa, Neisseria
GTIDPLLAGITQQA

SEQ ID NO: 18924 - protein, 6 aa, Neisseria
VIALIG

SEQ ID NO: 18925 - protein, 6 aa, Neisseria
RHSNEI

SEQ ID NO: 18926 - protein, 7 aa, Neisseria
LSALLAW

SEQ ID NO: 18927 - protein, 8 aa, Neisseria
ILRHPETG

SEQ ID NO: 18928 - protein, 23 aa, Neisseria
YGRVTRSLRGEQEVVNAMAESMS

SEQ ID NO: 18929 - protein, 14 aa, Neisseria
FVAFFNWTNIGQYI

SEQ ID NO: 18930 - protein, 31 aa, Neisseria; identical to SEQ ID NO: 5056

SEQ ID NO: 18931 - protein, 9 aa, Neisseria
IAWIALFCI

SEQ ID NO: 18932 - protein, 16 aa, Neisseria
KEKQMSQTDTQRDGRF

SEQ ID NO: 18933 - protein, 18 aa, Neisseria
SVPDPRPVGAKGRADDGL

SEQ ID NO: 18934 - protein, 6 aa, Neisseria
LDADGL

SEQ ID NO: 18935 - protein, 6 aa, Neisseria
IAEKSG

SEQ ID NO: 18936 - protein, 9 aa, Neisseria
LTKSPRKLT

SEQ ID NO: 18937 - protein, 7 aa, Neisseria
LSNTASE

SEQ ID NO: 18938 - protein, 6 aa, Neisseria
LGRHPL

SEQ ID NO: 18939 - protein, 33 aa, Neisseria; identical to SEQ ID NO: 5064

SEQ ID NO: 18940 - protein, 15 aa, Neisseria
PADGILRHPETGLVS

SEQ ID NO: 18941 - protein, 12 aa, Neisseria
RVTRSLRGEQEV

SEQ ID NO: 18942 - protein, 5 aa, Neisseria
VGLGG

SEQ ID NO: 18943 - protein, 8 aa, Neisseria
KYKKDAGV

SEQ ID NO: 18944 - protein, 16 aa, Neisseria
KEKQMSQTDTQRDGRF

SEQ ID NO: 18945 - protein, 16 aa, Neisseria
PDPRPVGAKGRADDGL

SEQ ID NO: 18946 - protein, 6 aa, Neisseria
LDADGL

SEQ ID NO: 18947 - protein, 6 aa, Neisseria
IAEKSG

SEQ ID NO: 18948 - protein, 6 aa, Neisseria
KSPRKL

SEQ ID NO: 18949 - protein, 13 aa, Neisseria
LSQEEKDIRHSNE

SEQ ID NO: 18950 - protein, 7 aa, Neisseria
GILRHPE

SEQ ID NO: 18951 - protein, 12 aa, Neisseria
RVTRSLRGEQEV

SEQ ID NO: 18952 - protein, 7 aa, Neisseria
KYKKDAG

SEQ ID NO: 18953 - protein, 14 aa, Neisseria
LMMGLVEGFTEFLP

SEQ ID NO: 18954 - protein, 9 aa, Neisseria
FGNLIDFHS

SEQ ID NO: 18955 - protein, 6 aa, Neisseria
FSNVLH

SEQ ID NO: 18956 - protein, 5 aa, Neisseria
AAVMG

SEQ ID NO: 18957 - protein, 11 aa, Neisseria
LFGKQIKEYLF

SEQ ID NO: 18958 - protein, 10 aa, Neisseria
DVDALRPIDA

SEQ ID NO: 18959 - protein, 6 aa, Neisseria
VAQVFA

SEQ ID NO: 18960 - protein, 14 aa, Neisseria
AYDVLKHYRFFTLH

SEQ ID NO: 18961 - protein, 9 aa, Neisseria
IGFVAAFVS

SEQ ID NO: 18962 - protein, 6 aa, Neisseria
VKALLR

SEQ ID NO: 18963 - protein, 5 aa, Neisseria
HSNHK

SEQ ID NO: 18964 - protein, 8 aa, Neisseria
EYRQRFSN

SEQ ID NO: 18965 - protein, 9 aa, Neisseria
GVGKDRKAN

SEQ ID NO: 18966 - protein, 14 aa, Neisseria
VEKRQSRAEPKIVD

SEQ ID NO: 18967 - protein, 7 aa, Neisseria
DALRPID

SEQ ID NO: 18968 - protein, 8 aa, Neisseria
PGTSRSGS

SEQ ID NO: 18969 - protein, 7 aa, Neisseria
IERKTAT

SEQ ID NO: 18970 - protein, 7 aa, Neisseria
FVSKKNY

SEQ ID NO: 18971 - protein, 5 aa, Neisseria
YRQRF

SEQ ID NO: 18972 - protein, 8 aa, Neisseria
VGKDRKAN

SEQ ID NO: 18973 - protein, 14 aa, Neisseria
VEKRQSRAEPKIVD

SEQ ID NO: 18974 - protein, 7 aa, Neisseria
DALRPID

SEQ ID NO: 18975 - protein, 6 aa, Neisseria
TSRSGS

SEQ ID NO: 18976 - protein, 7 aa, Neisseria
IERKTAT

SEQ ID NO: 18977 - protein, 5 aa, Neisseria
VSKKN

SEQ ID NO: 18978 - protein, 15 aa, Neisseria
FYRILGVADNLYPYL

SEQ ID NO: 18979 - protein, 6 aa, Neisseria
TIIAGL

SEQ ID NO: 18980 - protein, 9 aa, Neisseria
ALELLRAQD

SEQ ID NO: 18981 - protein, 8 aa, Neisseria
AEMARASE

SEQ ID NO: 18982 - protein, 14 aa, Neisseria
LADFVHPIGNIGAC

SEQ ID NO: 18983 - protein, 14 aa, Neisseria
SMRTLASVVHGFGD

SEQ ID NO: 18984 - protein, 12 aa, Neisseria
LAHLDNMKRVTE

SEQ ID NO: 18985 - protein, 7 aa, Neisseria
WERRMMV

SEQ ID NO: 18986 - protein, 8 aa, Neisseria
LRAQDIET

SEQ ID NO: 18987 - protein, 19 aa, Neisseria
SKGAEMARASETAYARDEV

SEQ ID NO: 18988 - protein, 8 aa, Neisseria
GTFKTDGM

SEQ ID NO: 18989 - protein, 6 aa, Neisseria
FGDNLL

SEQ ID NO: 18990 - protein, 13 aa, Neisseria
RAADVVLKERRRL

SEQ ID NO: 18991 - protein, 5 aa, Neisseria
RETPL

SEQ ID NO: 18992 - protein, 10 aa, Neisseria
DNMKRVTEMG

SEQ ID NO: 18993 - protein, 12 aa, Neisseria
MYRKPQTADDIV

SEQ ID NO: 18994 - protein, 8 aa, Neisseria
IDTPDSAE

SEQ ID NO: 18995 - protein, 7 aa, Neisseria
WERRMMV

SEQ ID NO: 18996 - protein, 8 aa, Neisseria
LRAQDIET

SEQ ID NO: 18997 - protein, 10 aa, Neisseria
KGAEMARASE

SEQ ID NO: 18998 - protein, 7 aa, Neisseria
AYARDEV

SEQ ID NO: 18999 - protein, 5 aa, Neisseria
FKTDG

SEQ ID NO: 19000 - protein, 13 aa, Neisseria
RAADVVLKERRRL

SEQ ID NO: 19001 - protein, 8 aa, Neisseria
DNMKRVTE

SEQ ID NO: 19002 - protein, 12 aa, Neisseria
MYRKPQTADDIV

SEQ ID NO: 19003 - protein, 7 aa, Neisseria
DTPDSAE

SEQ ID NO: 19004 - protein, 25 aa, Neisseria
SHWRVLAELADGLPQHVSQLARMAD

SEQ ID NO: 19005 - protein, 17 aa, Neisseria
LNGFWQQMPAHIRGLLR

SEQ ID NO: 19006 - protein, 23 aa, Neisseria
HDGYWRLVRPLAVFDAEGLRELG

SEQ ID NO: 19007 - protein, 10 aa, Neisseria
RQGRKWSHRL

SEQ ID NO: 19008 - protein, 6 aa, Neisseria
RALSRL

SEQ ID NO: 19009 - protein, 12 aa, Neisseria
VENAASVQSLFQ

SEQ ID NO: 19010 - protein, 6 aa, Neisseria
ETLLAE

SEQ ID NO: 19011 - protein, 13 aa, Neisseria
FEGTVKGVDGQGV

SEQ ID NO: 19012 - protein, 13 aa, Neisseria
TVGSAPYRDLSPL

SEQ ID NO: 19013 - protein, 7 aa, Neisseria
AEWAEKV

SEQ ID NO: 19014 - protein, 9 aa, Neisseria
CAVCGEFKK

SEQ ID NO: 19015 - protein, 18 aa, Neisseria
YRHPEEHGSDRWFNALGS

SEQ ID NO: 19016 - protein, 6 aa, Neisseria
NLNRHA

SEQ ID NO: 19017 - protein, 11 aa, Neisseria
AVASGMMDAVC

SEQ ID NO: 19018 - protein, 10 aa, Neisseria
AAKVAEALPP

SEQ ID NO: 19019 - protein, 6 aa, Neisseria
HGLLNL

SEQ ID NO: 19020 - protein, 9 aa, Neisseria
RMADMKPQQ

SEQ ID NO: 19021 - protein, 9 aa, Neisseria
GLLRQHDGY

SEQ ID NO: 19022 - protein, 12 aa, Neisseria
EGLRELGERSGF

SEQ ID NO: 19023 - protein, 14 aa, Neisseria
LKHECASSNDEILE

SEQ ID NO: 19024 - protein, 9 aa, Neisseria
RIAPDKAHK

SEQ ID NO: 19025 - protein, 20 aa, Neisseria
HLQSKGRGRQGRKWSHRLGE

SEQ ID NO: 19026 - protein, 10 aa, Neisseria
FDRPQYELGS

SEQ ID NO: 19027 - protein, 7 aa, Neisseria
ACRRALS

SEQ ID NO: 19028 - protein, 7 aa, Neisseria
TQIKWPN

SEQ ID NO: 19029 - protein, 9 aa, Neisseria
LVVGRDKLG

SEQ ID NO: 19030 - protein, 9 aa, Neisseria
TVRTGGKTV

SEQ ID NO: 19031 - protein, 7 aa, Neisseria
LPKEVEN

SEQ ID NO: 19032 - protein, 9 aa, Neisseria
TASRRGNAD

SEQ ID NO: 19033 - protein, 7 aa, Neisseria
YARDGFA

SEQ ID NO: 19034 - protein, 8 aa, Neisseria
AANRDHGK

SEQ ID NO: 19035 - protein, 8 aa, Neisseria
LRDGETVF

SEQ ID NO: 19036 - protein, 10 aa, Neisseria
GTVKGVDGQG

SEQ ID NO: 19037 - protein, 33 aa, Neisseria; identical to SEQ ID NO: 5160

SEQ ID NO: 19038 - protein, 7 aa, Neisseria
DGGNSRL

SEQ ID NO: 19039 - protein, 12 aa, Neisseria
GSAPYRDLSPLG

SEQ ID NO: 19040 - protein, 11 aa, Neisseria
WAEKVDGNVRI

SEQ ID NO: 19041 - protein, 9 aa, Neisseria
GEFKKAQVQ

SEQ ID NO: 19042 - protein, 7 aa, Neisseria
QLARKIE

SEQ ID NO: 19043 - protein, 14 aa, Neisseria
NHYRHPEEHGSDRW

SEQ ID NO: 19044 - protein, 11 aa, Neisseria
ALGSRRFSRNA

SEQ ID NO: 19045 - protein, 10 aa, Neisseria
ALTDDGHYLG

SEQ ID NO: 19046 - protein, 6 aa, Neisseria
MKESLA

SEQ ID NO: 19047 - protein, 12 aa, Neisseria
ANLNRHAGKRYP

SEQ ID NO: 19048 - protein, 13 aa, Neisseria
GRLKEKTGAGKPV

SEQ ID NO: 19049 - protein, 9 aa, Neisseria
GGGAAKVAE

SEQ ID NO: 19050 - protein, 7 aa, Neisseria
NTVRVAD

SEQ ID NO: 19051 - protein, 9 aa, Neisseria
AEGGESEHT

SEQ ID NO: 19052 - protein, 9 aa, Neisseria
RMADMKPQQ

SEQ ID NO: 19053 - protein, 6 aa, Neisseria
GLLRQH

SEQ ID NO: 19054 - protein, 12 aa, Neisseria
EGLRELGERSGF

SEQ ID NO: 19055 - protein, 14 aa, Neisseria
LKHECASSNDEILE

SEQ ID NO: 19056 - protein, 9 aa, Neisseria
RIAPDKAHK

SEQ ID NO: 19057 - protein, 18 aa, Neisseria
QSKGRGRQGRKWSHRLGE

SEQ ID NO: 19058 - protein, 7 aa, Neisseria
ACRRALS

SEQ ID NO: 19059 - protein, 8 aa, Neisseria
VVGRDKLG

SEQ ID NO: 19060 - protein, 7 aa, Neisseria
TVRTGGK

SEQ ID NO: 19061 - protein, 5 aa, Neisseria
KEVEN

SEQ ID NO: 19062 - protein, 8 aa, Neisseria
ASRRGNAD

SEQ ID NO: 19063 - protein, 5 aa, Neisseria
ARDGF

SEQ ID NO: 19064 - protein, 8 aa, Neisseria
AANRDHGK

SEQ ID NO: 19065 - protein, 7 aa, Neisseria
RDGETVF

SEQ ID NO: 19066 - protein, 8 aa, Neisseria
GTVKGVDG

SEQ ID NO: 19067 - protein, 10 aa, Neisseria
ETAEGKQTVV

SEQ ID NO: 19068 - protein, 20 aa, Neisseria
ISLRSDDRPVSVPKRRDSER

SEQ ID NO: 19069 - protein, 5 aa, Neisseria
GNSRL

SEQ ID NO: 19070 - protein, 6 aa, Neisseria
PYRDLS

SEQ ID NO: 19071 - protein, 9 aa, Neisseria
WAEKVDGNV

SEQ ID NO: 19072 - protein, 8 aa, Neisseria
GEFKKAQV

SEQ ID NO: 19073 - protein, 7 aa, Neisseria
QLARKIE

SEQ ID NO: 19074 - protein, 11 aa, Neisseria
NHYRHPEEHGS

SEQ ID NO: 19075 - protein, 7 aa, Neisseria
GSRRFSR

SEQ ID NO: 19076 - protein, 7 aa, Neisseria
ALTDDGH

SEQ ID NO: 19077 - protein, 6 aa, Neisseria
MKESLA

SEQ ID NO: 19078 - protein, 11 aa, Neisseria
NLNRHAGKRYP

SEQ ID NO: 19079 - protein, 13 aa, Neisseria
GRLKEKTGAGKPV

SEQ ID NO: 19080 - protein, 7 aa, Neisseria
GAAKVAE

SEQ ID NO: 19081 - protein, 7 aa, Neisseria
NTVRVAD

SEQ ID NO: 19082 - protein, 8 aa, Neisseria
EGGESEHT

SEQ ID NO: 19083 - protein, 11 aa, Neisseria
GEILETVKMVA

SEQ ID NO: 19084 - protein, 12 aa, Neisseria
QNIYNKITTVGK

SEQ ID NO: 19085 - protein, 8 aa, Neisseria
IAQIAAAT

SEQ ID NO: 19086 - protein, 12 aa, Neisseria
VSVAQTLDKAAK

SEQ ID NO: 19087 - protein, 13 aa, Neisseria
GVSFIGGFSALVQ

SEQ ID NO: 19088 - protein, 9 aa, Neisseria
RSIPEAMKT

SEQ ID NO: 19089 - protein, 7 aa, Neisseria
GETIKRT

SEQ ID NO: 19090 - protein, 9 aa, Neisseria
GCAKIVVFC

SEQ ID NO: 19091 - protein, 15 aa, Neisseria
SDATTLTEVAEVVKK

SEQ ID NO: 19092 - protein, 14 aa, Neisseria
ITRVGELIGREASK

SEQ ID NO: 19093 - protein, 13 aa, Neisseria
VGDSVARILEEMG

SEQ ID NO: 19094 - protein, 5 aa, Neisseria
LNDAV

SEQ ID NO: 19095 - protein, 8 aa, Neisseria
SAVGGLSG

SEQ ID NO: 19096 - protein, 11 aa, Neisseria
LTLDKLEAMTA

SEQ ID NO: 19097 - protein, 10 aa, Neisseria
TPAHTISGII

SEQ ID NO: 19098 - protein, 12 aa, Neisseria
VGDSVEFGGLLG

SEQ ID NO: 19099 - protein, 7 aa, Neisseria
QSGEILE

SEQ ID NO: 19100 - protein, 10 aa, Neisseria
KMVADQNFDV

SEQ ID NO: 19101 - protein, 7 aa, Neisseria
ISTDIDV

SEQ ID NO: 19102 - protein, 8 aa, Neisseria
TVGKDLVA

SEQ ID NO: 19103 - protein, 5 aa, Neisseria
THADS

SEQ ID NO: 19104 - protein, 7 aa, Neisseria
TLDKAAK

SEQ ID NO: 19105 - protein, 11 aa, Neisseria
QKGMSPSDEVL

SEQ ID NO: 19106 - protein, 10 aa, Neisseria
SIPEAMKTTD

SEQ ID NO: 19107 - protein, 5 aa, Neisseria
GSTRA

SEQ ID NO: 19108 - protein, 17 aa, Neisseria
DAVRLAGETIKRTAEIT

SEQ ID NO: 19109 - protein, 7 aa, Neisseria
AVEDNPF

SEQ ID NO: 19110 - protein, 8 aa, Neisseria
HGSGEADA

SEQ ID NO: 19111 - protein, 8 aa, Neisseria
AALENSDA

SEQ ID NO: 19112 - protein, 7 aa, Neisseria
EVAEVVK

SEQ ID NO: 19113 - protein, 12 aa, Neisseria
RVGELIGREASK

SEQ ID NO: 19114 - protein, 11 aa, Neisseria
AVGDSVARILE

SEQ ID NO: 19115 - protein, 8 aa, Neisseria
DAVKKGGM

SEQ ID NO: 19116 - protein, 7 aa, Neisseria
VSEDEGM

SEQ ID NO: 19117 - protein, 5 aa, Neisseria
DKLEA

SEQ ID NO: 19118 - protein, 7 aa, Neisseria
VPGDTPA

SEQ ID NO: 19119 - protein, 6 aa, Neisseria
IADEAA

SEQ ID NO: 19120 - protein, 7 aa, Neisseria
INSKTTA

SEQ ID NO: 19121 - protein, 10 aa, Neisseria
TGKTVGDSVE

SEQ ID NO: 19122 - protein, 7 aa, Neisseria
PVKEGSC

SEQ ID NO: 19123 - protein, 8 aa, Neisseria
FVNRGGRI

SEQ ID NO: 19124 - protein, 5 aa, Neisseria
QSMKN

SEQ ID NO: 19125 - protein, 5 aa, Neisseria
QNFDV

SEQ ID NO: 19126 - protein, 7 aa, Neisseria
ISTDIDV

SEQ ID NO: 19127 - protein, 8 aa, Neisseria
TVGKDLVA

SEQ ID NO: 19128 - protein, 7 aa, Neisseria
TLDKAAK

SEQ ID NO: 19129 - protein, 9 aa, Neisseria
GMSPSDEVL

SEQ ID NO: 19130 - protein, 10 aa, Neisseria
SIPEAMKTTD

SEQ ID NO: 19131 - protein, 17 aa, Neisseria
DAVRLAGETIKRTAEIT

SEQ ID NO: 19132 - protein, 6 aa, Neisseria
AVEDNP

SEQ ID NO: 19133 - protein, 5 aa, Neisseria
GEADA

SEQ ID NO: 19134 - protein, 8 aa, Neisseria
AALENSDA

SEQ ID NO: 19135 - protein, 7 aa, Neisseria
EVAEVVK

SEQ ID NO: 19136 - protein, 12 aa, Neisseria
RVGELIGREASK

SEQ ID NO: 19137 - protein, 7 aa, Neisseria
SVARILE

SEQ ID NO: 19138 - protein, 8 aa, Neisseria
DAVKKGGM

SEQ ID NO: 19139 - protein, 7 aa, Neisseria
VSEDEGM

SEQ ID NO: 19140 - protein, 5 aa, Neisseria
DKLEA

SEQ ID NO: 19141 - protein, 6 aa, Neisseria
IADEAA

SEQ ID NO: 19142 - protein, 7 aa, Neisseria
TVGDSVE

SEQ ID NO: 19143 - protein, 7 aa, Neisseria
PVKEGSC

SEQ ID NO: 19144 - protein, 5 aa, Neisseria
RGGRI

SEQ ID NO: 19145 - protein, 5 aa, Neisseria
QSMKN

SEQ ID NO: 19146 - protein, 11 aa, Neisseria
GMDDPRTYGSG

SEQ ID NO: 19147 - protein, 5 aa, Neisseria
ATNVL

SEQ ID NO: 19148 - protein, 5 aa, Neisseria
DAAKG

SEQ ID NO: 19149 - protein, 12 aa, Neisseria
VAVLLARVLQEP

SEQ ID NO: 19150 - protein, 12 aa, Neisseria
VALAALVGHMWP

SEQ ID NO: 19151 - protein, 15 aa, Neisseria
SLAALTATIAAPLAA

SEQ ID NO: 19152 - protein, 16 aa, Neisseria
YGMDDPRTYGSGNPGA

SEQ ID NO: 19153 - protein, 8 aa, Neisseria
RSGKKKAA

SEQ ID NO: 19154 - protein, 12 aa, Neisseria
VLQEPLGLSDSA

SEQ ID NO: 19155 - protein, 7 aa, Neisseria
FKGGKGV

SEQ ID NO: 19156 - protein, 5 aa, Neisseria
RHKSN

SEQ ID NO: 19157 - protein, 12 aa, Neisseria
IKGKESKIGEKR

SEQ ID NO: 19158 - protein, 10 aa, Neisseria
YGMDDPRTYG

SEQ ID NO: 19159 - protein, 8 aa, Neisseria
RSGKKKAA

SEQ ID NO: 19160 - protein, 6 aa, Neisseria
KGGKGV

SEQ ID NO: 19161 - protein, 12 aa, Neisseria
IKGKESKIGEKR

SEQ ID NO: 19162 - protein, 9 aa, Neisseria
SGVKPYNAL

SEQ ID NO: 19163 - protein, 13 aa, Neisseria
CYNCHSQMIRPFR

SEQ ID NO: 19164 - protein, 12 aa, Neisseria
VGGRYSDEWHRI

SEQ ID NO: 19165 - protein, 9 aa, Neisseria
MKALRKVGT

SEQ ID NO: 19166 - protein, 8 aa, Neisseria
IAKAPEAL

SEQ ID NO: 19167 - protein, 7 aa, Neisseria
QLAEEKI

SEQ ID NO: 19168 - protein, 13 aa, Neisseria
AATQPASGVKPYN

SEQ ID NO: 19169 - protein, 15 aa, Neisseria
AGRDIYIREGCYNCH

SEQ ID NO: 19170 - protein, 12 aa, Neisseria
RPFRAETERYGH

SEQ ID NO: 19171 - protein, 5 aa, Neisseria
GESVY

SEQ ID NO: 19172 - protein, 24 aa, Neisseria
FQWGSKRTGPDLARVGGRYSDEWH

SEQ ID NO: 19173 - protein, 14 aa, Neisseria
LLNPRDVVPESNMP

SEQ ID NO: 19174 - protein, 7 aa, Neisseria
NKVDVDA

SEQ ID NO: 19175 - protein, 20 aa, Neisseria
KALRKVGTPYSDEEIAKAPE

SEQ ID NO: 19176 - protein, 9 aa, Neisseria
LANKSELDA

SEQ ID NO: 19177 - protein, 7 aa, Neisseria
QLAEEKI

SEQ ID NO: 19178 - protein, 9 aa, Neisseria
FRAETERYG

SEQ ID NO: 19179 - protein, 21 aa, Neisseria
GSKRTGPDLARVGGRYSDEWH

SEQ ID NO: 19180 - protein, 7 aa, Neisseria
NPRDVVP

SEQ ID NO: 19181 - protein, 7 aa, Neisseria
NKVDVDA

SEQ ID NO: 19182 - protein, 7 aa, Neisseria
KALRKVG

SEQ ID NO: 19183 - protein, 11 aa, Neisseria
YSDEEIAKAPE

SEQ ID NO: 19184 - protein, 9 aa, Neisseria
LANKSELDA

SEQ ID NO: 19185 - protein, 5 aa, Neisseria
FLSGL

SEQ ID NO: 19186 - protein, 6 aa, Neisseria
AGIADF

SEQ ID NO: 19187 - protein, 8 aa, Neisseria
TGFSGFVH

SEQ ID NO: 19188 - protein, 6 aa, Neisseria
AVVRGL

SEQ ID NO: 19189 - protein, 5 aa, Neisseria
KSGRQ

SEQ ID NO: 19190 - protein, 6 aa, Neisseria
FANVAG

SEQ ID NO: 19191 - protein, 13 aa, Neisseria
VFQNIADRPDRLI

SEQ ID NO: 19192 - protein, 10 aa, Neisseria
DVFNSVNGIE

SEQ ID NO: 19193 - protein, 5 aa, Neisseria
KSGIR

SEQ ID NO: 19194 - protein, 13 aa, Neisseria
SWARVLSAIPEMQ

SEQ ID NO: 19195 - protein, 8 aa, Neisseria
RKWLRRHP

SEQ ID NO: 19196 - protein, 11 aa, Neisseria
AEFLKQVQSHL

SEQ ID NO: 19197 - protein, 14 aa, Neisseria
HSPHAFATAVHSIP

SEQ ID NO: 19198 - protein, 6 aa, Neisseria
QRLSRL

SEQ ID NO: 19199 - protein, 5 aa, Neisseria
AAQKV

SEQ ID NO: 19200 - protein, 8 aa, Neisseria
VNTKPNTS

SEQ ID NO: 19201 - protein, 9 aa, Neisseria
RICRSRFVD

SEQ ID NO: 19202 - protein, 13 aa, Neisseria
VGTDGNKSGRQVS

SEQ ID NO: 19203 - protein, 14 aa, Neisseria
IADRPDRLIENKHG

SEQ ID NO: 19204 - protein, 9 aa, Neisseria
YHRDGDKVV

SEQ ID NO: 19205 - protein, 8 aa, Neisseria
NSVNGIER

SEQ ID NO: 19206 - protein, 8 aa, Neisseria
SLKSGIRR

SEQ ID NO: 19207 - protein, 6 aa, Neisseria
IADEPQ

SEQ ID NO: 19208 - protein, 26 aa, Neisseria
LQDKRVEIVLDDGRKWLRRHPDEKFD

SEQ ID NO: 19209 - protein, 6 aa, Neisseria
HLTPDG

SEQ ID NO: 19210 - protein, 12 aa, Neisseria
FPNKELLKQRLS

SEQ ID NO: 19211 - protein, 14 aa, Neisseria
WPESGRHVFDSSTV

SEQ ID NO: 19212 - protein, 7 aa, Neisseria
MTEPSAG

SEQ ID NO: 19213 - protein, 7 aa, Neisseria
VITDDNM

SEQ ID NO: 19214 - protein, 9 aa, Neisseria
VEYKYGRGI

SEQ ID NO: 19215 - protein, 11 aa, Neisseria
GTDGNKSGRQV

SEQ ID NO: 19216 - protein, 13 aa, Neisseria
IADRPDRLIENKH

SEQ ID NO: 19217 - protein, 8 aa, Neisseria
HRDGDKVV

SEQ ID NO: 19218 - protein, 6 aa, Neisseria
LKSGIR

SEQ ID NO: 19219 - protein, 6 aa, Neisseria
IADEPQ

SEQ ID NO: 19220 - protein, 26 aa, Neisseria
LQDKRVEIVLDDGRKWLRRHPDEKFD

SEQ ID NO: 19221 - protein, 11 aa, Neisseria
PNKELLKQRLS

SEQ ID NO: 19222 - protein, 7 aa, Neisseria
ESGRHVF

SEQ ID NO: 19223 - protein, 6 aa, Neisseria
TEPSAG

SEQ ID NO: 19224 - protein, 7 aa, Neisseria
VITDDNM

SEQ ID NO: 19225 - protein, 17 aa, Neisseria
VEVLQELFRQYRVARQL

SEQ ID NO: 19226 - protein, 8 aa, Neisseria
VFAAFQAV

SEQ ID NO: 19227 - protein, 8 aa, Neisseria
FQGFDNGF

SEQ ID NO: 19228 - protein, 6 aa, Neisseria
ADAFQG

SEQ ID NO: 19229 - protein, 15 aa, Neisseria
VFEVVGDITRRTTEA

SEQ ID NO: 19230 - protein, 12 aa, Neisseria
DGFTRINRCGQC

SEQ ID NO: 19231 - protein, 8 aa, Neisseria
HAFGDFID

SEQ ID NO: 19232 - protein, 6 aa, Neisseria
AFAGQV

SEQ ID NO: 19233 - protein, 19 aa, Neisseria
HHDFYRCFRHVVQSNIGNL

SEQ ID NO: 19234 - protein, 13 aa, Neisseria
YGNFLTVFQQFGC

SEQ ID NO: 19235 - protein, 8 aa, Neisseria
GNQYVAGF

SEQ ID NO: 19236 - protein, 5 aa, Neisseria
ASPFD

SEQ ID NO: 19237 - protein, 6 aa, Neisseria
RQLGDF

SEQ ID NO: 19238 - protein, 9 aa, Neisseria
FQRGFEHIE

SEQ ID NO: 19239 - protein, 6 aa, Neisseria
YDVFAQ

SEQ ID NO: 19240 - protein, 5 aa, Neisseria
LTADA

SEQ ID NO: 19241 - protein, 8 aa, Neisseria
AAGGDGKV

SEQ ID NO: 19242 - protein, 5 aa, Neisseria
HHFDG

SEQ ID NO: 19243 - protein, 6 aa, Neisseria
VETEGQ

SEQ ID NO: 19244 - protein, 10 aa, Neisseria
VRADGEAVEV

SEQ ID NO: 19245 - protein, 5 aa, Neisseria
FDNGF

SEQ ID NO: 19246 - protein, 14 aa, Neisseria
QSADERNHDFNVGQ

SEQ ID NO: 19247 - protein, 12 aa, Neisseria
GDITRRTTEAQH

SEQ ID NO: 19248 - protein, 16 aa, Neisseria
GHTDDGFTRINRCGQC

SEQ ID NO: 19249 - protein, 18 aa, Neisseria
IDVEVDRGRVTGDTAGNF

SEQ ID NO: 19250 - protein, 22 aa, Neisseria
QQGFGVDTDLAVDDKFHTRQAD

SEQ ID NO: 19251 - protein, 9 aa, Neisseria
VGEAECEFG

SEQ ID NO: 19252 - protein, 8 aa, Neisseria
VHHDFYRC

SEQ ID NO: 19253 - protein, 6 aa, Neisseria
GVDEAG

SEQ ID NO: 19254 - protein, 31 aa, Neisseria
AAADNGRNTQFARDDGGVAGTSAPVGHDGGS

SEQ ID NO: 19255 - protein, 6 aa, Neisseria
VDRKAA

SEQ ID NO: 19256 - protein, 10 aa, Neisseria
FDGFGTGLQD

SEQ ID NO: 19257 - protein, 7 aa, Neisseria
SPFDVHR

SEQ ID NO: 19258 - protein, 6 aa, Neisseria
DIDVGY

SEQ ID NO: 19259 - protein, 7 aa, Neisseria
VGKNHFD

SEQ ID NO: 19260 - protein, 7 aa, Neisseria
FAQDGRF

SEQ ID NO: 19261 - protein, 6 aa, Neisseria
QRGFEH

SEQ ID NO: 19262 - protein, 9 aa, Neisseria
VGSDKDDLV

SEQ ID NO: 19263 - protein, 8 aa, Neisseria
GIEGEHHT

SEQ ID NO: 19264 - protein, 5 aa, Neisseria
LTADA

SEQ ID NO: 19265 - protein, 6 aa, Neisseria
GGDGKV

SEQ ID NO: 19266 - protein, 6 aa, Neisseria
VETEGQ

SEQ ID NO: 19267 - protein, 10 aa, Neisseria
VRADGEAVEV

SEQ ID NO: 19268 - protein, 9 aa, Neisseria
QSADERNHD

SEQ ID NO: 19269 - protein, 12 aa, Neisseria
GDITRRTTEAQH

SEQ ID NO: 19270 - protein, 12 aa, Neisseria
GHTDDGFTRINR

SEQ ID NO: 19271 - protein, 14 aa, Neisseria
IDVEVDRGRVTGDT

SEQ ID NO: 19272 - protein, 15 aa, Neisseria
TDLAVDDKFHTRQAD

SEQ ID NO: 19273 - protein, 9 aa, Neisseria
VGEAECEFG

SEQ ID NO: 19274 - protein, 6 aa, Neisseria
GVDEAG

SEQ ID NO: 19275 - protein, 15 aa, Neisseria
DNGRNTQFARDDGGV

SEQ ID NO: 19276 - protein, 5 aa, Neisseria
VGHDG

SEQ ID NO: 19277 - protein, 6 aa, Neisseria
VDRKAA

SEQ ID NO: 19278 - protein, 9 aa, Neisseria
VGSDKDDLV

SEQ ID NO: 19279 - protein, 7 aa, Neisseria
IEGEHHT

SEQ ID NO: 19280 - protein, 8 aa, Neisseria
NLFQFLAV

SEQ ID NO: 19281 - protein, 22 aa, Neisseria
GAVDALKQFNNDADGISGSFTQ

SEQ ID NO: 19282 - protein, 8 aa, Neisseria
QVTKSSQD

SEQ ID NO: 19283 - protein, 13 aa, Neisseria
KQFNNDADGISGS

SEQ ID NO: 19284 - protein, 14 aa, Neisseria
TVQSKKKTQTAHGT

SEQ ID NO: 19285 - protein, 9 aa, Neisseria
YTSPYKQTI

SEQ ID NO: 19286 - protein, 15 aa, Neisseria
QVTKSSQDQAIGGSP

SEQ ID NO: 19287 - protein, 21 aa, Neisseria
LSNKTALESSYTLKEDGSSNG

SEQ ID NO: 19288 - protein, 9 aa, Neisseria
ATPKRNNAG

SEQ ID NO: 19289 - protein, 5 aa, Neisseria
FKGGN

SEQ ID NO: 19290 - protein, 10 aa, Neisseria
QLKDSFGNQT

SEQ ID NO: 19291 - protein, 11 aa, Neisseria
NTNPQLSRGAF

SEQ ID NO: 19292 - protein, 9 aa, Neisseria
FTPPKGVDV

SEQ ID NO: 19293 - protein, 8 aa, Neisseria
FNNDADGI

SEQ ID NO: 19294 - protein, 9 aa, Neisseria
VQSKKKTQT

SEQ ID NO: 19295 - protein, 9 aa, Neisseria
TKSSQDQAI

SEQ ID NO: 19296 - protein, 10 aa, Neisseria
YTLKEDGSSN

SEQ ID NO: 19297 - protein, 7 aa, Neisseria
TPKRNNA

SEQ ID NO: 19298 - protein, 7 aa, Neisseria
QLKDSFG

SEQ ID NO: 19299 - protein, 7 aa, Neisseria
YREANTW

SEQ ID NO: 19300 - protein, 15 aa, Neisseria
SSTSNFASAAEMRSL

SEQ ID NO: 19301 - protein, 8 aa, Neisseria
SLYREANT

SEQ ID NO: 19302 - protein, 5 aa, Neisseria
RKVSC

SEQ ID NO: 19303 - protein, 26 aa, Neisseria
PANDASGRSSAVAEERTATEMSAPPA

SEQ ID NO: 19304 - protein, 11 aa, Neisseria
SASSCSGKGVS

SEQ ID NO: 19305 - protein, 14 aa, Neisseria
LPTRASSATSSTSN

SEQ ID NO: 19306 - protein, 7 aa, Neisseria
AEMRSLR

SEQ ID NO: 19307 - protein, 7 aa, Neisseria
LCARNAR

SEQ ID NO: 19308 - protein, 5 aa, Neisseria
SLYRE

SEQ ID NO: 19309 - protein, 20 aa, Neisseria
DASGRSSAVAEERTATEMSA

SEQ ID NO: 19310 - protein, 7 aa, Neisseria
CSGKGVS

SEQ ID NO: 19311 - protein, 5 aa, Neisseria
TRASS

SEQ ID NO: 19312 - protein, 7 aa, Neisseria
AEMRSLR

SEQ ID NO: 19313 - protein, 16 aa, Neisseria
LTALLKCLSLLPLSCL

SEQ ID NO: 19314 - protein, 5 aa, Neisseria
TLGNR

SEQ ID NO: 19315 - protein, 28 aa, Neisseria
PAFFRKPEDIETMFKAVHGWEHVQQALD

SEQ ID NO: 19316 - protein, 18 aa, Neisseria
AMYKPPKIKAIDKIMQAG

SEQ ID NO: 19317 - protein, 12 aa, Neisseria
IQGVKQIIKALR

SEQ ID NO: 19318 - protein, 10 aa, Neisseria
GVWVDFFGKP

SEQ ID NO: 19319 - protein, 6 aa, Neisseria
LGNRLG

SEQ ID NO: 19320 - protein, 8 aa, Neisseria
LKEDRARI

SEQ ID NO: 19321 - protein, 12 aa, Neisseria
RQAGMNPDPKTV

SEQ ID NO: 19322 - protein, 7 aa, Neisseria
ETAKGGL

SEQ ID NO: 19323 - protein, 9 aa, Neisseria
FRKPEDIET

SEQ ID NO: 19324 - protein, 6 aa, Neisseria
ALDKHE

SEQ ID NO: 19325 - protein, 11 aa, Neisseria
GSYDLGGRYIS

SEQ ID NO: 19326 - protein, 5 aa, Neisseria
LPFPL

SEQ ID NO: 19327 - protein, 14 aa, Neisseria
YKPPKIKAIDKIMQ

SEQ ID NO: 19328 - protein, 13 aa, Neisseria
GRVRGKGKTAPTS

SEQ ID NO: 19329 - protein, 12 aa, Neisseria
QIIKALRSGEAT

SEQ ID NO: 19330 - protein, 14 aa, Neisseria
PDHVPSPQEGGEGV

SEQ ID NO: 19331 - protein, 9 aa, Neisseria
CERLPGGQG

SEQ ID NO: 19332 - protein, 13 aa, Neisseria
PVQGELNGDKAHD

SEQ ID NO: 19333 - protein, 7 aa, Neisseria
YNRYKMP

SEQ ID NO: 19334 - protein, 8 aa, Neisseria
LKEDRARI

SEQ ID NO: 19335 - protein, 12 aa, Neisseria
RQAGMNPDPKTV

SEQ ID NO: 19336 - protein, 7 aa, Neisseria
ETAKGGL

SEQ ID NO: 19337 - protein, 9 aa, Neisseria
FRKPEDIET

SEQ ID NO: 19338 - protein, 6 aa, Neisseria
ALDKHE

SEQ ID NO: 19339 - protein, 13 aa, Neisseria
KPPKIKAIDKIMQ

SEQ ID NO: 19340 - protein, 11 aa, Neisseria
GRVRGKGKTAP

SEQ ID NO: 19341 - protein, 10 aa, Neisseria
QIIKALRSGE

SEQ ID NO: 19342 - protein, 9 aa, Neisseria
VPSPQEGGE

SEQ ID NO: 19343 - protein, 12 aa, Neisseria
VQGELNGDKAHD

SEQ ID NO: 19344 - protein, 12 aa, Neisseria
EVGRVAHCGGGV

SEQ ID NO: 19345 - protein, 11 aa, Neisseria
RVVHQVEQGAR

SEQ ID NO: 19346 - protein, 8 aa, Neisseria
AVDFQRRF

SEQ ID NO: 19347 - protein, 12 aa, Neisseria
ATRTVDRDLAEV

SEQ ID NO: 19348 - protein, 7 aa, Neisseria
GNEVARC

SEQ ID NO: 19349 - protein, 11 aa, Neisseria
QVKRMIRHFFR

SEQ ID NO: 19350 - protein, 17 aa, Neisseria
VHRPFRKLAALDGFVQV

SEQ ID NO: 19351 - protein, 17 aa, Neisseria
GDDFGGFFVGQVFNALL

SEQ ID NO: 19352 - protein, 14 aa, Neisseria
FVQVGELTRVAQEE

SEQ ID NO: 19353 - protein, 25 aa, Neisseria
GFFADFAEDFGAGVFGDVVRYGKRT

SEQ ID NO: 19354 - protein, 11 aa, Neisseria
FGDDFAHEVGE

SEQ ID NO: 19355 - protein, 8 aa, Neisseria
RQQRAART

SEQ ID NO: 19356 - protein, 6 aa, Neisseria
CGGGVA

SEQ ID NO: 19357 - protein, 6 aa, Neisseria
EQGARL

SEQ ID NO: 19358 - protein, 16 aa, Neisseria
PVRRVAVDFQRRFGEV

SEQ ID NO: 19359 - protein, 12 aa, Neisseria
RATRTVDRDLAE

SEQ ID NO: 19360 - protein, 13 aa, Neisseria
GADTGNEVARCEG

SEQ ID NO: 19361 - protein, 10 aa, Neisseria
PNFGQVKRMI

SEQ ID NO: 19362 - protein, 14 aa, Neisseria
GFRHDLDVHRPFRK

SEQ ID NO: 19363 - protein, 7 aa, Neisseria
VGDDFGG

SEQ ID NO: 19364 - protein, 7 aa, Neisseria
MEFHPKT

SEQ ID NO: 19365 - protein, 7 aa, Neisseria
VGMRTEA

SEQ ID NO: 19366 - protein, 9 aa, Neisseria
GQQRPEVPV

SEQ ID NO: 19367 - protein, 15 aa, Neisseria
ELTRVAQEEHGRVVA

SEQ ID NO: 19368 - protein, 8 aa, Neisseria
ELQRKTAD

SEQ ID NO: 19369 - protein, 8 aa, Neisseria
CHGGETGE

SEQ ID NO: 19370 - protein, 6 aa, Neisseria
FAEDFG

SEQ ID NO: 19371 - protein, 13 aa, Neisseria
VVRYGKRTERART

SEQ ID NO: 19372 - protein, 9 aa, Neisseria
FGDDFAHEV

SEQ ID NO: 19373 - protein, 14 aa, Neisseria
QILRQQRAARTGGQ

SEQ ID NO: 19374 - protein, 7 aa, Neisseria
VGNRRAV

SEQ ID NO: 19375 - protein, 9 aa, Neisseria
  VARIANT 4: Xaa is any amino acid
FGGXHRSCS

SEQ ID NO: 19376 - protein, 29 aa, Neisseria
  VARIANT 3: Xaa is any amino acid
GQXGGKRLTVRFGGKRIRNRFLDCNKFLE

SEQ ID NO: 19377 - protein, 11 aa, Neisseria
MDATIRQDFRY

SEQ ID NO: 19378 - protein, 6 aa, Neisseria
EQGARL

SEQ ID NO: 19379 - protein, 15 aa, Neisseria
PVRRVAVDFQRRFGE

SEQ ID NO: 19380 - protein, 12 aa, Neisseria
RATRTVDRDLAE

SEQ ID NO: 19381 - protein, 11 aa, Neisseria
DTGNEVARCEG

SEQ ID NO: 19382 - protein, 6 aa, Neisseria
QVKRMI

SEQ ID NO: 19383 - protein, 5 aa, Neisseria
HDLDV

SEQ ID NO: 19384 - protein, 5 aa, Neisseria
RPFRK

SEQ ID NO: 19385 - protein, 5 aa, Neisseria
VGDDF

SEQ ID NO: 19386 - protein, 5 aa, Neisseria
MEFHP

SEQ ID NO: 19387 - protein, 7 aa, Neisseria
VGMRTEA

SEQ ID NO: 19388 - protein, 5 aa, Neisseria
QRPEV

SEQ ID NO: 19389 - protein, 15 aa, Neisseria
ELTRVAQEEHGRVVA

SEQ ID NO: 19390 - protein, 8 aa, Neisseria
ELQRKTAD

SEQ ID NO: 19391 - protein, 6 aa, Neisseria
GGETGE

SEQ ID NO: 19392 - protein, 6 aa, Neisseria
FAEDFG

SEQ ID NO: 19393 - protein, 12 aa, Neisseria
VRYGKRTERART

SEQ ID NO: 19394 - protein, 9 aa, Neisseria
FGDDFAHEV

SEQ ID NO: 19395 - protein, 12 aa, Neisseria
ILRQQRAARTGG

SEQ ID NO: 19396 - protein, 6 aa, Neisseria
GNRRAV

SEQ ID NO: 19397 - protein, 7 aa, Neisseria
  VARIANT 1: Xaa is any amino acid
XGGKRLT

SEQ ID NO: 19398 - protein, 12 aa, Neisseria
FGGKRIRNRFLD

SEQ ID NO: 19399 - protein, 11 aa, Neisseria
MDATIRQDFRY

SEQ ID NO: 19400 - protein, 16 aa, Neisseria
TEWLHGWVGAINDPMW

SEQ ID NO: 19401 - protein, 6 aa, Neisseria
  VARIANT 5: Xaa is any amino acid
YLVYXL

SEQ ID NO: 19402 - protein, 6 aa, Neisseria
GRSIKE

SEQ ID NO: 19403 - protein, 13 aa, Neisseria
GITPFQAFVTGLA

SEQ ID NO: 19404 - protein, 11 aa, Neisseria
SSLAQLFKVRD

SEQ ID NO: 19405 - protein, 9 aa, Neisseria
GLGQKWLGV

SEQ ID NO: 19406 - protein, 5 aa, Neisseria
IADTV

SEQ ID NO: 19407 - protein, 10 aa, Neisseria
GGIRRISKAA

SEQ ID NO: 19408 - protein, 7 aa, Neisseria
VFGQIFS

SEQ ID NO: 19409 - protein, 8 aa, Neisseria
GGLLGGLI

SEQ ID NO: 19410 - protein, 8 aa, Neisseria
APNAAAAA

SEQ ID NO: 19411 - protein, 12 aa, Neisseria
QGMIQMLGVFVD

SEQ ID NO: 19412 - protein, 5 aa, Neisseria
PYGDL

SEQ ID NO: 19413 - protein, 7 aa, Neisseria
VSQVGQW

SEQ ID NO: 19414 - protein, 6 aa, Neisseria
TAVFRM

SEQ ID NO: 19415 - protein, 6 aa, Neisseria
YFGAVA

SEQ ID NO: 19416 - protein, 14 aa, Neisseria
IMAWINLVAILLLS

SEQ ID NO: 19417 - protein, 5 aa, Neisseria
MNENF

SEQ ID NO: 19418 - protein, 19 aa, Neisseria
GRSIKEMLGGRKQGDDPHG

SEQ ID NO: 19419 - protein, 15 aa, Neisseria
KVRDYDNHHFRGGPA

SEQ ID NO: 19420 - protein, 8 aa, Neisseria
RRISKAAE

SEQ ID NO: 19421 - protein, 19 aa, Neisseria
GIKRGLYSNEAGMGSAPNA

SEQ ID NO: 19422 - protein, 7 aa, Neisseria
AEVKHPV

SEQ ID NO: 19423 - protein, 8 aa, Neisseria
QPYGDLSG

SEQ ID NO: 19424 - protein, 7 aa, Neisseria
AYAESNV

SEQ ID NO: 19425 - protein, 32 aa, Neisseria; identical to SEQ ID NO: 5466

SEQ ID NO: 19426 - protein, 19 aa, Neisseria
GRSIKEMLGGRKQGDDPHG

SEQ ID NO: 19427 - protein, 9 aa, Neisseria
KVRDYDNHH

SEQ ID NO: 19428 - protein, 8 aa, Neisseria
RRISKAAE

SEQ ID NO: 19429 - protein, 7 aa, Neisseria
GIKRGLY

SEQ ID NO: 19430 - protein, 5 aa, Neisseria
AEVKH

SEQ ID NO: 19431 - protein, 13 aa, Neisseria
LKMGKDPEFKLSE

SEQ ID NO: 19432 - protein, 9 aa, Neisseria
PGLKRRIKS

SEQ ID NO: 19433 - protein, 15 aa, Neisseria
RAAGVARGLHSEFAR

SEQ ID NO: 19434 - protein, 19 aa, Neisseria
DVRFFAQVEEIGQDFFADA

SEQ ID NO: 19435 - protein, 12 aa, Neisseria
AGECADEVSDKT

SEQ ID NO: 19436 - protein, 16 aa, Neisseria
ESAQSAAGGGLTDGFG

SEQ ID NO: 19437 - protein, 7 aa, Neisseria
CGKTVGV

SEQ ID NO: 19438 - protein, 5 aa, Neisseria
GVFDA

SEQ ID NO: 19439 - protein, 6 aa, Neisseria
VADVLR

SEQ ID NO: 19440 - protein, 26 aa, Neisseria
FGGVAGDVGGGADGVAQGLFGEIGGA

SEQ ID NO: 19441 - protein, 8 aa, Neisseria
VTAEEIAF

SEQ ID NO: 19442 - protein, 8 aa, Neisseria
HEARCGGN

SEQ ID NO: 19443 - protein, 9 aa, Neisseria
IAAAERAGD

SEQ ID NO: 19444 - protein, 5 aa, Neisseria
EEIGQ

SEQ ID NO: 19445 - protein, 6 aa, Neisseria
AVDQET

SEQ ID NO: 19446 - protein, 42 aa, Neisseria
LAVERSAGECADEVSDKTARNGGIEEDGVVACRDAAAAESAQ

SEQ ID NO: 19447 - protein, 8 aa, Neisseria
AGGGLTDG

SEQ ID NO: 19448 - protein, 8 aa, Neisseria
GGNDAAGN

SEQ ID NO: 19449 - protein, 5 aa, Neisseria
LHRRA

SEQ ID NO: 19450 - protein, 6 aa, Neisseria
ADGGFR

SEQ ID NO: 19451 - protein, 7 aa, Neisseria
GVGKSGA

SEQ ID NO: 19452 - protein, 9 aa, Neisseria
DVGGGADGV

SEQ ID NO: 19453 - protein, 7 aa, Neisseria
DVNGNVQ

SEQ ID NO: 19454 - protein, 8 aa, Neisseria
VTAEEIAF

SEQ ID NO: 19455 - protein, 6 aa, Neisseria
HEARCG

SEQ ID NO: 19456 - protein, 9 aa, Neisseria
IAAAERAGD

SEQ ID NO: 19457 - protein, 6 aa, Neisseria
AVDQET

SEQ ID NO: 19458 - protein, 42 aa, Neisseria; identical to SEQ ID NO: 19446

SEQ ID NO: 19459 - protein, 5 aa, Neisseria
NDAAG

SEQ ID NO: 19460 - protein, 5 aa, Neisseria
LHRRA

SEQ ID NO: 19461 - protein, 8 aa, Neisseria
VGGGADGV

SEQ ID NO: 19462 - protein, 15 aa, Neisseria
VVERLGRFHRALTAG

SEQ ID NO: 19463 - protein, 14 aa, Neisseria
MAITQLAQTTLRSV

SEQ ID NO: 19464 - protein, 8 aa, Neisseria
VSALDEAA

SEQ ID NO: 19465 - protein, 8 aa, Neisseria
EILRSMQA

SEQ ID NO: 19466 - protein, 5 aa, Neisseria
KIEQI

SEQ ID NO: 19467 - protein, 10 aa, Neisseria
SNAEKIARIN

SEQ ID NO: 19468 - protein, 8 aa, Neisseria
AIRQIAAA

SEQ ID NO: 19469 - protein, 11 aa, Neisseria
QYVAAFNNLAK

SEQ ID NO: 19470 - protein, 23 aa, Neisseria
ANVADIGSLISAGMKIIDSSKTA

SEQ ID NO: 19471 - protein, 8 aa, Neisseria
ERLGRFHR

SEQ ID NO: 19472 - protein, 13 aa, Neisseria
HSLKEIPLDVPSQ

SEQ ID NO: 19473 - protein, 11 aa, Neisseria
CITRDNTQLTV

SEQ ID NO: 19474 - protein, 7 aa, Neisseria
TDPKLAS

SEQ ID NO: 19475 - protein, 14 aa, Neisseria
MELDKTFEERDEIN

SEQ ID NO: 19476 - protein, 7 aa, Neisseria
ALDEAAG

SEQ ID NO: 19477 - protein, 10 aa, Neisseria
LRYEIKDLVP

SEQ ID NO: 19478 - protein, 21 aa, Neisseria
ITAEREKRARIAESEGRKIEQ

SEQ ID NO: 19479 - protein, 20 aa, Neisseria
NLASGQREAEIQQSEGEAQA

SEQ ID NO: 19480 - protein, 23 aa, Neisseria
NASNAEKIARINRAKGEAESLRL

SEQ ID NO: 19481 - protein, 7 aa, Neisseria
ANAEAIR

SEQ ID NO: 19482 - protein, 10 aa, Neisseria
QTQGGADAVN

SEQ ID NO: 19483 - protein, 7 aa, Neisseria
LAKESNT

SEQ ID NO: 19484 - protein, 13 aa, Neisseria
AGMKIIDSSKTAK

SEQ ID NO: 19485 - protein, 8 aa, Neisseria
ERLGRFHR

SEQ ID NO: 19486 - protein, 8 aa, Neisseria
HSLKEIPL

SEQ ID NO: 19487 - protein, 6 aa, Neisseria
ITRDNT

SEQ ID NO: 19488 - protein, 5 aa, Neisseria
TDPKL

SEQ ID NO: 19489 - protein, 14 aa, Neisseria
MELDKTFEERDEIN

SEQ ID NO: 19490 - protein, 6 aa, Neisseria
ALDEAA

SEQ ID NO: 19491 - protein, 10 aa, Neisseria
LRYEIKDLVP

SEQ ID NO: 19492 - protein, 21 aa, Neisseria
ITAEREKRARIAESEGRKIEQ

SEQ ID NO: 19493 - protein, 17 aa, Neisseria
SGQREAEIQQSEGEAQA

SEQ ID NO: 19494 - protein, 21 aa, Neisseria
SNAEKIARINRAKGEAESLRL

SEQ ID NO: 19495 - protein, 7 aa, Neisseria
ANAEAIR

SEQ ID NO: 19496 - protein, 6 aa, Neisseria
LAKESN

SEQ ID NO: 19497 - protein, 10 aa, Neisseria
KIIDSSKTAK

SEQ ID NO: 19498 - protein, 16 aa, Neisseria
LTKAADGQVCRAFSSL

SEQ ID NO: 19499 - protein, 7 aa, Neisseria
KPSRRAL

SEQ ID NO: 19500 - protein, 8 aa, Neisseria
ASGKISLP

SEQ ID NO: 19501 - protein, 29 aa, Neisseria
PPNNSTTTSTSSRATSSNGSLTKAADGQV

SEQ ID NO: 19502 - protein, 30 aa, Neisseria; identical to SEQ ID NO: 5542

SEQ ID NO: 19503 - protein, 10 aa, Neisseria
PTVPKPKRPM

SEQ ID NO: 19504 - protein, 8 aa, Neisseria
SPCKPTEM

SEQ ID NO: 19505 - protein, 7 aa, Neisseria
KPSRRAL

SEQ ID NO: 19506 - protein, 8 aa, Neisseria
TSSRATSS

SEQ ID NO: 19507 - protein, 7 aa, Neisseria
SLTKAAD

SEQ ID NO: 19508 - protein, 18 aa, Neisseria
KSHTAEIRISRPKRREIS

SEQ ID NO: 19509 - protein, 6 aa, Neisseria
LSRNTA

SEQ ID NO: 19510 - protein, 9 aa, Neisseria
TVPKPKRPM

SEQ ID NO: 19511 - protein, 6 aa, Neisseria
CKPTEM

SEQ ID NO: 19512 - protein, 9 aa, Neisseria
VKTVSKPAK

SEQ ID NO: 19513 - protein, 9 aa, Neisseria
QARLAKGGN

SEQ ID NO: 19514 - protein, 9 aa, Neisseria
INALQSVLD

SEQ ID NO: 19515 - protein, 5 aa, Neisseria
MKSKL

SEQ ID NO: 19516 - protein, 18 aa, Neisseria
VYTTKPSKSCLSTDLPPI

SEQ ID NO: 19517 - protein, 24 aa, Neisseria
NYSSERYIPPQTSEPTPSPSNGGQ

SEQ ID NO: 19518 - protein, 7 aa, Neisseria
VKYKAPV

SEQ ID NO: 19519 - protein, 45 aa, Neisseria
TVSKPAKSNTPPPQQAPSNNSRRSILETELSNERKALVEAQKMLS

SEQ ID NO: 19520 - protein, 9 aa, Neisseria
RLAKGGNIN

SEQ ID NO: 19521 - protein, 7 aa, Neisseria
VLDRQQN

SEQ ID NO: 19522 - protein, 7 aa, Neisseria
LQRELGR

SEQ ID NO: 19523 - protein, 5 aa, Neisseria
MKSKL

SEQ ID NO: 19524 - protein, 7 aa, Neisseria
KPSKSCL

SEQ ID NO: 19525 - protein, 6 aa, Neisseria
SSERYI

SEQ ID NO: 19526 - protein, 12 aa, Neisseria
QTSEPTPSPSNG

SEQ ID NO: 19527 - protein, 7 aa, Neisseria
VKYKAPV

SEQ ID NO: 19528 - protein, 12 aa, Neisseria
TVSKPAKSNTPP

SEQ ID NO: 19529 - protein, 31 aa, Neisseria; identical to SEQ ID NO: 5567

SEQ ID NO: 19530 - protein, 7 aa, Neisseria
VLDRQQN

SEQ ID NO: 19531 - protein, 7 aa, Neisseria
LQRELGR

SEQ ID NO: 19532 - protein, 8 aa, Neisseria
KIVESCVK

SEQ ID NO: 19533 - protein, 32 aa, Neisseria
MWEQPLDRLSEKQISSFGKLGAQEQLDLLGGA

SEQ ID NO: 19534 - protein, 26 aa, Neisseria
MTEPKHEMPTEEQVAARKKAKAKIRT

SEQ ID NO: 19535 - protein, 17 aa, Neisseria
AMSKPQAKQKIVESCVK

SEQ ID NO: 19536 - protein, 19 aa, Neisseria
KWQNDLRARGLDSNNTRLT

SEQ ID NO: 19537 - protein, 19 aa, Neisseria
QPLDRLSEKQISSFGKLGA

SEQ ID NO: 19538 - protein, 17 aa, Neisseria
NAFETRDKQCVADLKSE

SEQ ID NO: 19539 - protein, 26 aa, Neisseria
MTEPKHEMPTEEQVAARKKAKAKIRT

SEQ ID NO: 19540 - protein, 16 aa, Neisseria
AMSKPQAKQKIVESCV

SEQ ID NO: 19541 - protein, 15 aa, Neisseria
WQNDLRARGLDSNNT

SEQ ID NO: 19542 - protein, 10 aa, Neisseria
PLDRLSEKQI

SEQ ID NO: 19543 - protein, 15 aa, Neisseria
FETRDKQCVADLKSE

SEQ ID NO: 19544 - protein, 11 aa, Neisseria
EFAEFVNSHPQ

SEQ ID NO: 19545 - protein, 7 aa, Neisseria
KHWMKNG

SEQ ID NO: 19546 - protein, 10 aa, Neisseria
RLPTIDEWEF

SEQ ID NO: 19547 - protein, 6 aa, Neisseria
DLHDVG

SEQ ID NO: 19548 - protein, 5 aa, Neisseria
WGVYD

SEQ ID NO: 19549 - protein, 5 aa, Neisseria
WEWTE

SEQ ID NO: 19550 - protein, 21 aa, Neisseria
VQIEGGSYRPLYLKKDTGLIK

SEQ ID NO: 19551 - protein, 11 aa, Neisseria
KPFKLDKYPVT

SEQ ID NO: 19552 - protein, 15 aa, Neisseria
HPQWQKGRIGSKQAE

SEQ ID NO: 19553 - protein, 19 aa, Neisseria
WMKNGSRSYAPKAGDLKQP

SEQ ID NO: 19554 - protein, 12 aa, Neisseria
QGKRLPTIDEWE

SEQ ID NO: 19555 - protein, 15 aa, Neisseria
ATQKNGSNEPGYNRT

SEQ ID NO: 19556 - protein, 19 aa, Neisseria
YADGDRKDLHDVGKGRPNY

SEQ ID NO: 19557 - protein, 15 aa, Neisseria
WTEDFNSSLLSSGNA

SEQ ID NO: 19558 - protein, 11 aa, Neisseria
ASIGSSDSSNY

SEQ ID NO: 19559 - protein, 6 aa, Neisseria
SLQSKY

SEQ ID NO: 19560 - protein, 10 aa, Neisseria
YLKKDTGLIK

SEQ ID NO: 19561 - protein, 9 aa, Neisseria
KPFKLDKYP

SEQ ID NO: 19562 - protein, 11 aa, Neisseria
QKGRIGSKQAE

SEQ ID NO: 19563 - protein, 7 aa, Neisseria
NGSRSYA

SEQ ID NO: 19564 - protein, 7 aa, Neisseria
KAGDLKQ

SEQ ID NO: 19565 - protein, 7 aa, Neisseria
QGKRLPT

SEQ ID NO: 19566 - protein, 12 aa, Neisseria
ATQKNGSNEPGY

SEQ ID NO: 19567 - protein, 16 aa, Neisseria
ADGDRKDLHDVGKGRP

SEQ ID NO: 19568 - protein, 7 aa, Neisseria
GSSDSSN

SEQ ID NO: 19569 - protein, 6 aa, Neisseria
FFQPVQ

SEQ ID NO: 19570 - protein, 14 aa, Neisseria
SDAAELVELFALFP

SEQ ID NO: 19571 - protein, 17 aa, Neisseria
GKGIERQVDNIADVYGF

SEQ ID NO: 19572 - protein, 7 aa, Neisseria
GGSDAAE

SEQ ID NO: 19573 - protein, 7 aa, Neisseria
QKPRLGC

SEQ ID NO: 19574 - protein, 14 aa, Neisseria
FIGKGIERQVDNIA

SEQ ID NO: 19575 - protein, 24 aa, Neisseria
LLRKGTGLEKTCRPKPFVQPHGGR

SEQ ID NO: 19576 - protein, 6 aa, Neisseria
GSDAAE

SEQ ID NO: 19577 - protein, 7 aa, Neisseria
QKPRLGC

SEQ ID NO: 19578 - protein, 10 aa, Neisseria
GIERQVDNIA

SEQ ID NO: 19579 - protein, 16 aa, Neisseria
LLRKGTGLEKTCRPKP

SEQ ID NO: 19580 - protein, 11 aa, Neisseria
KYTAMAALLAF

SEQ ID NO: 19581 - protein, 23 aa, Neisseria
RLAGWYECSSLSGWCKPRKPAAI

SEQ ID NO: 19582 - protein, 5 aa, Neisseria
NRSVR

SEQ ID NO: 19583 - protein, 7 aa, Neisseria
YRKIGKF

SEQ ID NO: 19584 - protein, 7 aa, Neisseria
PLIETFK

SEQ ID NO: 19585 - protein, 5 aa, Neisseria
MEIRA

SEQ ID NO: 19586 - protein, 16 aa, Neisseria
ECSSLSGWCKPRKPAA

SEQ ID NO: 19587 - protein, 35 aa, Neisseria
DIGGESPPSLEDYEIPLSDGNRSVRANEYESAQQS

SEQ ID NO: 19588 - protein, 20 aa, Neisseria
KIGKFEACGLDWRTRDGKPL

SEQ ID NO: 19589 - protein, 26 aa, Neisseria
TFKQEGFDCLKKQGLRRNGLSERVRW

SEQ ID NO: 19590 - protein, 5 aa, Neisseria
MEIRA

SEQ ID NO: 19591 - protein, 8 aa, Neisseria
CKPRKPAA

SEQ ID NO: 19592 - protein, 15 aa, Neisseria
GGESPPSLEDYEIPL

SEQ ID NO: 19593 - protein, 15 aa, Neisseria
DGNRSVRANEYESAQ

SEQ ID NO: 19594 - protein, 8 aa, Neisseria
KIGKFEAC

SEQ ID NO: 19595 - protein, 9 aa, Neisseria
WRTRDGKPL

SEQ ID NO: 19596 - protein, 25 aa, Neisseria
FKQEGFDCLKKQGLRRNGLSERVRW

SEQ ID NO: 19597 - protein, 10 aa, Neisseria
LALIGLAACS

SEQ ID NO: 19598 - protein, 5 aa, Neisseria
SHRLI

SEQ ID NO: 19599 - protein, 12 aa, Neisseria
NPDQGNLYRLPA

SEQ ID NO: 19600 - protein, 16 aa, Neisseria
QQPADAEVLKSVKGVR

SEQ ID NO: 19601 - protein, 9 aa, Neisseria
QDSLRRLFD

SEQ ID NO: 19602 - protein, 7 aa, Neisseria
VGLGGIY

SEQ ID NO: 19603 - protein, 5 aa, Neisseria
AMKEV

SEQ ID NO: 19604 - protein, 10 aa, Neisseria
AFLTRFMQYL

SEQ ID NO: 19605 - protein, 5 aa, Neisseria
ANEMA

SEQ ID NO: 19606 - protein, 5 aa, Neisseria
GRNWR

SEQ ID NO: 19607 - protein, 22 aa, Neisseria
CSGSKTEQPKLDYQSRSHRLIK

SEQ ID NO: 19608 - protein, 15 aa, Neisseria
EVPPDLNNPDQGNLY

SEQ ID NO: 19609 - protein, 19 aa, Neisseria
AGSGAVRASDLEKRRTPAV

SEQ ID NO: 19610 - protein, 22 aa, Neisseria
QPADAEVLKSVKGVRLERDGSQ

SEQ ID NO: 19611 - protein, 8 aa, Neisseria
VVDGKSHA

SEQ ID NO: 19612 - protein, 13 aa, Neisseria
QENGFDIKSEEPA

SEQ ID NO: 19613 - protein, 21 aa, Neisseria
METEWAENRAKIPQDSLRRLF

SEQ ID NO: 19614 - protein, 20 aa, Neisseria
STGERDKFIVRIEQGKNGVS

SEQ ID NO: 19615 - protein, 15 aa, Neisseria
KAMKEVYGGKDKDTT

SEQ ID NO: 19616 - protein, 9 aa, Neisseria
QPSPSDPNL

SEQ ID NO: 19617 - protein, 17 aa, Neisseria
GVDGQQAENASAKKPTL

SEQ ID NO: 19618 - protein, 10 aa, Neisseria
NEMARIEGKS

SEQ ID NO: 19619 - protein, 12 aa, Neisseria
DYGRNWRRTALA

SEQ ID NO: 19620 - protein, 8 aa, Neisseria
GQNTERHA

SEQ ID NO: 19621 - protein, 17 aa, Neisseria
QKAPNESNAVTEQKPGL

SEQ ID NO: 19622 - protein, 15 aa, Neisseria
LLGKGKAEKPAEQPE

SEQ ID NO: 19623 - protein, 6 aa, Neisseria
VANGSR

SEQ ID NO: 19624 - protein, 15 aa, Neisseria
LLNKDGSAYAGKDAS

SEQ ID NO: 19625 - protein, 6 aa, Neisseria
LHSELR

SEQ ID NO: 19626 - protein, 21 aa, Neisseria
SGSKTEQPKLDYQSRSHRLIK

SEQ ID NO: 19627 - protein, 11 aa, Neisseria
EVPPDLNNPDQ

SEQ ID NO: 19628 - protein, 15 aa, Neisseria
GAVRASDLEKRRTPA

SEQ ID NO: 19629 - protein, 22 aa, Neisseria
QPADAEVLKSVKGVRLERDGSQ

SEQ ID NO: 19630 - protein, 6 aa, Neisseria
DGKSHA

SEQ ID NO: 19631 - protein, 11 aa, Neisseria
NGFDIKSEEPA

SEQ ID NO: 19632 - protein, 21 aa, Neisseria
METEWAENRAKIPQDSLRRLF

SEQ ID NO: 19633 - protein, 9 aa, Neisseria
TGERDKFIV

SEQ ID NO: 19634 - protein, 8 aa, Neisseria
IEQGKNGV

SEQ ID NO: 19635 - protein, 15 aa, Neisseria
KAMKEVYGGKDKDTT

SEQ ID NO: 19636 - protein, 7 aa, Neisseria
SPSDPNL

SEQ ID NO: 19637 - protein, 14 aa, Neisseria
DGQQAENASAKKPT

SEQ ID NO: 19638 - protein, 10 aa, Neisseria
NEMARIEGKS

SEQ ID NO: 19639 - protein, 7 aa, Neisseria
YGRNWRR

SEQ ID NO: 19640 - protein, 5 aa, Neisseria
NTERH

SEQ ID NO: 19641 - protein, 15 aa, Neisseria
APNESNAVTEQKPGL

SEQ ID NO: 19642 - protein, 15 aa, Neisseria
LLGKGKAEKPAEQPE

SEQ ID NO: 19643 - protein, 5 aa, Neisseria
NKDGS

SEQ ID NO: 19644 - protein, 6 aa, Neisseria
AGKDAS

SEQ ID NO: 19645 - protein, 6 aa, Neisseria
LHSELR

SEQ ID NO: 19646 - protein, 16 aa, Neisseria
SLAGILADYVAGIWGT

SEQ ID NO: 19647 - protein, 16 aa, Neisseria
GSIIGIFFSLPGLILG

SEQ ID NO: 19648 - protein, 6 aa, Neisseria
IGAAAG

SEQ ID NO: 19649 - protein, 7 aa, Neisseria
TLLGLIV

SEQ ID NO: 19650 - protein, 11 aa, Neisseria
TKYTGAGKLAV

SEQ ID NO: 19651 - protein, 8 aa, Neisseria
ELIERRNM

SEQ ID NO: 19652 - protein, 8 aa, Neisseria
ELIERRNM

SEQ ID NO: 19653 - protein, 5 aa, Neisseria
GKGAD

SEQ ID NO: 19654 - protein, 18 aa, Neisseria
ALLSAVTHLLAIFVPMIT

SEQ ID NO: 19655 - protein, 9 aa, Neisseria
YLQVNRFGP

SEQ ID NO: 19656 - protein, 5 aa, Neisseria
STLLG

SEQ ID NO: 19657 - protein, 7 aa, Neisseria
KVITPTV

SEQ ID NO: 19658 - protein, 9 aa, Neisseria
TFGSMENLG

SEQ ID NO: 19659 - protein, 5 aa, Neisseria
CMKNP

SEQ ID NO: 19660 - protein, 6 aa, Neisseria
GYIVAL

SEQ ID NO: 19661 - protein, 8 aa, Neisseria
FSALQNLP

SEQ ID NO: 19662 - protein, 12 aa, Neisseria
LSVFEAVGDLTA

SEQ ID NO: 19663 - protein, 8 aa, Neisseria
TKRLRGGV

SEQ ID NO: 19664 - protein, 12 aa, Neisseria
DGLVSVIATALG

SEQ ID NO: 19665 - protein, 8 aa, Neisseria
ASRHVGKY

SEQ ID NO: 19666 - protein, 10 aa, Neisseria
RAFTTIPSPV

SEQ ID NO: 19667 - protein, 12 aa, Neisseria
MSGQLGKGADAP

SEQ ID NO: 19668 - protein, 9 aa, Neisseria
LEDRPPFGN

SEQ ID NO: 19669 - protein, 5 aa, Neisseria
NRFGP

SEQ ID NO: 19670 - protein, 13 aa, Neisseria
AGMKEGGLTKDAM

SEQ ID NO: 19671 - protein, 11 aa, Neisseria
FGAKADGTFGS

SEQ ID NO: 19672 - protein, 7 aa, Neisseria
MKNPLLR

SEQ ID NO: 19673 - protein, 20 aa, Neisseria
VSDQPIEGEEYTKRLRGGVL

SEQ ID NO: 19674 - protein, 11 aa, Neisseria
VSHGIRRREAV

SEQ ID NO: 19675 - protein, 19 aa, Neisseria
LPEDKTEAAVKFDTDHLEH

SEQ ID NO: 19676 - protein, 9 aa, Neisseria
QLGKGADAP

SEQ ID NO: 19677 - protein, 7 aa, Neisseria
LEDRPPF

SEQ ID NO: 19678 - protein, 12 aa, Neisseria
GMKEGGLTKDAM

SEQ ID NO: 19679 - protein, 5 aa, Neisseria
AKADG

SEQ ID NO: 19680 - protein, 14 aa, Neisseria
QPIEGEEYTKRLRG

SEQ ID NO: 19681 - protein, 8 aa, Neisseria
GIRRREAV

SEQ ID NO: 19682 - protein, 19 aa, Neisseria
LPEDKTEAAVKFDTDHLEH

SEQ ID NO: 19683 - protein, 15 aa, Neisseria
QIRDGGDALHYLNRI

SEQ ID NO: 19684 - protein, 5 aa, Neisseria
HGEHH

SEQ ID NO: 19685 - protein, 9 aa, Neisseria
GYLYNGVHE

SEQ ID NO: 19686 - protein, 11 aa, Neisseria
RQVDGLMSAIY

SEQ ID NO: 19687 - protein, 6 aa, Neisseria
RFERHC

SEQ ID NO: 19688 - protein, 11 aa, Neisseria
PEAGRKYYRNA

SEQ ID NO: 19689 - protein, 9 aa, Neisseria
RPVRVLTAG

SEQ ID NO: 19690 - protein, 14 aa, Neisseria
YTAVFDYVRNGRRA

SEQ ID NO: 19691 - protein, 9 aa, Neisseria
TQNQSLPAG

SEQ ID NO: 19692 - protein, 14 aa, Neisseria
VYPSAPQIRDGGDA

SEQ ID NO: 19693 - protein, 8 aa, Neisseria
NSARRHAR

SEQ ID NO: 19694 - protein, 16 aa, Neisseria
LNPEDGHGEHHPDNPH

SEQ ID NO: 19695 - protein, 9 aa, Neisseria
QKLTERTRL

SEQ ID NO: 19696 - protein, 29 aa, Neisseria
VHENISTEEEAAESSDSDIRTQQRQVDGL

SEQ ID NO: 19697 - protein, 11 aa, Neisseria
SLLDRHTDEAG

SEQ ID NO: 19698 - protein, 8 aa, Neisseria
FVRENGKT

SEQ ID NO: 19699 - protein, 31 aa, Neisseria; identical to SEQ ID NO: 5738

SEQ ID NO: 19700 - protein, 7 aa, Neisseria
YTDEAMP

SEQ ID NO: 19701 - protein, 20 aa, Neisseria
FHGERPDPVPEYEITGNPAS

SEQ ID NO: 19702 - protein, 7 aa, Neisseria
DFSEAAG

SEQ ID NO: 19703 - protein, 5 aa, Neisseria
ITMKS

SEQ ID NO: 19704 - protein, 9 aa, Neisseria
YQGKNEIRP

SEQ ID NO: 19705 - protein, 11 aa, Neisseria
TAGNDPNGRLT

SEQ ID NO: 19706 - protein, 11 aa, Neisseria
DYVRNGRRAQA

SEQ ID NO: 19707 - protein, 10 aa, Neisseria
FRTRKPDYPY

SEQ ID NO: 19708 - protein, 15 aa, Neisseria
EVNGGETLAVRKGEK

SEQ ID NO: 19709 - protein, 7 aa, Neisseria
WRGRWCL

SEQ ID NO: 19710 - protein, 20 aa, Neisseria
YTYRQRPGSRLSIGRHKAGG

SEQ ID NO: 19711 - protein, 6 aa, Neisseria
DGMAGS

SEQ ID NO: 19712 - protein, 12 aa, Neisseria
ITLAPEGETERG

SEQ ID NO: 19713 - protein, 8 aa, Neisseria
PQIRDGGD

SEQ ID NO: 19714 - protein, 8 aa, Neisseria
NSARRHAR

SEQ ID NO: 19715 - protein, 12 aa, Neisseria
NPEDGHGEHHPD

SEQ ID NO: 19716 - protein, 8 aa, Neisseria
KLTERTRL

SEQ ID NO: 19717 - protein, 23 aa, Neisseria
ISTEEEAAESSDSDIRTQQRQVD

SEQ ID NO: 19718 - protein, 11 aa, Neisseria
SLLDRHTDEAG

SEQ ID NO: 19719 - protein, 7 aa, Neisseria
FVRENGK

SEQ ID NO: 19720 - protein, 24 aa, Neisseria
GNGRFERHCAQGRNQPEAGRKYYR

SEQ ID NO: 19721 - protein, 10 aa, Neisseria
HGERPDPVPE

SEQ ID NO: 19722 - protein, 7 aa, Neisseria
DFSEAAG

SEQ ID NO: 19723 - protein, 5 aa, Neisseria
ITMKS

SEQ ID NO: 19724 - protein, 8 aa, Neisseria
QGKNEIRP

SEQ ID NO: 19725 - protein, 7 aa, Neisseria
GNDPNGR

SEQ ID NO: 19726 - protein, 8 aa, Neisseria
RNGRRAQA

SEQ ID NO: 19727 - protein, 7 aa, Neisseria
FRTRKPD

SEQ ID NO: 19728 - protein, 8 aa, Neisseria
LAVRKGEK

SEQ ID NO: 19729 - protein, 8 aa, Neisseria
TYRQRPGS

SEQ ID NO: 19730 - protein, 7 aa, Neisseria
SIGRHKA

SEQ ID NO: 19731 - protein, 8 aa, Neisseria
PEGETERG

SEQ ID NO: 19732 - protein, 14 aa, Neisseria
TALAEAVELVKAAG

SEQ ID NO: 19733 - protein, 10 aa, Neisseria
KAAELSEAVA

SEQ ID NO: 19734 - protein, 17 aa, Neisseria
QERNLEKILQCRVLDRV

SEQ ID NO: 19735 - protein, 17 aa, Neisseria
QLSHLAGRLIRGYGHLQ

SEQ ID NO: 19736 - protein, 9 aa, Neisseria
INALKKQLA

SEQ ID NO: 19737 - protein, 14 aa, Neisseria
SGTIKTFALVGYTN

SEQ ID NO: 19738 - protein, 6 aa, Neisseria
FNRLTK

SEQ ID NO: 19739 - protein, 19 aa, Neisseria
GFVSDLPHKLISAFSATLE

SEQ ID NO: 19740 - protein, 17 aa, Neisseria
NSGQQIEDVENVLQEIH

SEQ ID NO: 19741 - protein, 17 aa, Neisseria
ENTGIDALREAIAEYCA

SEQ ID NO: 19742 - protein, 18 aa, Neisseria
MTGRTGRNGSTQAQPERV

SEQ ID NO: 19743 - protein, 16 aa, Neisseria
MLDKDGTGSSATRLNG

SEQ ID NO: 19744 - protein, 5 aa, Neisseria
VELVK

SEQ ID NO: 19745 - protein, 18 aa, Neisseria
AGGDSVRVETAKRDRPHT

SEQ ID NO: 19746 - protein, 9 aa, Neisseria
TGKAAELSE

SEQ ID NO: 19747 - protein, 12 aa, Neisseria
ELTPTQERNLEK

SEQ ID NO: 19748 - protein, 13 aa, Neisseria
ARRARTQEGRLQV

SEQ ID NO: 19749 - protein, 24 aa, Neisseria
QSQRGGIGMKGPGETKLETDRRLI

SEQ ID NO: 19750 - protein, 28 aa, Neisseria
NALKKQLANLKKQRALRRKSRESGTIKT

SEQ ID NO: 19751 - protein, 7 aa, Neisseria
NVGKSSL

SEQ ID NO: 19752 - protein, 9 aa, Neisseria
RLTKSGIYA

SEQ ID NO: 19753 - protein, 6 aa, Neisseria
YISPEC

SEQ ID NO: 19754 - protein, 7 aa, Neisseria
TLEETAQ

SEQ ID NO: 19755 - protein, 16 aa, Neisseria
AAPNSGQQIEDVENVL

SEQ ID NO: 19756 - protein, 6 aa, Neisseria
HAGDIP

SEQ ID NO: 19757 - protein, 16 aa, Neisseria
YNKTDLLPSEEQNTGI

SEQ ID NO: 19758 - protein, 12 aa, Neisseria
ENTGIDALREAI

SEQ ID NO: 19759 - protein, 12 aa, Neisseria
AAAPNTDETEMP

SEQ ID NO: 19760 - protein, 11 aa, Neisseria
MTGRTGRNGST

SEQ ID NO: 19761 - protein, 5 aa, Neisseria
AQPER

SEQ ID NO: 19762 - protein, 7 aa, Neisseria
LDKDGTG

SEQ ID NO: 19763 - protein, 5 aa, Neisseria
VELVK

SEQ ID NO: 19764 - protein, 17 aa, Neisseria
AGGDSVRVETAKRDRPH

SEQ ID NO: 19765 - protein, 8 aa, Neisseria
GKAAELSE

SEQ ID NO: 19766 - protein, 11 aa, Neisseria
LTPTQERNLEK

SEQ ID NO: 19767 - protein, 13 aa, Neisseria
ARRARTQEGRLQV

SEQ ID NO: 19768 - protein, 7 aa, Neisseria
QSQRGGI

SEQ ID NO: 19769 - protein, 14 aa, Neisseria
GPGETKLETDRRLI

SEQ ID NO: 19770 - protein, 25 aa, Neisseria
NALKKQLANLKKQRALRRKSRESGT

SEQ ID NO: 19771 - protein, 7 aa, Neisseria
TLEETAQ

SEQ ID NO: 19772 - protein, 10 aa, Neisseria
QQIEDVENVL

SEQ ID NO: 19773 - protein, 9 aa, Neisseria
DLLPSEEQN

SEQ ID NO: 19774 - protein, 7 aa, Neisseria
DALREAI

SEQ ID NO: 19775 - protein, 9 aa, Neisseria
PNTDETEMP

SEQ ID NO: 19776 - protein, 8 aa, Neisseria
RQREHHRL

SEQ ID NO: 19777 - protein, 24 aa, Neisseria
LVGGFDFLRVIGCGGVAYLPDFQQ

SEQ ID NO: 19778 - protein, 8 aa, Neisseria
MEDLQEIG

SEQ ID NO: 19779 - protein, 23 aa, Neisseria
KVGRQREHHRLHHPQPGNGEADD

SEQ ID NO: 19780 - protein, 11 aa, Neisseria
PDFQQNVGKAD

SEQ ID NO: 19781 - protein, 7 aa, Neisseria
VPDDAAA

SEQ ID NO: 19782 - protein, 10 aa, Neisseria
IEVDADDAVC

SEQ ID NO: 19783 - protein, 16 aa, Neisseria
LFDQPDAGGAGDAAEH

SEQ ID NO: 19784 - protein, 8 aa, Neisseria
MEDLQEIG

SEQ ID NO: 19785 - protein, 10 aa, Neisseria
KVGRQREHHR

SEQ ID NO: 19786 - protein, 7 aa, Neisseria
GNGEADD

SEQ ID NO: 19787 - protein, 5 aa, Neisseria
VGKAD

SEQ ID NO: 19788 - protein, 6 aa, Neisseria
PDDAAA

SEQ ID NO: 19789 - protein, 10 aa, Neisseria
IEVDADDAVC

SEQ ID NO: 19790 - protein, 16 aa, Neisseria
LFDQPDAGGAGDAAEH

SEQ ID NO: 19791 - protein, 7 aa, Neisseria
RIRRCSV

SEQ ID NO: 19792 - protein, 12 aa, Neisseria
MPKWSRIRRCSV

SEQ ID NO: 19793 - protein, 7 aa, Neisseria
SASRLTC

SEQ ID NO: 19794 - protein, 11 aa, Neisseria
MRLKSSDGIAS

SEQ ID NO: 19795 - protein, 31 aa, Neisseria; identical to SEQ ID NO: 5832

SEQ ID NO: 19796 - protein, 14 aa, Neisseria
FRQDAAKPRRFGGK

SEQ ID NO: 19797 - protein, 5 aa, Neisseria
LTGSR

SEQ ID NO: 19798 - protein, 7 aa, Neisseria
SRIRRCS

SEQ ID NO: 19799 - protein, 10 aa, Neisseria
MRLKSSDGIA

SEQ ID NO: 19800 - protein, 25 aa, Neisseria
MPSETVSHKSDSSRNTSASRRNVSP

SEQ ID NO: 19801 - protein, 13 aa, Neisseria
FRQDAAKPRRFGG

SEQ ID NO: 19802 - protein, 6 aa, Neisseria
ALIGIL

SEQ ID NO: 19803 - protein, 20 aa, Neisseria
FWFPSCPGCVSEMPKIIKTA

SEQ ID NO: 19804 - protein, 17 aa, Neisseria
LAVAQPIDPIESVRQYV

SEQ ID NO: 19805 - protein, 7 aa, Neisseria
KAVGQAF

SEQ ID NO: 19806 - protein, 5 aa, Neisseria
MKKIL

SEQ ID NO: 19807 - protein, 8 aa, Neisseria
IPDSKTAP

SEQ ID NO: 19808 - protein, 14 aa, Neisseria
DLHGKTVSNADLQG

SEQ ID NO: 19809 - protein, 5 aa, Neisseria
SCPGC

SEQ ID NO: 19810 - protein, 17 aa, Neisseria
EMPKIIKTANDYKNKNF

SEQ ID NO: 19811 - protein, 16 aa, Neisseria
PIDPIESVRQYVKDYG

SEQ ID NO: 19812 - protein, 6 aa, Neisseria
DADKAV

SEQ ID NO: 19813 - protein, 8 aa, Neisseria
IGKKGEIL

SEQ ID NO: 19814 - protein, 15 aa, Neisseria
VGEPDFGKLYQEIDT

SEQ ID NO: 19815 - protein, 5 aa, Neisseria
MKKIL

SEQ ID NO: 19816 - protein, 5 aa, Neisseria
PDSKT

SEQ ID NO: 19817 - protein, 16 aa, Neisseria
EMPKIIKTANDYKNKN

SEQ ID NO: 19818 - protein, 11 aa, Neisseria
DPIESVRQYVK

SEQ ID NO: 19819 - protein, 6 aa, Neisseria
DADKAV

SEQ ID NO: 19820 - protein, 7 aa, Neisseria
IGKKGEI

SEQ ID NO: 19821 - protein, 17 aa, Neisseria
FNKTVASFAQIVETFDV

SEQ ID NO: 19822 - protein, 5 aa, Neisseria
NRSFK

SEQ ID NO: 19823 - protein, 8 aa, Neisseria
LHIFTNIK

SEQ ID NO: 19824 - protein, 9 aa, Neisseria
VDNGFNKTV

SEQ ID NO: 19825 - protein, 8 aa, Neisseria
QMKQRCGW

SEQ ID NO: 19826 - protein, 15 aa, Neisseria
FPRCGFEIPNRSFKE

SEQ ID NO: 19827 - protein, 13 aa, Neisseria
LSERFRTNAEVEI

SEQ ID NO: 19828 - protein, 5 aa, Neisseria
MKQRC

SEQ ID NO: 19829 - protein, 8 aa, Neisseria
IPNRSFKE

SEQ ID NO: 19830 - protein, 13 aa, Neisseria
LSERFRTNAEVEI

SEQ ID NO: 19831 - protein, 9 aa, Neisseria
VLAALAACK

SEQ ID NO: 19832 - protein, 9 aa, Neisseria
SAAENAAKP

SEQ ID NO: 19833 - protein, 10 aa, Neisseria
FTHCPDVCPT

SEQ ID NO: 19834 - protein, 11 aa, Neisseria
YSDTLKQLGGQ

SEQ ID NO: 19835 - protein, 8 aa, Neisseria
EIIGKYAK

SEQ ID NO: 19836 - protein, 9 aa, Neisseria
CKPQDNSAA

SEQ ID NO: 19837 - protein, 36 aa, Neisseria; identical to SEQ ID NO: 5878

SEQ ID NO: 19838 - protein, 5 aa, Neisseria
SDLKG

SEQ ID NO: 19839 - protein, 7 aa, Neisseria
HCPDVCP

SEQ ID NO: 19840 - protein, 15 aa, Neisseria
SDTLKQLGGQAKDVK

SEQ ID NO: 19841 - protein, 22 aa, Neisseria
IDPERDTPEIIGKYAKQFNPDF

SEQ ID NO: 19842 - protein, 7 aa, Neisseria
ATGDQNL

SEQ ID NO: 19843 - protein, 12 aa, Neisseria
KVNQKDDSENYL

SEQ ID NO: 19844 - protein, 7 aa, Neisseria
LIDKNGE

SEQ ID NO: 19845 - protein, 14 aa, Neisseria
SPYGSEPETIAADV

SEQ ID NO: 19846 - protein, 7 aa, Neisseria
KPQDNSA

SEQ ID NO: 19847 - protein, 23 aa, Neisseria
SAAENAAKPQTRGTDMRKEDIGG

SEQ ID NO: 19848 - protein, 9 aa, Neisseria
TLTDGEGKP

SEQ ID NO: 19849 - protein, 5 aa, Neisseria
SDLKG

SEQ ID NO: 19850 - protein, 8 aa, Neisseria
GGQAKDVK

SEQ ID NO: 19851 - protein, 11 aa, Neisseria
IDPERDTPEII

SEQ ID NO: 19852 - protein, 5 aa, Neisseria
TGDQN

SEQ ID NO: 19853 - protein, 12 aa, Neisseria
KVNQKDDSENYL

SEQ ID NO: 19854 - protein, 5 aa, Neisseria
DKNGE

SEQ ID NO: 19855 - protein, 11 aa, Neisseria
GSEPETIAADV

SEQ ID NO: 19856 - protein, 8 aa, Neisseria
CTNAFAAP

SEQ ID NO: 19857 - protein, 9 aa, Neisseria
ASLARWLDT

SEQ ID NO: 19858 - protein, 27 aa, Neisseria
DRDIEKNMIEGFNAGFKPYADKALAEM

SEQ ID NO: 19859 - protein, 12 aa, Neisseria
AAEAFNRYRENV

SEQ ID NO: 19860 - protein, 8 aa, Neisseria
DLITPEVK

SEQ ID NO: 19861 - protein, 6 aa, Neisseria
IDGMIA

SEQ ID NO: 19862 - protein, 8 aa, Neisseria
IKKSMSEI

SEQ ID NO: 19863 - protein, 18 aa, Neisseria
SGKIAQHHLPEFTEELRR

SEQ ID NO: 19864 - protein, 7 aa, Neisseria
PPSDASL

SEQ ID NO: 19865 - protein, 15 aa, Neisseria
LDTQNFDRDIEKNMI

SEQ ID NO: 19866 - protein, 24 aa, Neisseria
NAGFKPYADKALAEMPEAKKDQAA

SEQ ID NO: 19867 - protein, 10 aa, Neisseria
AFNRYRENVL

SEQ ID NO: 19868 - protein, 10 aa, Neisseria
LITPEVKQAV

SEQ ID NO: 19869 - protein, 14 aa, Neisseria
KNAREIYTQEEIDG

SEQ ID NO: 19870 - protein, 14 aa, Neisseria
VVAKNPRLIKKSMS

SEQ ID NO: 19871 - protein, 5 aa, Neisseria
LSGKI

SEQ ID NO: 19872 - protein, 8 aa, Neisseria
EFTEELRR

SEQ ID NO: 19873 - protein, 23 aa, Neisseria
ICGGKNPDAGCKQAGQVGKRHQK

SEQ ID NO: 19874 - protein, 6 aa, Neisseria
PSDASL

SEQ ID NO: 19875 - protein, 12 aa, Neisseria
QNFDRDIEKNMI

SEQ ID NO: 19876 - protein, 19 aa, Neisseria
PYADKALAEMPEAKKDQAA

SEQ ID NO: 19877 - protein, 10 aa, Neisseria
AFNRYRENVL

SEQ ID NO: 19878 - protein, 10 aa, Neisseria
LITPEVKQAV

SEQ ID NO: 19879 - protein, 8 aa, Neisseria
KNAREIYT

SEQ ID NO: 19880 - protein, 5 aa, Neisseria
EEIDG

SEQ ID NO: 19881 - protein, 14 aa, Neisseria
VVAKNPRLIKKSMS

SEQ ID NO: 19882 - protein, 8 aa, Neisseria
EFTEELRR

SEQ ID NO: 19883 - protein, 20 aa, Neisseria
GKNPDAGCKQAGQVGKRHQK

SEQ ID NO: 19884 - protein, 7 aa, Neisseria
FQTPETL

SEQ ID NO: 19885 - protein, 7 aa, Neisseria
AALTQLM

SEQ ID NO: 19886 - protein, 10 aa, Neisseria
RMFVRPGDTV

SEQ ID NO: 19887 - protein, 5 aa, Neisseria
LLKGM

SEQ ID NO: 19888 - protein, 12 aa, Neisseria
SIENFVQQMNKE

SEQ ID NO: 19889 - protein, 23 aa, Neisseria
AKDLAQLSEALMRDFPEYYPLFS

SEQ ID NO: 19890 - protein, 5 aa, Neisseria
TVAQI

SEQ ID NO: 19891 - protein, 12 aa, Neisseria
EQILETIQPIPA

SEQ ID NO: 19892 - protein, 10 aa, Neisseria
ASPAPNRPTA

SEQ ID NO: 19893 - protein, 7 aa, Neisseria
TFQTPET

SEQ ID NO: 19894 - protein, 5 aa, Neisseria
LQSKQ

SEQ ID NO: 19895 - protein, 9 aa, Neisseria
AKNINTPVE

SEQ ID NO: 19896 - protein, 18 aa, Neisseria
KNMKSGNIRSEENLKIPE

SEQ ID NO: 19897 - protein, 22 aa, Neisseria
WASEGSRMFVRPGDTVSTDKLL

SEQ ID NO: 19898 - protein, 10 aa, Neisseria
RLGNGSIENF

SEQ ID NO: 19899 - protein, 35 aa, Neisseria
MNKEARRLGMKNTVFKNPTGLSREGQVSTAKDLAQ

SEQ ID NO: 19900 - protein, 10 aa, Neisseria
ALMRDFPEYY

SEQ ID NO: 19901 - protein, 11 aa, Neisseria
KNIEQNNRNIL

SEQ ID NO: 19902 - protein, 20 aa, Neisseria
YRDNNVNGLKAGHTESGGYN

SEQ ID NO: 19903 - protein, 7 aa, Neisseria
YSGNGRH

SEQ ID NO: 19904 - protein, 15 aa, Neisseria
LGSESAETRASDNSK

SEQ ID NO: 19905 - protein, 12 aa, Neisseria
FDTPKIYPKGKT

SEQ ID NO: 19906 - protein, 10 aa, Neisseria
ISGGSKKTVR

SEQ ID NO: 19907 - protein, 12 aa, Neisseria
PHKEAKMAEQIL

SEQ ID NO: 19908 - protein, 19 aa, Neisseria
APVKKGQILGKIKIRQNGY

SEQ ID NO: 19909 - protein, 8 aa, Neisseria
IAEKEIVA

SEQ ID NO: 19910 - protein, 11 aa, Neisseria
ENVKKRSRWQR

SEQ ID NO: 19911 - protein, 7 aa, Neisseria
APNRPTA

SEQ ID NO: 19912 - protein, 17 aa, Neisseria
NMKSGNIRSEENLKIPE

SEQ ID NO: 19913 - protein, 19 aa, Neisseria
EGSRMFVRPGDTVSTDKLL

SEQ ID NO: 19914 - protein, 10 aa, Neisseria
MNKEARRLGM

SEQ ID NO: 19915 - protein, 17 aa, Neisseria
TGLSREGQVSTAKDLAQ

SEQ ID NO: 19916 - protein, 8 aa, Neisseria
KNIEQNNR

SEQ ID NO: 19917 - protein, 6 aa, Neisseria
RDNNVN

SEQ ID NO: 19918 - protein, 6 aa, Neisseria
GHTESG

SEQ ID NO: 19919 - protein, 13 aa, Neisseria
SESAETRASDNSK

SEQ ID NO: 19920 - protein, 8 aa, Neisseria
KIYPKGKT

SEQ ID NO: 19921 - protein, 8 aa, Neisseria
GGSKKTVR

SEQ ID NO: 19922 - protein, 12 aa, Neisseria
PHKEAKMAEQIL

SEQ ID NO: 19923 - protein, 7 aa, Neisseria
PVKKGQI

SEQ ID NO: 19924 - protein, 5 aa, Neisseria
IKIRQ

SEQ ID NO: 19925 - protein, 8 aa, Neisseria
IAEKEIVA

SEQ ID NO: 19926 - protein, 9 aa, Neisseria
ENVKKRSRW

SEQ ID NO: 19927 - protein, 5 aa, Neisseria
IERLK

SEQ ID NO: 19928 - protein, 9 aa, Neisseria
MDNKTKLRL

SEQ ID NO: 19929 - protein, 44 aa, Neisseria; identical to SEQ ID NO: 6009

SEQ ID NO: 19930 - protein, 23 aa, Neisseria
SQKCSVDEAHAMFKKRPTRQEIN

SEQ ID NO: 19931 - protein, 13 aa, Neisseria
AAKQSRGQKRPHR

SEQ ID NO: 19932 - protein, 9 aa, Neisseria
MDNKTKLRL

SEQ ID NO: 19933 - protein, 33 aa, Neisseria; identical to SEQ ID NO: 6013

SEQ ID NO: 19934 - protein, 6 aa, Neisseria
QHQKDA

SEQ ID NO: 19935 - protein, 20 aa, Neisseria
CSVDEAHAMFKKRPTRQEIN

SEQ ID NO: 19936 - protein, 13 aa, Neisseria
AAKQSRGQKRPHR

SEQ ID NO: 19937 - protein, 5 aa, Neisseria
GADGI

SEQ ID NO: 19938 - protein, 8 aa, Neisseria
SGRVDDAA

SEQ ID NO: 19939 - protein, 24 aa, Neisseria
LKGADGISPPLTYRSWHIEGGQAL

SEQ ID NO: 19940 - protein, 10 aa, Neisseria
ASGRVDDAAG

SEQ ID NO: 19941 - protein, 14 aa, Neisseria
LRIDSVSQNKETYT

SEQ ID NO: 19942 - protein, 13 aa, Neisseria
QVLKRGEPVGKPM

SEQ ID NO: 19943 - protein, 13 aa, Neisseria
ADNEILGKQEEEA

SEQ ID NO: 19944 - protein, 11 aa, Neisseria
MRQDAAEQIVR

SEQ ID NO: 19945 - protein, 6 aa, Neisseria
KGADGI

SEQ ID NO: 19946 - protein, 8 aa, Neisseria
GRVDDAAG

SEQ ID NO: 19947 - protein, 14 aa, Neisseria
LRIDSVSQNKETYT

SEQ ID NO: 19948 - protein, 10 aa, Neisseria
QVLKRGEPVG

SEQ ID NO: 19949 - protein, 10 aa, Neisseria
EILGKQEEEA

SEQ ID NO: 19950 - protein, 11 aa, Neisseria
MRQDAAEQIVR

SEQ ID NO: 19951 - protein, 16 aa, Neisseria
FRDGAHKMARVWVKIL

SEQ ID NO: 19952 - protein, 6 aa, Neisseria
RMAKMF

SEQ ID NO: 19953 - protein, 7 aa, Neisseria
FLKYPGE

SEQ ID NO: 19954 - protein, 9 aa, Neisseria
MGKCEHLIE

SEQ ID NO: 19955 - protein, 9 aa, Neisseria
PFRDGAHKM

SEQ ID NO: 19956 - protein, 10 aa, Neisseria
GAENIPDRPA

SEQ ID NO: 19957 - protein, 6 aa, Neisseria
HQSGWE

SEQ ID NO: 19958 - protein, 7 aa, Neisseria
VAKRELF

SEQ ID NO: 19959 - protein, 16 aa, Neisseria
IGIDRNNRREANEQLI

SEQ ID NO: 19960 - protein, 9 aa, Neisseria
GLARKNEGY

SEQ ID NO: 19961 - protein, 18 aa, Neisseria
PEGTRLAPGKRGKYKLGG

SEQ ID NO: 19962 - protein, 18 aa, Neisseria
NSGEFWPKNSFLKYPGEI

SEQ ID NO: 19963 - protein, 17 aa, Neisseria
HASGSEAELMGKCEHLI

SEQ ID NO: 19964 - protein, 6 aa, Neisseria
MPSETA

SEQ ID NO: 19965 - protein, 9 aa, Neisseria
PFRDGAHKM

SEQ ID NO: 19966 - protein, 7 aa, Neisseria
NIPDRPA

SEQ ID NO: 19967 - protein, 7 aa, Neisseria
VAKRELF

SEQ ID NO: 19968 - protein, 16 aa, Neisseria
IGIDRNNRREANEQLI

SEQ ID NO: 19969 - protein, 7 aa, Neisseria
GLARKNE

SEQ ID NO: 19970 - protein, 17 aa, Neisseria
EGTRLAPGKRGKYKLGG

SEQ ID NO: 19971 - protein, 15 aa, Neisseria
SGSEAELMGKCEHLI

SEQ ID NO: 19972 - protein, 6 aa, Neisseria
MPSETA

SEQ ID NO: 19973 - protein, 8 aa, Neisseria
GLWVGLAA

SEQ ID NO: 19974 - protein, 9 aa, Neisseria
ASVIEEAGN

SEQ ID NO: 19975 - protein, 13 aa, Neisseria
VAEFEKSLKRIAQ

SEQ ID NO: 19976 - protein, 8 aa, Neisseria
SYRRPTQV

SEQ ID NO: 19977 - protein, 6 aa, Neisseria
MTLVSS

SEQ ID NO: 19978 - protein, 22 aa, Neisseria
VIRPLQALREGAERIGRRCFDI

SEQ ID NO: 19979 - protein, 11 aa, Neisseria
FKQVGRCFNQM

SEQ ID NO: 19980 - protein, 17 aa, Neisseria
DDLEGQVAEQTRSLEKQ

SEQ ID NO: 19981 - protein, 7 aa, Neisseria
TRDLHQS

SEQ ID NO: 19982 - protein, 7 aa, Neisseria
QQAAEHF

SEQ ID NO: 19983 - protein, 5 aa, Neisseria
NRILP

SEQ ID NO: 19984 - protein, 9 aa, Neisseria
ASDLGKYHE

SEQ ID NO: 19985 - protein, 9 aa, Neisseria
RLLLSFPNG

SEQ ID NO: 19986 - protein, 9 aa, Neisseria
LQTLGRQLG

SEQ ID NO: 19987 - protein, 12 aa, Neisseria
QGLHDSIAQALT

SEQ ID NO: 19988 - protein, 12 aa, Neisseria
GVQECYEDVREL

SEQ ID NO: 19989 - protein, 19 aa, Neisseria
KEFPEAVADLFSRFTQQTG

SEQ ID NO: 19990 - protein, 8 aa, Neisseria
LSNIRKHA

SEQ ID NO: 19991 - protein, 8 aa, Neisseria
TENIGEPS

SEQ ID NO: 19992 - protein, 7 aa, Neisseria
RFSDGIS

SEQ ID NO: 19993 - protein, 7 aa, Neisseria
VIEEAGN

SEQ ID NO: 19994 - protein, 32 aa, Neisseria; identical to SEQ ID NO: 6074

SEQ ID NO: 19995 - protein, 7 aa, Neisseria
IPSDTPL

SEQ ID NO: 19996 - protein, 14 aa, Neisseria
PPLQSYRRPTQVDL

SEQ ID NO: 19997 - protein, 8 aa, Neisseria
ENANEKNT

SEQ ID NO: 19998 - protein, 16 aa, Neisseria
QALREGAERIGRRCFD

SEQ ID NO: 19999 - protein, 49 aa, Neisseria; identical to SEQ ID NO: 6079

SEQ ID NO: 20000 - protein, 11 aa, Neisseria
QTTRDLHQSYI

SEQ ID NO: 20001 - protein, 15 aa, Neisseria
VGADSGRVCLDGGSD

SEQ ID NO: 20002 - protein, 16 aa, Neisseria
HADCGTAASDLGKYHE

SEQ ID NO: 20003 - protein, 7 aa, Neisseria
YQNETLG

SEQ ID NO: 20004 - protein, 14 aa, Neisseria
FPNGISLDEDDRIL

SEQ ID NO: 20005 - protein, 6 aa, Neisseria
TLGRQL

SEQ ID NO: 20006 - protein, 10 aa, Neisseria
GAKQEEEKRL

SEQ ID NO: 20007 - protein, 6 aa, Neisseria
LQERNL

SEQ ID NO: 20008 - protein, 5 aa, Neisseria
LHDSI

SEQ ID NO: 20009 - protein, 12 aa, Neisseria
AFAENKREEAAE

SEQ ID NO: 20010 - protein, 11 aa, Neisseria
GVQECYEDVRE

SEQ ID NO: 20011 - protein, 13 aa, Neisseria
RTKISNKEFPEAV

SEQ ID NO: 20012 - protein, 10 aa, Neisseria
RFTQQTGTTV

SEQ ID NO: 20013 - protein, 15 aa, Neisseria
AWENGTHLPTQDEQL

SEQ ID NO: 20014 - protein, 10 aa, Neisseria
SLSNIRKHAH

SEQ ID NO: 20015 - protein, 10 aa, Neisseria
RLLKQDGSFT

SEQ ID NO: 20016 - protein, 20 aa, Neisseria
IQDNGQGFDTENIGEPSGSH

SEQ ID NO: 20017 - protein, 8 aa, Neisseria
MQERAKRI

SEQ ID NO: 20018 - protein, 11 aa, Neisseria
EIRSQAQQGTT

SEQ ID NO: 20019 - protein, 7 aa, Neisseria
ASEESLK

SEQ ID NO: 20020 - protein, 7 aa, Neisseria
VIEEAGN

SEQ ID NO: 20021 - protein, 8 aa, Neisseria
EGSPRAQI

SEQ ID NO: 20022 - protein, 14 aa, Neisseria
QVAEFEKSLKRIAQ

SEQ ID NO: 20023 - protein, 7 aa, Neisseria
SYRRPTQ

SEQ ID NO: 20024 - protein, 6 aa, Neisseria
ENANEK

SEQ ID NO: 20025 - protein, 15 aa, Neisseria
QALREGAERIGRRCF

SEQ ID NO: 20026 - protein, 11 aa, Neisseria
EGGTPEFKQVG

SEQ ID NO: 20027 - protein, 22 aa, Neisseria
ILYDDLEGQVAEQTRSLEKQNQ

SEQ ID NO: 20028 - protein, 6 aa, Neisseria
TTRDLH

SEQ ID NO: 20029 - protein, 9 aa, Neisseria
GADSGRVCL

SEQ ID NO: 20030 - protein, 14 aa, Neisseria
DCGTAASDLGKYHE

SEQ ID NO: 20031 - protein, 9 aa, Neisseria
SLDEDDRIL

SEQ ID NO: 20032 - protein, 10 aa, Neisseria
GAKQEEEKRL

SEQ ID NO: 20033 - protein, 6 aa, Neisseria
LQERNL

SEQ ID NO: 20034 - protein, 12 aa, Neisseria
AFAENKREEAAE

SEQ ID NO: 20035 - protein, 8 aa, Neisseria
ECYEDVRE

SEQ ID NO: 20036 - protein, 12 aa, Neisseria
TKISNKEFPEAV

SEQ ID NO: 20037 - protein, 7 aa, Neisseria
PTQDEQL

SEQ ID NO: 20038 - protein, 10 aa, Neisseria
SLSNIRKHAH

SEQ ID NO: 20039 - protein, 7 aa, Neisseria
RLLKQDG

SEQ ID NO: 20040 - protein, 16 aa, Neisseria
DNGQGFDTENIGEPSG

SEQ ID NO: 20041 - protein, 8 aa, Neisseria
MQERAKRI

SEQ ID NO: 20042 - protein, 7 aa, Neisseria
EIRSQAQ

SEQ ID NO: 20043 - protein, 7 aa, Neisseria
ASEESLK

SEQ ID NO: 20044 - protein, 11 aa, Neisseria
WSLVSAWMVVI

SEQ ID NO: 20045 - protein, 5 aa, Neisseria
LETTV

SEQ ID NO: 20046 - protein, 6 aa, Neisseria
SAVRML

SEQ ID NO: 20047 - protein, 11 aa, Neisseria
FTPYTTVASTS

SEQ ID NO: 20048 - protein, 10 aa, Neisseria
TFFAPLSRTL

SEQ ID NO: 20049 - protein, 16 aa, Neisseria
NAPVHSMTKSTPSSFH

SEQ ID NO: 20050 - protein, 9 aa, Neisseria
VSNLVRWAL

SEQ ID NO: 20051 - protein, 8 aa, Neisseria
NSGSTKPT

SEQ ID NO: 20052 - protein, 11 aa, Neisseria
PLRARRRSLWR

SEQ ID NO: 20053 - protein, 8 aa, Neisseria
ATGERQLV

SEQ ID NO: 20054 - protein, 10 aa, Neisseria
STSSPPGAEM

SEQ ID NO: 20055 - protein, 14 aa, Neisseria
MTKSTPSSFHGSSA

SEQ ID NO: 20056 - protein, 7 aa, Neisseria
  VARIANT (1)...(5): Xaa is any amino acid
RVXKXGI

SEQ ID NO: 20057 - protein, 16 aa, Neisseria
RLPPSWDTSASKRPCT

SEQ ID NO: 20058 - protein, 9 aa, Neisseria
LRARRRSLW

SEQ ID NO: 20059 - protein, 8 aa, Neisseria
ATGERQLV

SEQ ID NO: 20060 - protein, 5 aa, Neisseria
PGAEM

SEQ ID NO: 20061 - protein, 5 aa, Neisseria
TKSTP

SEQ ID NO: 20062 - protein, 8 aa, Neisseria
SASKRPCT

SEQ ID NO: 20063 - protein, 10 aa, Neisseria
ATCTRAMSKS

SEQ ID NO: 20064 - protein, 5 aa, Neisseria
SSWAR

SEQ ID NO: 20065 - protein, 7 aa, Neisseria
ISTWSDL

SEQ ID NO: 20066 - protein, 9 aa, Neisseria
DFMSQLDLT

SEQ ID NO: 20067 - protein, 20 aa, Neisseria
SHSSETISSCPAMASITKPN

SEQ ID NO: 20068 - protein, 7 aa, Neisseria
ANTTSAF

SEQ ID NO: 20069 - protein, 9 aa, Neisseria
MDSTLSKTC

SEQ ID NO: 20070 - protein, 13 aa, Neisseria
FARPRPAASNTSL

SEQ ID NO: 20071 - protein, 9 aa, Neisseria
FASPNDTGS

SEQ ID NO: 20072 - protein, 10 aa, Neisseria
AMSKSSAKYG

SEQ ID NO: 20073 - protein, 18 aa, Neisseria
SWARTRPTVCPPLPKPTI

SEQ ID NO: 20074 - protein, 8 aa, Neisseria
CRSSDFMS

SEQ ID NO: 20075 - protein, 19 aa, Neisseria
DLTKRPTSASLPPKRKGAI

SEQ ID NO: 20076 - protein, 7 aa, Neisseria
IDSRTAA

SEQ ID NO: 20077 - protein, 12 aa, Neisseria
SHSSETISSCPA

SEQ ID NO: 20078 - protein, 12 aa, Neisseria
ITKPNSPPCARY

SEQ ID NO: 20079 - protein, 7 aa, Neisseria
LRLSPTE

SEQ ID NO: 20080 - protein, 13 aa, Neisseria
SIANSINTCRQPP

SEQ ID NO: 20081 - protein, 7 aa, Neisseria
ARPRPAA

SEQ ID NO: 20082 - protein, 7 aa, Neisseria
SPNDTGS

SEQ ID NO: 20083 - protein, 7 aa, Neisseria
AMSKSSA

SEQ ID NO: 20084 - protein, 5 aa, Neisseria
ARTRP

SEQ ID NO: 20085 - protein, 5 aa, Neisseria
RSSDF

SEQ ID NO: 20086 - protein, 8 aa, Neisseria
DLTKRPTS

SEQ ID NO: 20087 - protein, 9 aa, Neisseria
LPPKRKGAI

SEQ ID NO: 20088 - protein, 5 aa, Neisseria
IDSRT

SEQ ID NO: 20089 - protein, 7 aa, Neisseria
HSSETIS

SEQ ID NO: 20090 - protein, 5 aa, Neisseria
TKPNS

SEQ ID NO: 20091 - protein, 14 aa, Neisseria
YPNCGADGAGGKGH

SEQ ID NO: 20092 - protein, 29 aa, Neisseria
AVGGEEGGVVADDVARADGGKADGGRIAR

SEQ ID NO: 20093 - protein, 10 aa, Neisseria
SAERAGDDFA

SEQ ID NO: 20094 - protein, 10 aa, Neisseria
GADGAGGKGH

SEQ ID NO: 20095 - protein, 27 aa, Neisseria
GGEEGGVVADDVARADGGKADGGRIAR

SEQ ID NO: 20096 - protein, 10 aa, Neisseria
SAERAGDDFA

SEQ ID NO: 20097 - protein, 5 aa, Neisseria
GVYQV

SEQ ID NO: 20098 - protein, 10 aa, Neisseria
ELVQEIAREV

SEQ ID NO: 20099 - protein, 5 aa, Neisseria
ALKAV

SEQ ID NO: 20100 - protein, 18 aa, Neisseria
YALEGISDLIATVRKIRQ

SEQ ID NO: 20101 - protein, 5 aa, Neisseria
TGIVR

SEQ ID NO: 20102 - protein, 15 aa, Neisseria
AEVSEQLRSHFGDLL

SEQ ID NO: 20103 - protein, 11 aa, Neisseria
NQKGGVGKTTT

SEQ ID NO: 20104 - protein, 7 aa, Neisseria
LASRGKR

SEQ ID NO: 20105 - protein, 23 aa, Neisseria
VDLDPQGNATTGSGIDKASLQSG

SEQ ID NO: 20106 - protein, 17 aa, Neisseria
GDADVKSAAVRSKEGGY

SEQ ID NO: 20107 - protein, 5 aa, Neisseria
AEIEL

SEQ ID NO: 20108 - protein, 13 aa, Neisseria
QEIAREVRLKNAL

SEQ ID NO: 20109 - protein, 7 aa, Neisseria
AVAEDYD

SEQ ID NO: 20110 - protein, 5 aa, Neisseria
CPPSL

SEQ ID NO: 20111 - protein, 16 aa, Neisseria
ATVRKIRQAVNPDLDI

SEQ ID NO: 20112 - protein, 24 aa, Neisseria
TMYDSRSRLVAEVSEQLRSHFGDL

SEQ ID NO: 20113 - protein, 14 aa, Neisseria
IPRNIRLAEAPSHG

SEQ ID NO: 20114 - protein, 7 aa, Neisseria
AQAKGAK

SEQ ID NO: 20115 - protein, 5 aa, Neisseria
DELMA

SEQ ID NO: 20116 - protein, 8 aa, Neisseria
NQKGGVGK

SEQ ID NO: 20117 - protein, 7 aa, Neisseria
LASRGKR

SEQ ID NO: 20118 - protein, 5 aa, Neisseria
LDPQG

SEQ ID NO: 20119 - protein, 8 aa, Neisseria
SGIDKASL

SEQ ID NO: 20120 - protein, 16 aa, Neisseria
GDADVKSAAVRSKEGG

SEQ ID NO: 20121 - protein, 5 aa, Neisseria
AEIEL

SEQ ID NO: 20122 - protein, 13 aa, Neisseria
QEIAREVRLKNAL

SEQ ID NO: 20123 - protein, 7 aa, Neisseria
AVAEDYD

SEQ ID NO: 20124 - protein, 8 aa, Neisseria
ATVRKIRQ

SEQ ID NO: 20125 - protein, 5 aa, Neisseria
PDLDI

SEQ ID NO: 20126 - protein, 17 aa, Neisseria
MYDSRSRLVAEVSEQLR

SEQ ID NO: 20127 - protein, 10 aa, Neisseria
RNIRLAEAPS

SEQ ID NO: 20128 - protein, 7 aa, Neisseria
AQAKGAK

SEQ ID NO: 20129 - protein, 5 aa, Neisseria
DELMA

SEQ ID NO: 20130 - protein, 5 aa, Neisseria
SIFRR

SEQ ID NO: 20131 - protein, 5 aa, Neisseria
KACKN

SEQ ID NO: 20132 - protein, 8 aa, Neisseria
EKANTVRY

SEQ ID NO: 20133 - protein, 7 aa, Neisseria
SLAQCFT

SEQ ID NO: 20134 - protein, 9 aa, Neisseria
RPLPSIITA

SEQ ID NO: 20135 - protein, 18 aa, Neisseria
EFVGFGNVFVGQFLNRFF

SEQ ID NO: 20136 - protein, 8 aa, Neisseria
EEFFDVVV

SEQ ID NO: 20137 - protein, 9 aa, Neisseria
FNQVFAAFL

SEQ ID NO: 20138 - protein, 16 aa, Neisseria
HRHADQVADSCRVQSQ

SEQ ID NO: 20139 - protein, 12 aa, Neisseria
IRLKRSRLPSIF

SEQ ID NO: 20140 - protein, 37 aa, Neisseria; identical to SEQ ID NO: 6797

SEQ ID NO: 20141 - protein, 8 aa, Neisseria
SNASKPRL

SEQ ID NO: 20142 - protein, 11 aa, Neisseria
PIMRGRKRFFA

SEQ ID NO: 20143 - protein, 16 aa, Neisseria
FRGSAFKCRLNAEPCR

SEQ ID NO: 20144 - protein, 5 aa, Neisseria
ADGDA

SEQ ID NO: 20145 - protein, 20 aa, Neisseria
GQHGHRHADQVADSCRVQSQ

SEQ ID NO: 20146 - protein, 8 aa, Neisseria
IRLKRSRL

SEQ ID NO: 20147 - protein, 7 aa, Neisseria
CRRRTCF

SEQ ID NO: 20148 - protein, 27 aa, Neisseria
KACKNSPIRNETSSSGRRQFSVEKANT

SEQ ID NO: 20149 - protein, 6 aa, Neisseria
ASKPRL

SEQ ID NO: 20150 - protein, 9 aa, Neisseria
MRGRKRFFA

SEQ ID NO: 20151 - protein, 13 aa, Neisseria
SAFKCRLNAEPCR

SEQ ID NO: 20152 - protein, 15 aa, Neisseria
HGHRHADQVADSCRV

SEQ ID NO: 20153 - protein, 23 aa, Neisseria
AAFCGLIALTALWEYARMAGLCK

SEQ ID NO: 20154 - protein, 7 aa, Neisseria
FWLAVMP

SEQ ID NO: 20155 - protein, 15 aa, Neisseria
IARAISPGKSWEGAI

SEQ ID NO: 20156 - protein, 6 aa, Neisseria
TVLIGL

SEQ ID NO: 20157 - protein, 16 aa, Neisseria
LTVVSVCGDLLESWLK

SEQ ID NO: 20158 - protein, 7 aa, Neisseria
CKTETNH

SEQ ID NO: 20159 - protein, 8 aa, Neisseria
KWRLNGGW

SEQ ID NO: 20160 - protein, 10 aa, Neisseria
SLRPHPDDAL

SEQ ID NO: 20161 - protein, 10 aa, Neisseria
KALGKHKIAR

SEQ ID NO: 20162 - protein, 8 aa, Neisseria
ISPGKSWE

SEQ ID NO: 20163 - protein, 14 aa, Neisseria
AAGIKDSSNLLPGH

SEQ ID NO: 20164 - protein, 8 aa, Neisseria
GVFDRTDS

SEQ ID NO: 20165 - protein, 5 aa, Neisseria
CKTET

SEQ ID NO: 20166 - protein, 7 aa, Neisseria
PHPDDAL

SEQ ID NO: 20167 - protein, 9 aa, Neisseria
ALGKHKIAR

SEQ ID NO: 20168 - protein, 9 aa, Neisseria
AAGIKDSSN

SEQ ID NO: 20169 - protein, 7 aa, Neisseria
VFDRTDS

SEQ ID NO: 20170 - protein, 10 aa, Neisseria
RAFAAALIGL

SEQ ID NO: 20171 - protein, 12 aa, Neisseria
HADTFQKIGFIN

SEQ ID NO: 20172 - protein, 11 aa, Neisseria
QARKIQKTLDS

SEQ ID NO: 20173 - protein, 7 aa, Neisseria
DELQKLQ

SEQ ID NO: 20174 - protein, 6 aa, Neisseria
LKDAKK

SEQ ID NO: 20175 - protein, 12 aa, Neisseria
LQQNANRVIVKI

SEQ ID NO: 20176 - protein, 61 aa, Neisseria
NTERIYLESKQARKIQKTLDSEFSARQDELQKLQREGLDLERQLAEGKLKDAKKAQAEEKW

SEQ ID NO: 20177 - protein, 21 aa, Neisseria
FRKKQAQFEEDYNLRRNEEFA

SEQ ID NO: 20178 - protein, 7 aa, Neisseria
QQNANRV

SEQ ID NO: 20179 - protein, 10 aa, Neisseria
IAKQEGYDVI

SEQ ID NO: 20180 - protein, 17 aa, Neisseria
NTQYDVTDSVIKEMNAR

SEQ ID NO: 20181 - protein, 57 aa, Neisseria
IYLESKQARKIQKTLDSEFSARQDELQKLQREGLDLERQLAEGKLKDAKKAQAEEKW

SEQ ID NO: 20182 - protein, 21 aa, Neisseria
FRKKQAQFEEDYNLRRNEEFA

SEQ ID NO: 20183 - protein, 7 aa, Neisseria
IAKQEGY

SEQ ID NO: 20184 - protein, 13 aa, Neisseria
DVTDSVIKEMNAR

SEQ ID NO: 20185 - protein, 5 aa, Neisseria
AVNVL

SEQ ID NO: 20186 - protein, 9 aa, Neisseria
DGARVFRAG

SEQ ID NO: 20187 - protein, 9 aa, Neisseria
AAVADFFAV

SEQ ID NO: 20188 - protein, 6 aa, Neisseria
VEVFKE

SEQ ID NO: 20189 - protein, 6 aa, Neisseria
AAGRGT

SEQ ID NO: 20190 - protein, 24 aa, Neisseria
KQAQADGARVFRAGHREEQLGGDV

SEQ ID NO: 20191 - protein, 6 aa, Neisseria
RTERAA

SEQ ID NO: 20192 - protein, 7 aa, Neisseria
VFKEGDF

SEQ ID NO: 20193 - protein, 24 aa, Neisseria
RNADFAAEHQREGFAGEEPGLVVG

SEQ ID NO: 20194 - protein, 7 aa, Neisseria
GQGDFGV

SEQ ID NO: 20195 - protein, 6 aa, Neisseria
VAARRP

SEQ ID NO: 20196 - protein, 5 aa, Neisseria
AAGRG

SEQ ID NO: 20197 - protein, 21 aa, Neisseria
KQAQADGARVFRAGHREEQLG

SEQ ID NO: 20198 - protein, 6 aa, Neisseria
RTERAA

SEQ ID NO: 20199 - protein, 7 aa, Neisseria
VFKEGDF

SEQ ID NO: 20200 - protein, 20 aa, Neisseria
RNADFAAEHQREGFAGEEPG

SEQ ID NO: 20201 - protein, 6 aa, Neisseria
VAARRP

SEQ ID NO: 20202 - protein, 10 aa, Neisseria
GAVGLPSALA

SEQ ID NO: 20203 - protein, 10 aa, Neisseria
QVLPRDYTGR

SEQ ID NO: 20204 - protein, 6 aa, Neisseria
NTFDSI

SEQ ID NO: 20205 - protein, 5 aa, Neisseria
KGLEL

SEQ ID NO: 20206 - protein, 6 aa, Neisseria
IHSMVR

SEQ ID NO: 20207 - protein, 9 aa, Neisseria
GLPERIDSG

SEQ ID NO: 20208 - protein, 5 aa, Neisseria
LSALT

SEQ ID NO: 20209 - protein, 5 aa, Neisseria
VAAFL

SEQ ID NO: 20210 - protein, 25 aa, Neisseria
FTDIAKTVAHCLSQDFSDGIGDIGG

SEQ ID NO: 20211 - protein, 5 aa, Neisseria
QKGKT

SEQ ID NO: 20212 - protein, 6 aa, Neisseria
ANKETL

SEQ ID NO: 20213 - protein, 6 aa, Neisseria
TARANG

SEQ ID NO: 20214 - protein, 6 aa, Neisseria
PVDSEH

SEQ ID NO: 20215 - protein, 13 aa, Neisseria
LPRDYTGRLNEHG

SEQ ID NO: 20216 - protein, 27 aa, Neisseria
NTFDSITPDQAVKHPNWRMGRKISVDS

SEQ ID NO: 20217 - protein, 6 aa, Neisseria
NKGLEL

SEQ ID NO: 20218 - protein, 9 aa, Neisseria
NCPPDKLEV

SEQ ID NO: 20219 - protein, 8 aa, Neisseria
VRYRDGSV

SEQ ID NO: 20220 - protein, 7 aa, Neisseria
GNPDMRT

SEQ ID NO: 20221 - protein, 14 aa, Neisseria
LPERIDSGVGDLDF

SEQ ID NO: 20222 - protein, 9 aa, Neisseria
TFQKPDFDR

SEQ ID NO: 20223 - protein, 12 aa, Neisseria
SQDFSDGIGDIG

SEQ ID NO: 20224 - protein, 9 aa, Neisseria
QDARTRAQA

SEQ ID NO: 20225 - protein, 5 aa, Neisseria
NKETL

SEQ ID NO: 20226 - protein, 6 aa, Neisseria
TARANG

SEQ ID NO: 20227 - protein, 5 aa, Neisseria
VDSEH

SEQ ID NO: 20228 - protein, 8 aa, Neisseria
DYTGRLNE

SEQ ID NO: 20229 - protein, 8 aa, Neisseria
RMGRKISV

SEQ ID NO: 20230 - protein, 5 aa, Neisseria
KGLEL

SEQ ID NO: 20231 - protein, 6 aa, Neisseria
PPDKLE

SEQ ID NO: 20232 - protein, 7 aa, Neisseria
VRYRDGS

SEQ ID NO: 20233 - protein, 7 aa, Neisseria
GNPDMRT

SEQ ID NO: 20234 - protein, 14 aa, Neisseria
LPERIDSGVGDLDF

SEQ ID NO: 20235 - protein, 7 aa, Neisseria
QKPDFDR

SEQ ID NO: 20236 - protein, 7 aa, Neisseria
DFSDGIG

SEQ ID NO: 20237 - protein, 9 aa, Neisseria
QDARTRAQA

SEQ ID NO: 20238 - protein, 6 aa, Neisseria
PNSLEK

SEQ ID NO: 20239 - protein, 35 aa, Neisseria; identical to SEQ ID NO: 6914

SEQ ID NO: 20240 - protein, 6 aa, Neisseria
GKLYRQ

SEQ ID NO: 20241 - protein, 12 aa, Neisseria
HQTLLDSPDTTG

SEQ ID NO: 20242 - protein, 9 aa, Neisseria
EKAVETARL

SEQ ID NO: 20243 - protein, 12 aa, Neisseria
NVGKALEANKKC

SEQ ID NO: 20244 - protein, 12 aa, Neisseria
FPAAVEAYAAIE

SEQ ID NO: 20245 - protein, 11 aa, Neisseria
MVGEKLYEAYA

SEQ ID NO: 20246 - protein, 20 aa, Neisseria
PEEGLNRLTGYMQTFPELDL

SEQ ID NO: 20247 - protein, 5 aa, Neisseria
NGVYR

SEQ ID NO: 20248 - protein, 11 aa, Neisseria
RSVIGRQLQRS

SEQ ID NO: 20249 - protein, 16 aa, Neisseria
MRPNLPNSLEKADMDN

SEQ ID NO: 20250 - protein, 44 aa, Neisseria; identical to SEQ ID NO: 6925

SEQ ID NO: 20251 - protein, 12 aa, Neisseria
LYRQRGENDKAI

SEQ ID NO: 20252 - protein, 15 aa, Neisseria
LLDSPDTTGAKRARV

SEQ ID NO: 20253 - protein, 11 aa, Neisseria
YQSAGLVDRAE

SEQ ID NO: 20254 - protein, 12 aa, Neisseria
LQDGEMAREARQ

SEQ ID NO: 20255 - protein, 13 aa, Neisseria
YQQDRDWEKAVET

SEQ ID NO: 20256 - protein, 10 aa, Neisseria
RLLSHDDQTY

SEQ ID NO: 20257 - protein, 7 aa, Neisseria
SNFDAAR

SEQ ID NO: 20258 - protein, 11 aa, Neisseria
KALEANKKCTR

SEQ ID NO: 20259 - protein, 8 aa, Neisseria
DIEHRQGN

SEQ ID NO: 20260 - protein, 15 aa, Neisseria
AQGKPEEGLNRLTGY

SEQ ID NO: 20261 - protein, 7 aa, Neisseria
KCEKEAA

SEQ ID NO: 20262 - protein, 11 aa, Neisseria
ELVRRKPDLNG

SEQ ID NO: 20263 - protein, 17 aa, Neisseria
KLSDLDPAWKADADMMR

SEQ ID NO: 20264 - protein, 11 aa, Neisseria
VMYRCRNCHFK

SEQ ID NO: 20265 - protein, 17 aa, Neisseria
CPACNKWQTFTPNKIEV

SEQ ID NO: 20266 - protein, 5 aa, Neisseria
MRPNL

SEQ ID NO: 20267 - protein, 10 aa, Neisseria
NSLEKADMDN

SEQ ID NO: 20268 - protein, 9 aa, Neisseria
TVLKQAKSI

SEQ ID NO: 20269 - protein, 25 aa, Neisseria
DALVDRNSGRAARELAEVVDGRPQS

SEQ ID NO: 20270 - protein, 12 aa, Neisseria
LYRQRGENDKAI

SEQ ID NO: 20271 - protein, 13 aa, Neisseria
DSPDTTGAKRARV

SEQ ID NO: 20272 - protein, 6 aa, Neisseria
LVDRAE

SEQ ID NO: 20273 - protein, 11 aa, Neisseria
QDGEMAREARQ

SEQ ID NO: 20274 - protein, 12 aa, Neisseria
QQDRDWEKAVET

SEQ ID NO: 20275 - protein, 8 aa, Neisseria
LSHDDQTY

SEQ ID NO: 20276 - protein, 6 aa, Neisseria
NFDAAR

SEQ ID NO: 20277 - protein, 11 aa, Neisseria
KALEANKKCTR

SEQ ID NO: 20278 - protein, 8 aa, Neisseria
DIEHRQGN

SEQ ID NO: 20279 - protein, 8 aa, Neisseria
GKPEEGLN

SEQ ID NO: 20280 - protein, 7 aa, Neisseria
KCEKEAA

SEQ ID NO: 20281 - protein, 9 aa, Neisseria
ELVRRKPDL

SEQ ID NO: 20282 - protein, 7 aa, Neisseria
KLSDLDP

SEQ ID NO: 20283 - protein, 9 aa, Neisseria
WKADADMMR

SEQ ID NO: 20284 - protein, 9 aa, Neisseria
VMYRCRNCH

SEQ ID NO: 20285 - protein, 5 aa, Neisseria
NKIEV

SEQ ID NO: 20286 - protein, 6 aa, Neisseria
FRKPAS

SEQ ID NO: 20287 - protein, 5 aa, Neisseria
FAEAV

SEQ ID NO: 20288 - protein, 9 aa, Neisseria
STVSGLFSA

SEQ ID NO: 20289 - protein, 6 aa, Neisseria
LSKSKS

SEQ ID NO: 20290 - protein, 5 aa, Neisseria
SSDSP

SEQ ID NO: 20291 - protein, 6 aa, Neisseria
FTSFFG

SEQ ID NO: 20292 - protein, 11 aa, Neisseria
VSTSAKVISMP

SEQ ID NO: 20293 - protein, 8 aa, Neisseria
SKVYEPPN

SEQ ID NO: 20294 - protein, 6 aa, Neisseria
AETCST

SEQ ID NO: 20295 - protein, 10 aa, Neisseria
AGFSAFASGA

SEQ ID NO: 20296 - protein, 9 aa, Neisseria
TFASGFSTG

SEQ ID NO: 20297 - protein, 5 aa, Neisseria
STVAC

SEQ ID NO: 20298 - protein, 11 aa, Neisseria
GSDGMDAVSAL

SEQ ID NO: 20299 - protein, 19 aa, Neisseria
VSGEEAFRKPASPEGEAGF

SEQ ID NO: 20300 - protein, 9 aa, Neisseria
GRLSEKSVS

SEQ ID NO: 20301 - protein, 7 aa, Neisseria
TDSGSGV

SEQ ID NO: 20302 - protein, 13 aa, Neisseria
SSSCVSAPDKMPF

SEQ ID NO: 20303 - protein, 12 aa, Neisseria
RLSKSKSMRLEG

SEQ ID NO: 20304 - protein, 15 aa, Neisseria
FADNSSSDSPSKASV

SEQ ID NO: 20305 - protein, 5 aa, Neisseria
GAGSG

SEQ ID NO: 20306 - protein, 36 aa, Neisseria; identical to SEQ ID NO: 6977

SEQ ID NO: 20307 - protein, 6 aa, Neisseria
APPPAS

SEQ ID NO: 20308 - protein, 10 aa, Neisseria
KVYEPPNSPL

SEQ ID NO: 20309 - protein, 13 aa, Neisseria
SSSAETCSTGSET

SEQ ID NO: 20310 - protein, 7 aa, Neisseria
GADSAAV

SEQ ID NO: 20311 - protein, 8 aa, Neisseria
GTGSGRTA

SEQ ID NO: 20312 - protein, 5 aa, Neisseria
FSTGF

SEQ ID NO: 20313 - protein, 8 aa, Neisseria
LDGSDGMD

SEQ ID NO: 20314 - protein, 19 aa, Neisseria
VSGEEAFRKPASPEGEAGF

SEQ ID NO: 20315 - protein, 9 aa, Neisseria
GRLSEKSVS

SEQ ID NO: 20316 - protein, 7 aa, Neisseria
SAPDKMP

SEQ ID NO: 20317 - protein, 12 aa, Neisseria
RLSKSKSMRLEG

SEQ ID NO: 20318 - protein, 10 aa, Neisseria
NSSSDSPSKA

SEQ ID NO: 20319 - protein, 33 aa, Neisseria; identical to SEQ ID NO: 6990

SEQ ID NO: 20320 - protein, 12 aa, Neisseria
SSAETCSTGSET

SEQ ID NO: 20321 - protein, 7 aa, Neisseria
DGSDGMD

SEQ ID NO: 20322 - protein, 7 aa, Neisseria
ASEPAAA

SEQ ID NO: 20323 - protein, 5 aa, Neisseria
SIGST

SEQ ID NO: 20324 - protein, 8 aa, Neisseria
GRSLKQMK

SEQ ID NO: 20325 - protein, 5 aa, Neisseria
TEAMQ

SEQ ID NO: 20326 - protein, 19 aa, Neisseria
QEVMMKFLQEQQAKAVEKH

SEQ ID NO: 20327 - protein, 8 aa, Neisseria
AKDGVKTT

SEQ ID NO: 20328 - protein, 8 aa, Neisseria
ILGWTEGV

SEQ ID NO: 20329 - protein, 9 aa, Neisseria
ACGKKEAAP

SEQ ID NO: 20330 - protein, 7 aa, Neisseria
SASEPAA

SEQ ID NO: 20331 - protein, 11 aa, Neisseria
SSAQGDTSSIG

SEQ ID NO: 20332 - protein, 18 aa, Neisseria
DIGRSLKQMKEQGAEIDL

SEQ ID NO: 20333 - protein, 14 aa, Neisseria
YDGKEIKMTEEQAQ

SEQ ID NO: 20334 - protein, 43 aa, Neisseria; identical to SEQ ID NO: 7006

SEQ ID NO: 20335 - protein, 17 aa, Neisseria
KITKQGEGKQPTKDDIV

SEQ ID NO: 20336 - protein, 8 aa, Neisseria
EYEGRLID

SEQ ID NO: 20337 - protein, 10 aa, Neisseria
VFDSSKANGG

SEQ ID NO: 20338 - protein, 8 aa, Neisseria
QLLKEGGE

SEQ ID NO: 20339 - protein, 18 aa, Neisseria
SNLAYREQGAGDKIGPNA

SEQ ID NO: 20340 - protein, 12 aa, Neisseria
GAPENAPAKQPA

SEQ ID NO: 20341 - protein, 7 aa, Neisseria
VDIKKVN

SEQ ID NO: 20342 - protein, 8 aa, Neisseria
CGKKEAAP

SEQ ID NO: 20343 - protein, 7 aa, Neisseria
SASEPAA

SEQ ID NO: 20344 - protein, 7 aa, Neisseria
AQGDTSS

SEQ ID NO: 20345 - protein, 18 aa, Neisseria
DIGRSLKQMKEQGAEIDL

SEQ ID NO: 20346 - protein, 14 aa, Neisseria
YDGKEIKMTEEQAQ

SEQ ID NO: 20347 - protein, 37 aa, Neisseria; identical to SEQ ID NO: 7019

SEQ ID NO: 20348 - protein, 16 aa, Neisseria
ITKQGEGKQPTKDDIV

SEQ ID NO: 20349 - protein, 8 aa, Neisseria
EYEGRLID

SEQ ID NO: 20350 - protein, 7 aa, Neisseria
DSSKANG

SEQ ID NO: 20351 - protein, 8 aa, Neisseria
QLLKEGGE

SEQ ID NO: 20352 - protein, 13 aa, Neisseria
AYREQGAGDKIGP

SEQ ID NO: 20353 - protein, 12 aa, Neisseria
GAPENAPAKQPA

SEQ ID NO: 20354 - protein, 7 aa, Neisseria
VDIKKVN

SEQ ID NO: 20355 - protein, 6 aa, Neisseria
GKIVGN

SEQ ID NO: 20356 - protein, 14 aa, Neisseria
AASYPKPCKSFKLA

SEQ ID NO: 20357 - protein, 6 aa, Neisseria
TVIKII

SEQ ID NO: 20358 - protein, 6 aa, Neisseria
AFVVGI

SEQ ID NO: 20359 - protein, 8 aa, Neisseria
GMFALFGR

SEQ ID NO: 20360 - protein, 8 aa, Neisseria
ELTAPPAQ

SEQ ID NO: 20361 - protein, 6 aa, Neisseria
MERNGV

SEQ ID NO: 20362 - protein, 10 aa, Neisseria
RILRMSSEHA

SEQ ID NO: 20363 - protein, 10 aa, Neisseria
SYPKPCKSFK

SEQ ID NO: 20364 - protein, 6 aa, Neisseria
RSCPGG

SEQ ID NO: 20365 - protein, 8 aa, Neisseria
LPGQKFDL

SEQ ID NO: 20366 - protein, 40 aa, Neisseria
LSLRGENGRLRAEVKKNARLTGKELTAPPAQNAPESAKQP

SEQ ID NO: 20367 - protein, 6 aa, Neisseria
MERNGV

SEQ ID NO: 20368 - protein, 10 aa, Neisseria
RILRMSSEHA

SEQ ID NO: 20369 - protein, 7 aa, Neisseria
KPCKSFK

SEQ ID NO: 20370 - protein, 26 aa, Neisseria
LSLRGENGRLRAEVKKNARLTGKELT

SEQ ID NO: 20371 - protein, 9 aa, Neisseria
NAPESAKQP

SEQ ID NO: 20372 - protein, 17 aa, Neisseria
FADFFKDFAPQFGGFQN

SEQ ID NO: 20373 - protein, 11 aa, Neisseria
DFFAAFLGGLE

SEQ ID NO: 20374 - protein, 7 aa, Neisseria
NTDAARF

SEQ ID NO: 20375 - protein, 5 aa, Neisseria
GKLDI

SEQ ID NO: 20376 - protein, 11 aa, Neisseria
FFKDFAPQFGG

SEQ ID NO: 20377 - protein, 9 aa, Neisseria
LEGDVGNTA

SEQ ID NO: 20378 - protein, 8 aa, Neisseria
NTDAARFA

SEQ ID NO: 20379 - protein, 19 aa, Neisseria
HNQNIQTRNDFRLERGGVG

SEQ ID NO: 20380 - protein, 5 aa, Neisseria
GKLDI

SEQ ID NO: 20381 - protein, 7 aa, Neisseria
LEGDVGN

SEQ ID NO: 20382 - protein, 6 aa, Neisseria
DAARFA

SEQ ID NO: 20383 - protein, 14 aa, Neisseria
IQTRNDFRLERGGV

SEQ ID NO: 20384 - protein, 17 aa, Neisseria
FDFLHLISASGWEHLAE

SEQ ID NO: 20385 - protein, 5 aa, Neisseria
VAVMR

SEQ ID NO: 20386 - protein, 6 aa, Neisseria
ISFLCN

SEQ ID NO: 20387 - protein, 5 aa, Neisseria
LSNFA

SEQ ID NO: 20388 - protein, 21 aa, Neisseria
PFKVGDFIRVGGFEGYVREIK

SEQ ID NO: 20389 - protein, 7 aa, Neisseria
QVVENLR

SEQ ID NO: 20390 - protein, 7 aa, Neisseria
SLKDQLS

SEQ ID NO: 20391 - protein, 5 aa, Neisseria
RPFKV

SEQ ID NO: 20392 - protein, 15 aa, Neisseria
IRVGGFEGYVREIKM

SEQ ID NO: 20393 - protein, 12 aa, Neisseria
SLRTTDNEEVVL

SEQ ID NO: 20394 - protein, 7 aa, Neisseria
IVNRSTL

SEQ ID NO: 20395 - protein, 9 aa, Neisseria
LKVAKEAVL

SEQ ID NO: 20396 - protein, 8 aa, Neisseria
VQNEERQA

SEQ ID NO: 20397 - protein, 5 aa, Neisseria
GDNAI

SEQ ID NO: 20398 - protein, 8 aa, Neisseria
NEADRWTL

SEQ ID NO: 20399 - protein, 15 aa, Neisseria
CDLNEQVVENLRKVN

SEQ ID NO: 20400 - protein, 8 aa, Neisseria
PFPQRDIH

SEQ ID NO: 20401 - protein, 6 aa, Neisseria
SLKDQL

SEQ ID NO: 20402 - protein, 7 aa, Neisseria
YVREIKM

SEQ ID NO: 20403 - protein, 10 aa, Neisseria
LRTTDNEEVV

SEQ ID NO: 20404 - protein, 9 aa, Neisseria
LKVAKEAVL

SEQ ID NO: 20405 - protein, 8 aa, Neisseria
VQNEERQA

SEQ ID NO: 20406 - protein, 6 aa, Neisseria
NEADRW

SEQ ID NO: 20407 - protein, 14 aa, Neisseria
DLNEQVVENLRKVN

SEQ ID NO: 20408 - protein, 6 aa, Neisseria
PQRDIH

SEQ ID NO: 20409 - protein, 6 aa, Neisseria
PVSASK

SEQ ID NO: 20410 - protein, 11 aa, Neisseria
SLVKPLSQPLA

SEQ ID NO: 20411 - protein, 9 aa, Neisseria
MDSPKVGCG

SEQ ID NO: 20412 - protein, 5 aa, Neisseria
VSASK

SEQ ID NO: 20413 - protein, 7 aa, Neisseria
ARPEAAH

SEQ ID NO: 20414 - protein, 20 aa, Neisseria
RPEALADNSVSPTHATSGEV

SEQ ID NO: 20415 - protein, 6 aa, Neisseria
MDSPKV

SEQ ID NO: 20416 - protein, 7 aa, Neisseria
ARPEAAH

SEQ ID NO: 20417 - protein, 6 aa, Neisseria
RPEALA

SEQ ID NO: 20418 - protein, 5 aa, Neisseria
TSGEV

SEQ ID NO: 20419 - protein, 6 aa, Neisseria
SHFISL

SEQ ID NO: 20420 - protein, 7 aa, Neisseria
RECFVGF

SEQ ID NO: 20421 - protein, 9 aa, Neisseria
ATAFGRINQ

SEQ ID NO: 20422 - protein, 9 aa, Neisseria
VHGFLTTFA

SEQ ID NO: 20423 - protein, 26 aa, Neisseria
GQTGIEQNTFCRRGFTRIDMGGNTDV

SEQ ID NO: 20424 - protein, 9 aa, Neisseria
VQADRGLTS

SEQ ID NO: 20425 - protein, 11 aa, Neisseria
SKLETEVRECF

SEQ ID NO: 20426 - protein, 15 aa, Neisseria
FAGRINPAHCQSQTA

SEQ ID NO: 20427 - protein, 7 aa, Neisseria
VQADRGL

SEQ ID NO: 20428 - protein, 9 aa, Neisseria
SKLETEVRE

SEQ ID NO: 20429 - protein, 8 aa, Neisseria
TDNVTRLA

SEQ ID NO: 20430 - protein, 5 aa, Neisseria
VRSSL

SEQ ID NO: 20431 - protein, 11 aa, Neisseria
GETADIYTPLS

SEQ ID NO: 20432 - protein, 5 aa, Neisseria
GSPTR

SEQ ID NO: 20433 - protein, 6 aa, Neisseria
IAEDLF

SEQ ID NO: 20434 - protein, 10 aa, Neisseria
SRSWNRIYAM

SEQ ID NO: 20435 - protein, 15 aa, Neisseria
LTVIPRVWVRAFDQS

SEQ ID NO: 20436 - protein, 7 aa, Neisseria
IADYMGY

SEQ ID NO: 20437 - protein, 13 aa, Neisseria
LKGVVRGFHGYGE

SEQ ID NO: 20438 - protein, 6 aa, Neisseria
LTDNVT

SEQ ID NO: 20439 - protein, 5 aa, Neisseria
ACYDR

SEQ ID NO: 20440 - protein, 14 aa, Neisseria
LPSSAGQEGQESKA

SEQ ID NO: 20441 - protein, 12 aa, Neisseria
ETVRSSLDKGEA

SEQ ID NO: 20442 - protein, 19 aa, Neisseria
VVEKGGDALPADSAGETAD

SEQ ID NO: 20443 - protein, 9 aa, Neisseria
DLDKNDLRG

SEQ ID NO: 20444 - protein, 10 aa, Neisseria
LGVREHNPMY

SEQ ID NO: 20445 - protein, 31 aa, Neisseria; identical to SEQ ID NO: 7115

SEQ ID NO: 20446 - protein, 14 aa, Neisseria
FKSKIAEDLFKTRA

SEQ ID NO: 20447 - protein, 27 aa, Neisseria
GYTQRSDWQIYNQGRKSAPFRNTDYKP

SEQ ID NO: 20448 - protein, 14 aa, Neisseria
PVKADLPFGGRLRM

SEQ ID NO: 20449 - protein, 14 aa, Neisseria
QSNGQSRPESRSWN

SEQ ID NO: 20450 - protein, 16 aa, Neisseria
AFDQSGDKNDNPDIAD

SEQ ID NO: 20451 - protein, 17 aa, Neisseria
GYGDVKLQYRLNDRQNV

SEQ ID NO: 20452 - protein, 8 aa, Neisseria
RYNPKTGY

SEQ ID NO: 20453 - protein, 9 aa, Neisseria
IKGKLKGVV

SEQ ID NO: 20454 - protein, 16 aa, Neisseria
HGYGESLIDYNHKQNG

SEQ ID NO: 20455 - protein, 6 aa, Neisseria
NDLDGI

SEQ ID NO: 20456 - protein, 10 aa, Neisseria
AGQEGQESKA

SEQ ID NO: 20457 - protein, 12 aa, Neisseria
ETVRSSLDKGEA

SEQ ID NO: 20458 - protein, 8 aa, Neisseria
EKGGDALP

SEQ ID NO: 20459 - protein, 8 aa, Neisseria
DSAGETAD

SEQ ID NO: 20460 - protein, 9 aa, Neisseria
DLDKNDLRG

SEQ ID NO: 20461 - protein, 7 aa, Neisseria
LGVREHN

SEQ ID NO: 20462 - protein, 22 aa, Neisseria
SPTRGTTVQEKFGQQKRAETKL

SEQ ID NO: 20463 - protein, 14 aa, Neisseria
FKSKIAEDLFKTRA

SEQ ID NO: 20464 - protein, 15 aa, Neisseria
QGRKSAPFRNTDYKP

SEQ ID NO: 20465 - protein, 5 aa, Neisseria
GRLRM

SEQ ID NO: 20466 - protein, 11 aa, Neisseria
NGQSRPESRSW

SEQ ID NO: 20467 - protein, 15 aa, Neisseria
FDQSGDKNDNPDIAD

SEQ ID NO: 20468 - protein, 5 aa, Neisseria
GDVKL

SEQ ID NO: 20469 - protein, 8 aa, Neisseria
YRLNDRQN

SEQ ID NO: 20470 - protein, 7 aa, Neisseria
GKLKGVV

SEQ ID NO: 20471 - protein, 5 aa, Neisseria
NHKQN

SEQ ID NO: 20472 - protein, 10 aa, Neisseria
HLAFCAFCGI

SEQ ID NO: 20473 - protein, 13 aa, Neisseria
RLHNRMYNAAAAR

SEQ ID NO: 20474 - protein, 5 aa, Neisseria
VTDAQ

SEQ ID NO: 20475 - protein, 8 aa, Neisseria
SKNGDKQI

SEQ ID NO: 20476 - protein, 6 aa, Neisseria
DTHPQP

SEQ ID NO: 20477 - protein, 8 aa, Neisseria
GYAGYCDQ

SEQ ID NO: 20478 - protein, 8 aa, Neisseria
DNGGNHTD

SEQ ID NO: 20479 - protein, 10 aa, Neisseria
GYGQCQNQGA

SEQ ID NO: 20480 - protein, 11 aa, Neisseria
TAGNRLHNRMY

SEQ ID NO: 20481 - protein, 142 aa, Neisseria
GIGRGNGSQQQFGKSETVTDAQRFSSKNGDKQISDTHPQPCFEQTARNHNCDGNQPNQRIGERTQRIAHRRTRFVGGYAGYCDQPDGNNRQRTQRHGLADNGGNHTDKHGQQRPSLRLDPVGYGQCQNQGAQYCGNGEGYRF

SEQ ID NO: 20482 - protein, 13 aa, Neisseria
DLRKKDRPEKSEK

SEQ ID NO: 20483 - protein, 5 aa, Neisseria
NRLHN

SEQ ID NO: 20484 - protein, 8 aa, Neisseria
GIGRGNGS

SEQ ID NO: 20485 - protein, 28 aa, Neisseria
QFGKSETVTDAQRFSSKNGDKQISDTHP

SEQ ID NO: 20486 - protein, 31 aa, Neisseria
QTARNHNCDGNQPNQRIGERTQRIAHRRTRF

SEQ ID NO: 20487 - protein, 13 aa, Neisseria
DQPDGNNRQRTQR

SEQ ID NO: 20488 - protein, 24 aa, Neisseria
GLADNGGNHTDKHGQQRPSLRLDP

SEQ ID NO: 20489 - protein, 5 aa, Neisseria
EGYRF

SEQ ID NO: 20490 - protein, 13 aa, Neisseria
DLRKKDRPEKSEK

SEQ ID NO: 20491 - protein, 15 aa, Neisseria
EFSESAGVEAVQDTM

SEQ ID NO: 20492 - protein, 13 aa, Neisseria
AEFVKKFNNFTRK

SEQ ID NO: 20493 - protein, 11 aa, Neisseria
FDALNRFIADV

SEQ ID NO: 20494 - protein, 7 aa, Neisseria
IDQVSKD

SEQ ID NO: 20495 - protein, 6 aa, Neisseria
LAGVLG

SEQ ID NO: 20496 - protein, 5 aa, Neisseria
GSHIA

SEQ ID NO: 20497 - protein, 8 aa, Neisseria
QAKMLRAM

SEQ ID NO: 20498 - protein, 9 aa, Neisseria
AEGRDKNAV

SEQ ID NO: 20499 - protein, 58 aa, Neisseria
EFVKKFNNFTRKSKNGSFKTELVSRSAMPRYQYTNGRRIQTGWEERAEFKVEGRNFDA

SEQ ID NO: 20500 - protein, 20 aa, Neisseria
HVSRERRNEVIDQVSKDAVL

SEQ ID NO: 20501 - protein, 9 aa, Neisseria
FKARAEKLA

SEQ ID NO: 20502 - protein, 5 aa, Neisseria
IAGGG

SEQ ID NO: 20503 - protein, 16 aa, Neisseria
NMEGADSAAPGVEEIS

SEQ ID NO: 20504 - protein, 9 aa, Neisseria
AEGRDKNAV

SEQ ID NO: 20505 - protein, 18 aa, Neisseria
NNFTRKSKNGSFKTELVS

SEQ ID NO: 20506 - protein, 24 aa, Neisseria
NGRRIQTGWEERAEFKVEGRNFDA

SEQ ID NO: 20507 - protein, 20 aa, Neisseria
HVSRERRNEVIDQVSKDAVL

SEQ ID NO: 20508 - protein, 9 aa, Neisseria
FKARAEKLA

SEQ ID NO: 20509 - protein, 16 aa, Neisseria
NMEGADSAAPGVEEIS

SEQ ID NO: 20510 - protein, 12 aa, Neisseria
RIFATFCAVIVC

SEQ ID NO: 20511 - protein, 9 aa, Neisseria
TTLMGSIIS

SEQ ID NO: 20512 - protein, 9 aa, Neisseria
REILTEWKD

SEQ ID NO: 20513 - protein, 6 aa, Neisseria
HRYIDS

SEQ ID NO: 20514 - protein, 10 aa, Neisseria
KDWDKLQARR

SEQ ID NO: 20515 - protein, 6 aa, Neisseria
PLAPIW

SEQ ID NO: 20516 - protein, 20 aa, Neisseria
LAGNIAKPIRILGNGMDRVA

SEQ ID NO: 20517 - protein, 12 aa, Neisseria
FDKMVEKLEKLV

SEQ ID NO: 20518 - protein, 5 aa, Neisseria
EMRSP

SEQ ID NO: 20519 - protein, 8 aa, Neisseria
MQAIVGLI

SEQ ID NO: 20520 - protein, 6 aa, Neisseria
LKRLEG

SEQ ID NO: 20521 - protein, 14 aa, Neisseria
LYRAFDNVIRNAVN

SEQ ID NO: 20522 - protein, 12 aa, Neisseria
IIEQHCGKIIAE

SEQ ID NO: 20523 - protein, 10 aa, Neisseria
NQFNQRRTIE

SEQ ID NO: 20524 - protein, 22 aa, Neisseria
FRARGDAGAREILTEWKDSPVS

SEQ ID NO: 20525 - protein, 9 aa, Neisseria
QGDEKKDIL

SEQ ID NO: 20526 - protein, 10 aa, Neisseria
DSYTIERARL

SEQ ID NO: 20527 - protein, 7 aa, Neisseria
EYDRFGE

SEQ ID NO: 20528 - protein, 14 aa, Neisseria
KDWDKLQARRLPSP

SEQ ID NO: 20529 - protein, 17 aa, Neisseria
LGNGMDRVANGELETRI

SEQ ID NO: 20530 - protein, 11 aa, Neisseria
QQVDDRDDELS

SEQ ID NO: 20531 - protein, 16 aa, Neisseria
KMVEKLEKLVAKERHL

SEQ ID NO: 20532 - protein, 8 aa, Neisseria
HEMRSPLA

SEQ ID NO: 20533 - protein, 24 aa, Neisseria
AQPQKQEQYLKRLEGELTRMDTLA

SEQ ID NO: 20534 - protein, 16 aa, Neisseria
SRLETSNMALEKESLK

SEQ ID NO: 20535 - protein, 14 aa, Neisseria
LVEDNQSIAQKNGQ

SEQ ID NO: 20536 - protein, 10 aa, Neisseria
SADGKIPENT

SEQ ID NO: 20537 - protein, 7 aa, Neisseria
YSPEGST

SEQ ID NO: 20538 - protein, 8 aa, Neisseria
NIGQDHKH

SEQ ID NO: 20539 - protein, 13 aa, Neisseria
DVTDNGPGVDEMQ

SEQ ID NO: 20540 - protein, 13 aa, Neisseria
YRADSSANKPGTG

SEQ ID NO: 20541 - protein, 18 aa, Neisseria
EQHCGKIIAENIKPNGLR

SEQ ID NO: 20542 - protein, 16 aa, Neisseria
ILPKKKTGSKTEKSAN

SEQ ID NO: 20543 - protein, 9 aa, Neisseria
QFNQRRTIE

SEQ ID NO: 20544 - protein, 21 aa, Neisseria
FRARGDAGAREILTEWKDSPV

SEQ ID NO: 20545 - protein, 9 aa, Neisseria
QGDEKKDIL

SEQ ID NO: 20546 - protein, 7 aa, Neisseria
TIERARL

SEQ ID NO: 20547 - protein, 7 aa, Neisseria
EYDRFGE

SEQ ID NO: 20548 - protein, 12 aa, Neisseria
KDWDKLQARRLP

SEQ ID NO: 20549 - protein, 14 aa, Neisseria
GMDRVANGELETRI

SEQ ID NO: 20550 - protein, 11 aa, Neisseria
QQVDDRDDELS

SEQ ID NO: 20551 - protein, 16 aa, Neisseria
KMVEKLEKLVAKERHL

SEQ ID NO: 20552 - protein, 7 aa, Neisseria
HEMRSPL

SEQ ID NO: 20553 - protein, 23 aa, Neisseria
QPQKQEQYLKRLEGELTRMDTLA

SEQ ID NO: 20554 - protein, 5 aa, Neisseria
SRLET

SEQ ID NO: 20555 - protein, 8 aa, Neisseria
ALEKESLK

SEQ ID NO: 20556 - protein, 14 aa, Neisseria
LVEDNQSIAQKNGQ

SEQ ID NO: 20557 - protein, 7 aa, Neisseria
ADGKIPE

SEQ ID NO: 20558 - protein, 12 aa, Neisseria
VTDNGPGVDEMQ

SEQ ID NO: 20559 - protein, 11 aa, Neisseria
RADSSANKPGT

SEQ ID NO: 20560 - protein, 7 aa, Neisseria
IIAENIK

SEQ ID NO: 20561 - protein, 15 aa, Neisseria
LPKKKTGSKTEKSAN

SEQ ID NO: 20562 - protein, 9 aa, Neisseria
DNFKYFWKT

SEQ ID NO: 20563 - protein, 6 aa, Neisseria
ILAALG

SEQ ID NO: 20564 - protein, 14 aa, Neisseria
VLANIVEKAQNKAP

SEQ ID NO: 20565 - protein, 10 aa, Neisseria
LQQSYPHSIS

SEQ ID NO: 20566 - protein, 22 aa, Neisseria
SQEALKNYGQALEKMPQDSVGR

SEQ ID NO: 20567 - protein, 10 aa, Neisseria
HLEEQQELDN

SEQ ID NO: 20568 - protein, 11 aa, Neisseria
QNRAASQNQEA

SEQ ID NO: 20569 - protein, 23 aa, Neisseria
IVEKAQNKAPQSEINAELAKLQQ

SEQ ID NO: 20570 - protein, 13 aa, Neisseria
TEFDAQRYDVAEG

SEQ ID NO: 20571 - protein, 8 aa, Neisseria
LSNQKDSL

SEQ ID NO: 20572 - protein, 7 aa, Neisseria
QQKKYDA

SEQ ID NO: 20573 - protein, 7 aa, Neisseria
TPVEADF

SEQ ID NO: 20574 - protein, 7 aa, Neisseria
METKGDV

SEQ ID NO: 20575 - protein, 29 aa, Neisseria
AQGKSQEALKNYGQALEKMPQDSVGRELV

SEQ ID NO: 20576 - protein, 6 aa, Neisseria
KLDSLK

SEQ ID NO: 20577 - protein, 10 aa, Neisseria
HLEEQQELDN

SEQ ID NO: 20578 - protein, 9 aa, Neisseria
RAASQNQEA

SEQ ID NO: 20579 - protein, 20 aa, Neisseria
IVEKAQNKAPQSEINAELAK

SEQ ID NO: 20580 - protein, 13 aa, Neisseria
TEFDAQRYDVAEG

SEQ ID NO: 20581 - protein, 6 aa, Neisseria
NQKDSL

SEQ ID NO: 20582 - protein, 7 aa, Neisseria
QQKKYDA

SEQ ID NO: 20583 - protein, 7 aa, Neisseria
TPVEADF

SEQ ID NO: 20584 - protein, 7 aa, Neisseria
METKGDV

SEQ ID NO: 20585 - protein, 9 aa, Neisseria
QGKSQEALK

SEQ ID NO: 20586 - protein, 15 aa, Neisseria
ALEKMPQDSVGRELV

SEQ ID NO: 20587 - protein, 6 aa, Neisseria
KLDSLK

SEQ ID NO: 20588 - protein, 12 aa, Neisseria
LPALPAILPLSA

SEQ ID NO: 20589 - protein, 7 aa, Neisseria
KQPDRLD

SEQ ID NO: 20590 - protein, 13 aa, Neisseria
DIMTDKGKWKLET

SEQ ID NO: 20591 - protein, 10 aa, Neisseria
LNSENNRAEL

SEQ ID NO: 20592 - protein, 10 aa, Neisseria
TEIQENGSNT

SEQ ID NO: 20593 - protein, 10 aa, Neisseria
GNTDIYGSGS

SEQ ID NO: 20594 - protein, 19 aa, Neisseria
HEERKLDGNGKTRNKRMSD

SEQ ID NO: 20595 - protein, 9 aa, Neisseria
FLKDDKNPA

SEQ ID NO: 20596 - protein, 15 aa, Neisseria
TVYEKSRNKASSGKS

SEQ ID NO: 20597 - protein, 18 aa, Neisseria
YRINGSKTLSSNTKYKAG

SEQ ID NO: 20598 - protein, 10 aa, Neisseria
ANDRISLTGG

SEQ ID NO: 20599 - protein, 19 aa, Neisseria
GKQPDRLDGKKESARNTST

SEQ ID NO: 20600 - protein, 11 aa, Neisseria
VSGQSSSELKF

SEQ ID NO: 20601 - protein, 11 aa, Neisseria
DIMTDKGKWKL

SEQ ID NO: 20602 - protein, 7 aa, Neisseria
ENNRAEL

SEQ ID NO: 20603 - protein, 8 aa, Neisseria
EIQENGSN

SEQ ID NO: 20604 - protein, 19 aa, Neisseria
HEERKLDGNGKTRNKRMSD

SEQ ID NO: 20605 - protein, 8 aa, Neisseria
FLKDDKNP

SEQ ID NO: 20606 - protein, 13 aa, Neisseria
TVYEKSRNKASSG

SEQ ID NO: 20607 - protein, 5 aa, Neisseria
KTLSS

SEQ ID NO: 20608 - protein, 5 aa, Neisseria
TKYKA

SEQ ID NO: 20609 - protein, 6 aa, Neisseria
ANDRIS

SEQ ID NO: 20610 - protein, 15 aa, Neisseria
KQPDRLDGKKESARN

SEQ ID NO: 20611 - protein, 7 aa, Neisseria
SSSELKF

SEQ ID NO: 20612 - protein, 10 aa, Neisseria
QDGRNYTGSF

SEQ ID NO: 20613 - protein, 5 aa, Neisseria
GTFKK

SEQ ID NO: 20614 - protein, 46 aa, Neisseria
SYQEPGCTYEGDVGKDGKPAGKGTWRCQDGRNYTGSFKNGKFDGQG

SEQ ID NO: 20615 - protein, 14 aa, Neisseria
IFIEPFNSDSTKFR

SEQ ID NO: 20616 - protein, 19 aa, Neisseria
TFKKGLAHGRFTVSQNGET

SEQ ID NO: 20617 - protein, 15 aa, Neisseria
CENGMIKEVKLPKNK

SEQ ID NO: 20618 - protein, 13 aa, Neisseria
YEGDVGKDGKPAG

SEQ ID NO: 20619 - protein, 11 aa, Neisseria
GTWRCQDGRNY

SEQ ID NO: 20620 - protein, 8 aa, Neisseria
FKNGKFDG

SEQ ID NO: 20621 - protein, 9 aa, Neisseria
FNSDSTKFR

SEQ ID NO: 20622 - protein, 7 aa, Neisseria
TFKKGLA

SEQ ID NO: 20623 - protein, 15 aa, Neisseria
CENGMIKEVKLPKNK

SEQ ID NO: 20624 - protein, 8 aa, Neisseria
ASRIEKVL

SEQ ID NO: 20625 - protein, 10 aa, Neisseria
VADIAKIIEK

SEQ ID NO: 20626 - protein, 5 aa, Neisseria
MVGMM

SEQ ID NO: 20627 - protein, 8 aa, Neisseria
LASVVQLW

SEQ ID NO: 20628 - protein, 7 aa, Neisseria
MDVLVTI

SEQ ID NO: 20629 - protein, 11 aa, Neisseria
FVSLGKFLEHR

SEQ ID NO: 20630 - protein, 6 aa, Neisseria
VQRDGE

SEQ ID NO: 20631 - protein, 7 aa, Neisseria
QIGDLIR

SEQ ID NO: 20632 - protein, 12 aa, Neisseria
LGDMMNALSEAQ

SEQ ID NO: 20633 - protein, 9 aa, Neisseria
APIARVADK

SEQ ID NO: 20634 - protein, 10 aa, Neisseria
GIALLTFIAT

SEQ ID NO: 20635 - protein, 5 aa, Neisseria
MGKAV

SEQ ID NO: 20636 - protein, 6 aa, Neisseria
IVSAAQ

SEQ ID NO: 20637 - protein, 5 aa, Neisseria
IPTAQ

SEQ ID NO: 20638 - protein, 6 aa, Neisseria
GAGLVK

SEQ ID NO: 20639 - protein, 13 aa, Neisseria
KPIGAFALADALK

SEQ ID NO: 20640 - protein, 9 aa, Neisseria
DTAEAIGRL

SEQ ID NO: 20641 - protein, 8 aa, Neisseria
EVQKLKAA

SEQ ID NO: 20642 - protein, 9 aa, Neisseria
VGDGINDAP

SEQ ID NO: 20643 - protein, 7 aa, Neisseria
ADVAEHT

SEQ ID NO: 20644 - protein, 12 aa, Neisseria
QHSVNQLADALS

SEQ ID NO: 20645 - protein, 7 aa, Neisseria
AFFYNIL

SEQ ID NO: 20646 - protein, 13 aa, Neisseria
MQQKVRFQIEGMT

SEQ ID NO: 20647 - protein, 17 aa, Neisseria
CASRIEKVLNKKDFVES

SEQ ID NO: 20648 - protein, 16 aa, Neisseria
ASEEAQVVFDDSKTSV

SEQ ID NO: 20649 - protein, 25 aa, Neisseria
KIIEKTGYGAKEKTEDTLPQPEAEH

SEQ ID NO: 20650 - protein, 5 aa, Neisseria
TRHDW

SEQ ID NO: 20651 - protein, 5 aa, Neisseria
IKGGL

SEQ ID NO: 20652 - protein, 11 aa, Neisseria
LEHRTKKSSLN

SEQ ID NO: 20653 - protein, 10 aa, Neisseria
VNVQRDGEWR

SEQ ID NO: 20654 - protein, 8 aa, Neisseria
NHGERIAA

SEQ ID NO: 20655 - protein, 28 aa, Neisseria
GIIESGSGWADESHLTGESNPEEKKAGG

SEQ ID NO: 20656 - protein, 5 aa, Neisseria
TEGSV

SEQ ID NO: 20657 - protein, 10 aa, Neisseria
SEAQGSKAPI

SEQ ID NO: 20658 - protein, 7 aa, Neisseria
RVADKAA

SEQ ID NO: 20659 - protein, 5 aa, Neisseria
IKGDW

SEQ ID NO: 20660 - protein, 6 aa, Neisseria
MGKAVK

SEQ ID NO: 20661 - protein, 9 aa, Neisseria
AAAMEEAAH

SEQ ID NO: 20662 - protein, 15 aa, Neisseria
VLDKTGTLTEGKPQV

SEQ ID NO: 20663 - protein, 10 aa, Neisseria
PDSGFDEDAL

SEQ ID NO: 20664 - protein, 5 aa, Neisseria
VEQNA

SEQ ID NO: 20665 - protein, 8 aa, Neisseria
AEVKGAGL

SEQ ID NO: 20666 - protein, 8 aa, Neisseria
KAGKAEFA

SEQ ID NO: 20667 - protein, 6 aa, Neisseria
KFSDGV

SEQ ID NO: 20668 - protein, 7 aa, Neisseria
SVNGKPI

SEQ ID NO: 20669 - protein, 19 aa, Neisseria
DALKADTAEAIGRLKKHNI

SEQ ID NO: 20670 - protein, 12 aa, Neisseria
SGDNQGTVEYVA

SEQ ID NO: 20671 - protein, 19 aa, Neisseria
GNMSPRDKAAEVQKLKAAG

SEQ ID NO: 20672 - protein, 8 aa, Neisseria
VGDGINDA

SEQ ID NO: 20673 - protein, 9 aa, Neisseria
MKGGADVAE

SEQ ID NO: 20674 - protein, 7 aa, Neisseria
ATLKNIK

SEQ ID NO: 20675 - protein, 11 aa, Neisseria
NALRLKRVKID

SEQ ID NO: 20676 - protein, 9 aa, Neisseria
MQQKVRFQI

SEQ ID NO: 20677 - protein, 14 aa, Neisseria
SRIEKVLNKKDFVE

SEQ ID NO: 20678 - protein, 16 aa, Neisseria
ASEEAQVVFDDSKTSV

SEQ ID NO: 20679 - protein, 20 aa, Neisseria
TGYGAKEKTEDTLPQPEAEH

SEQ ID NO: 20680 - protein, 10 aa, Neisseria
LEHRTKKSSL

SEQ ID NO: 20681 - protein, 9 aa, Neisseria
NVQRDGEWR

SEQ ID NO: 20682 - protein, 8 aa, Neisseria
NHGERIAA

SEQ ID NO: 20683 - protein, 5 aa, Neisseria
GIIES

SEQ ID NO: 20684 - protein, 20 aa, Neisseria
WADESHLTGESNPEEKKAGG

SEQ ID NO: 20685 - protein, 10 aa, Neisseria
SEAQGSKAPI

SEQ ID NO: 20686 - protein, 7 aa, Neisseria
RVADKAA

SEQ ID NO: 20687 - protein, 9 aa, Neisseria
AAAMEEAAH

SEQ ID NO: 20688 - protein, 7 aa, Neisseria
VLDKTGT

SEQ ID NO: 20689 - protein, 6 aa, Neisseria
TEGKPQ

SEQ ID NO: 20690 - protein, 8 aa, Neisseria
SGFDEDAL

SEQ ID NO: 20691 - protein, 5 aa, Neisseria
VEQNA

SEQ ID NO: 20692 - protein, 5 aa, Neisseria
AEVKG

SEQ ID NO: 20693 - protein, 8 aa, Neisseria
KAGKAEFA

SEQ ID NO: 20694 - protein, 19 aa, Neisseria
DALKADTAEAIGRLKKHNI

SEQ ID NO: 20695 - protein, 5 aa, Neisseria
GDNQG

SEQ ID NO: 20696 - protein, 16 aa, Neisseria
SPRDKAAEVQKLKAAG

SEQ ID NO: 20697 - protein, 7 aa, Neisseria
GGADVAE

SEQ ID NO: 20698 - protein, 7 aa, Neisseria
ATLKNIK

SEQ ID NO: 20699 - protein, 9 aa, Neisseria
LRLKRVKID

SEQ ID NO: 20700 - protein, 22 aa, Neisseria
YLPDNLKTVLEQPVTLVNHITH

SEQ ID NO: 20701 - protein, 6 aa, Neisseria
PFAGGF

SEQ ID NO: 20702 - protein, 7 aa, Neisseria
KVLERFF

SEQ ID NO: 20703 - protein, 6 aa, Neisseria
QVPVSL

SEQ ID NO: 20704 - protein, 11 aa, Neisseria
YQKGFKSYRNG

SEQ ID NO: 20705 - protein, 8 aa, Neisseria
TSDGINPL

SEQ ID NO: 20706 - protein, 7 aa, Neisseria
NELVNLV

SEQ ID NO: 20707 - protein, 7 aa, Neisseria
KRKFARI

SEQ ID NO: 20708 - protein, 5 aa, Neisseria
KMLED

SEQ ID NO: 20709 - protein, 9 aa, Neisseria
DINETLRLM

SEQ ID NO: 20710 - protein, 5 aa, Neisseria
DSTVQ

SEQ ID NO: 20711 - protein, 5 aa, Neisseria
MKKPL

SEQ ID NO: 20712 - protein, 14 aa, Neisseria
KAEESLTQQQKILQ

SEQ ID NO: 20713 - protein, 23 aa, Neisseria
SHQYERGWFTSTETTVIRLKPEL

SEQ ID NO: 20714 - protein, 12 aa, Neisseria
QKYLPDNLKTVL

SEQ ID NO: 20715 - protein, 14 aa, Neisseria
TEFKYAPETEKVLE

SEQ ID NO: 20716 - protein, 6 aa, Neisseria
FFGKQV

SEQ ID NO: 20717 - protein, 8 aa, Neisseria
NGSGKMEV

SEQ ID NO: 20718 - protein, 7 aa, Neisseria
DYEELSG

SEQ ID NO: 20719 - protein, 17 aa, Neisseria
TVYQKGFKSYRNGYDAP

SEQ ID NO: 20720 - protein, 11 aa, Neisseria
KLADKGDAAFE

SEQ ID NO: 20721 - protein, 12 aa, Neisseria
VHFDSETSDGIN

SEQ ID NO: 20722 - protein, 11 aa, Neisseria
FSLEWKEGVDY

SEQ ID NO: 20723 - protein, 14 aa, Neisseria
NPNGSIAPSKIEVG

SEQ ID NO: 20724 - protein, 10 aa, Neisseria
FSTKTGESGA

SEQ ID NO: 20725 - protein, 9 aa, Neisseria
IDSEGQFRF

SEQ ID NO: 20726 - protein, 8 aa, Neisseria
YGDEKYGP

SEQ ID NO: 20727 - protein, 22 aa, Neisseria
LKRKFARISAKKMTEEQIRNDL

SEQ ID NO: 20728 - protein, 7 aa, Neisseria
VKGEASG

SEQ ID NO: 20729 - protein, 5 aa, Neisseria
NPVLD

SEQ ID NO: 20730 - protein, 10 aa, Neisseria
LPSGKIDVGG

SEQ ID NO: 20731 - protein, 13 aa, Neisseria
IMFKDMKKEDLNQ

SEQ ID NO: 20732 - protein, 10 aa, Neisseria
LKKTEADIRM

SEQ ID NO: 20733 - protein, 19 aa, Neisseria
NAEDEAEGRASLDDINETL

SEQ ID NO: 20734 - protein, 6 aa, Neisseria
MAREKY

SEQ ID NO: 20735 - protein, 6 aa, Neisseria
NGDQID

SEQ ID NO: 20736 - protein, 32 aa, Neisseria; identical to SEQ ID NO: 7403

SEQ ID NO: 20737 - protein, 5 aa, Neisseria
MKKPL

SEQ ID NO: 20738 - protein, 8 aa, Neisseria
KAEESLTQ

SEQ ID NO: 20739 - protein, 9 aa, Neisseria
TVIRLKPEL

SEQ ID NO: 20740 - protein, 10 aa, Neisseria
YLPDNLKTVL

SEQ ID NO: 20741 - protein, 14 aa, Neisseria
TEFKYAPETEKVLE

SEQ ID NO: 20742 - protein, 5 aa, Neisseria
GKMEV

SEQ ID NO: 20743 - protein, 7 aa, Neisseria
DYEELSG

SEQ ID NO: 20744 - protein, 9 aa, Neisseria
GFKSYRNGY

SEQ ID NO: 20745 - protein, 11 aa, Neisseria
KLADKGDAAFE

SEQ ID NO: 20746 - protein, 10 aa, Neisseria
VHFDSETSDG

SEQ ID NO: 20747 - protein, 11 aa, Neisseria
FSLEWKEGVDY

SEQ ID NO: 20748 - protein, 6 aa, Neisseria
SKIEVG

SEQ ID NO: 20749 - protein, 7 aa, Neisseria
IDSEGQF

SEQ ID NO: 20750 - protein, 7 aa, Neisseria
GDEKYGP

SEQ ID NO: 20751 - protein, 22 aa, Neisseria
LKRKFARISAKKMTEEQIRNDL

SEQ ID NO: 20752 - protein, 5 aa, Neisseria
VKGEA

SEQ ID NO: 20753 - protein, 7 aa, Neisseria
GKIDVGG

SEQ ID NO: 20754 - protein, 12 aa, Neisseria
IMFKDMKKEDLN

SEQ ID NO: 20755 - protein, 10 aa, Neisseria
LKKTEADIRM

SEQ ID NO: 20756 - protein, 19 aa, Neisseria
NAEDEAEGRASLDDINETL

SEQ ID NO: 20757 - protein, 6 aa, Neisseria
MAREKY

SEQ ID NO: 20758 - protein, 9 aa, Neisseria
KNNQLKLNG

SEQ ID NO: 20759 - protein, 21 aa, Neisseria
TLQNEPEPDFDEGGMVSEPQQ

SEQ ID NO: 20760 - protein, 5 aa, Neisseria
AFIFA

SEQ ID NO: 20761 - protein, 10 aa, Neisseria
LHEFGHYIVA

SEQ ID NO: 20762 - protein, 9 aa, Neisseria
LGGYVKMVD

SEQ ID NO: 20763 - protein, 15 aa, Neisseria
GDKIQSVNGTPVADW

SEQ ID NO: 20764 - protein, 22 aa, Neisseria
SGAQTVRTIDAAGTPEAGKIAK

SEQ ID NO: 20765 - protein, 6 aa, Neisseria
AGGVEK

SEQ ID NO: 20766 - protein, 5 aa, Neisseria
PGDRL

SEQ ID NO: 20767 - protein, 13 aa, Neisseria
PIASWQEWANLTR

SEQ ID NO: 20768 - protein, 7 aa, Neisseria
AWDAQIR

SEQ ID NO: 20769 - protein, 10 aa, Neisseria
YRPSVVRAFG

SEQ ID NO: 20770 - protein, 8 aa, Neisseria
GWEKTVSH

SEQ ID NO: 20771 - protein, 9 aa, Neisseria
TLKFFGKLI

SEQ ID NO: 20772 - protein, 9 aa, Neisseria
HISGPLTIA

SEQ ID NO: 20773 - protein, 7 aa, Neisseria
YLEFLAL

SEQ ID NO: 20774 - protein, 10 aa, Neisseria
FFTRKRGDTE

SEQ ID NO: 20775 - protein, 13 aa, Neisseria
VDTREGEVSEADL

SEQ ID NO: 20776 - protein, 9 aa, Neisseria
FDKQHPAKR

SEQ ID NO: 20777 - protein, 7 aa, Neisseria
VEPDTIA

SEQ ID NO: 20778 - protein, 10 aa, Neisseria
GFQSGDKIQS

SEQ ID NO: 20779 - protein, 5 aa, Neisseria
WGSAQ

SEQ ID NO: 20780 - protein, 19 aa, Neisseria
RTIDAAGTPEAGKIAKNQG

SEQ ID NO: 20781 - protein, 28 aa, Neisseria
GGVEKGSPAEKAGLKPGDRLTAADGKPI

SEQ ID NO: 20782 - protein, 11 aa, Neisseria
NLTRQSPGKKI

SEQ ID NO: 20783 - protein, 24 aa, Neisseria
YERAGQTHTADIRPDTVEQPDHTL

SEQ ID NO: 20784 - protein, 11 aa, Neisseria
VGLRPQPDRAW

SEQ ID NO: 20785 - protein, 11 aa, Neisseria
AQIRRSYRPSV

SEQ ID NO: 20786 - protein, 6 aa, Neisseria
KTVSHS

SEQ ID NO: 20787 - protein, 5 aa, Neisseria
ISGNA

SEQ ID NO: 20788 - protein, 5 aa, Neisseria
AGQSA

SEQ ID NO: 20789 - protein, 11 aa, Neisseria
IRGKPLGERVQ

SEQ ID NO: 20790 - protein, 9 aa, Neisseria
FFTRKRGDT

SEQ ID NO: 20791 - protein, 13 aa, Neisseria
VDTREGEVSEADL

SEQ ID NO: 20792 - protein, 9 aa, Neisseria
FDKQHPAKR

SEQ ID NO: 20793 - protein, 7 aa, Neisseria
VEPDTIA

SEQ ID NO: 20794 - protein, 10 aa, Neisseria
GFQSGDKIQS

SEQ ID NO: 20795 - protein, 10 aa, Neisseria
GTPEAGKIAK

SEQ ID NO: 20796 - protein, 26 aa, Neisseria
GVEKGSPAEKAGLKPGDRLTAADGKP

SEQ ID NO: 20797 - protein, 9 aa, Neisseria
TRQSPGKKI

SEQ ID NO: 20798 - protein, 6 aa, Neisseria
YERAGQ

SEQ ID NO: 20799 - protein, 12 aa, Neisseria
ADIRPDTVEQPD

SEQ ID NO: 20800 - protein, 7 aa, Neisseria
PQPDRAW

SEQ ID NO: 20801 - protein, 7 aa, Neisseria
QIRRSYR

SEQ ID NO: 20802 - protein, 5 aa, Neisseria
AGQSA

SEQ ID NO: 20803 - protein, 8 aa, Neisseria
KPLGERVQ

SEQ ID NO: 20804 - protein, 6 aa, Neisseria
FGQIFS

SEQ ID NO: 20805 - protein, 8 aa, Neisseria
GGLLGGLI

SEQ ID NO: 20806 - protein, 8 aa, Neisseria
APNAAAAA

SEQ ID NO: 20807 - protein, 12 aa, Neisseria
QGMIQMLGVFVD

SEQ ID NO: 20808 - protein, 5 aa, Neisseria
PYGDL

SEQ ID NO: 20809 - protein, 7 aa, Neisseria
VSQVGQW

SEQ ID NO: 20810 - protein, 6 aa, Neisseria
TAVFRM

SEQ ID NO: 20811 - protein, 6 aa, Neisseria
YFGAVA

SEQ ID NO: 20812 - protein, 14 aa, Neisseria
IMAWINLVAILLLS

SEQ ID NO: 20813 - protein, 19 aa, Neisseria
GIKRGLYSNEAGMGSAPNA

SEQ ID NO: 20814 - protein, 8 aa, Neisseria
AEVKHPVS

SEQ ID NO: 20815 - protein, 8 aa, Neisseria
QPYGDLSG

SEQ ID NO: 20816 - protein, 7 aa, Neisseria
AYAESNV

SEQ ID NO: 20817 - protein, 32 aa, Neisseria; identical to SEQ ID NO: 5466

SEQ ID NO: 20818 - protein, 7 aa, Neisseria
GIKRGLY

SEQ ID NO: 20819 - protein, 7 aa, Neisseria
AEVKHPV

SEQ ID NO: 20820 - protein, 13 aa, Neisseria
LKMGKDPEFKLSE

SEQ ID NO: 20821 - protein, 9 aa, Neisseria
PGLKRRIKS

SEQ ID NO: 20822 - protein, 10 aa, Neisseria
GLCKRFGGKT

SEQ ID NO: 20823 - protein, 12 aa, Neisseria
STLLNMIAGIVR

SEQ ID NO: 20824 - protein, 6 aa, Neisseria
HMSALE

SEQ ID NO: 20825 - protein, 5 aa, Neisseria
KMPKA

SEQ ID NO: 20826 - protein, 12 aa, Neisseria
  VARIANT 6: Xaa is any amino acid
AHRKPXKLSGGE

SEQ ID NO: 20827 - protein, 5 aa, Neisseria
FSSLD

SEQ ID NO: 20828 - protein, 9 aa, Neisseria
HLRDRLRRM

SEQ ID NO: 20829 - protein, 21 aa, Neisseria
CGTPETLVQTPAGVQVAHLMG

SEQ ID NO: 20830 - protein, 13 aa, Neisseria
GLCKRFGGKTVAD

SEQ ID NO: 20831 - protein, 6 aa, Neisseria
VGRGKI

SEQ ID NO: 20832 - protein, 10 aa, Neisseria
LGRSGCGKST

SEQ ID NO: 20833 - protein, 8 aa, Neisseria
IVRPDGGE

SEQ ID NO: 20834 - protein, 15 aa, Neisseria
NGENITRMPPEKRRI

SEQ ID NO: 20835 - protein, 12 aa, Neisseria
KMQKMPKAEAES

SEQ ID NO: 20836 - protein, 24 aa, Neisseria
  VARIANT 12: Xaa is any amino acid
VGLENEAHRKPXKLSGGEKQRLAL

SEQ ID NO: 20837 - protein, 6 aa, Neisseria
ESFSSL

SEQ ID NO: 20838 - protein, 20 aa, Neisseria
THLRDRLRRMTAERIRKGGI

SEQ ID NO: 20839 - protein, 15 aa, Neisseria
HSPEEACTAADEIAV

SEQ ID NO: 20840 - protein, 14 aa, Neisseria
HEGKILQCGTPETL

SEQ ID NO: 20841 - protein, 11 aa, Neisseria
GLPNTDDDRHI

SEQ ID NO: 20842 - protein, 14 aa, Neisseria
VRFDQDGMECRVLS

SEQ ID NO: 20843 - protein, 6 aa, Neisseria
TCLPES

SEQ ID NO: 20844 - protein, 22 aa, Neisseria
GEISGNDTVRIHIEDREIVRFR

SEQ ID NO: 20845 - protein, 8 aa, Neisseria
GLCKRFGG

SEQ ID NO: 20846 - protein, 5 aa, Neisseria
GRGKI

SEQ ID NO: 20847 - protein, 5 aa, Neisseria
SGCGK

SEQ ID NO: 20848 - protein, 6 aa, Neisseria
VRPDGG

SEQ ID NO: 20849 - protein, 8 aa, Neisseria
MPPEKRRI

SEQ ID NO: 20850 - protein, 12 aa, Neisseria
KMQKMPKAEAES

SEQ ID NO: 20851 - protein, 24 aa, Neisseria
  VARIANT 12: Xaa is any amino acid
VGLENEAHRKPXKLSGGEKQRLAL

SEQ ID NO: 20852 - protein, 19 aa, Neisseria
THLRDRLRRMTAERIRKGG

SEQ ID NO: 20853 - protein, 14 aa, Neisseria
SPEEACTAADEIAV

SEQ ID NO: 20854 - protein, 5 aa, Neisseria
HEGKI

SEQ ID NO: 20855 - protein, 8 aa, Neisseria
NTDDDRHI

SEQ ID NO: 20856 - protein, 14 aa, Neisseria
VRFDQDGMECRVLS

SEQ ID NO: 20857 - protein, 5 aa, Neisseria
GEISG

SEQ ID NO: 20858 - protein, 16 aa, Neisseria
DTVRIHIEDREIVRFR

SEQ ID NO: 20859 - protein, 5 aa, Neisseria
SILRL

SEQ ID NO: 20860 - protein, 11 aa, Neisseria
AGRECQETAAA

SEQ ID NO: 20861 - protein, 6 aa, Neisseria
AIKRCN

SEQ ID NO: 20862 - protein, 16 aa, Neisseria
MGADTDGDKDVRLNRT

SEQ ID NO: 20863 - protein, 7 aa, Neisseria
VEHPNRF

SEQ ID NO: 20864 - protein, 8 aa, Neisseria
HLDGSTGG

SEQ ID NO: 20865 - protein, 16 aa, Neisseria
FRREKTGHKRRCHTQC

SEQ ID NO: 20866 - protein, 13 aa, Neisseria
HSARAAGRECQET

SEQ ID NO: 20867 - protein, 7 aa, Neisseria
RAIKRCN

SEQ ID NO: 20868 - protein, 15 aa, Neisseria
MGADTDGDKDVRLNR

SEQ ID NO: 20869 - protein, 13 aa, Neisseria
FRREKTGHKRRCH

SEQ ID NO: 20870 - protein, 11 aa, Neisseria
ARAAGRECQET

SEQ ID NO: 20871 - protein, 7 aa, Neisseria
RAIKRCN

SEQ ID NO: 20872 - protein, 6 aa, Neisseria
CQPPEA

SEQ ID NO: 20873 - protein, 11 aa, Neisseria
ADLEKLSQPLA

SEQ ID NO: 20874 - protein, 8 aa, Neisseria
QGEVKELV

SEQ ID NO: 20875 - protein, 14 aa, Neisseria
TFTEAVKAGDIEKA

SEQ ID NO: 20876 - protein, 13 aa, Neisseria
IEPIAELFSELDP

SEQ ID NO: 20877 - protein, 8 aa, Neisseria
AGFTGFHR

SEQ ID NO: 20878 - protein, 22 aa, Neisseria
SGVKEIAAKLMTDVEALQKEID

SEQ ID NO: 20879 - protein, 13 aa, Neisseria
VGGASELIEEVAG

SEQ ID NO: 20880 - protein, 13 aa, Neisseria
DGSKKIVDLFRPL

SEQ ID NO: 20881 - protein, 10 aa, Neisseria
FKQVNEILAK

SEQ ID NO: 20882 - protein, 11 aa, Neisseria
DGFETYDKLGE

SEQ ID NO: 20883 - protein, 22 aa, Neisseria
ALQASINALAEDLAQLRGILGL

SEQ ID NO: 20884 - protein, 5 aa, Neisseria
MRKFN

SEQ ID NO: 20885 - protein, 10 aa, Neisseria
QPPEAEKAAP

SEQ ID NO: 20886 - protein, 13 aa, Neisseria
ASGEAQTANEGGS

SEQ ID NO: 20887 - protein, 9 aa, Neisseria
NDNACEPME

SEQ ID NO: 20888 - protein, 13 aa, Neisseria
IKNNSGRKLEWEI

SEQ ID NO: 20889 - protein, 10 aa, Neisseria
MVVDERENIA

SEQ ID NO: 20890 - protein, 7 aa, Neisseria
GLSDKMT

SEQ ID NO: 20891 - protein, 7 aa, Neisseria
LPGEYEM

SEQ ID NO: 20892 - protein, 27 aa, Neisseria
TNPRGKLVVTDSGFKDTANEADLEKLS

SEQ ID NO: 20893 - protein, 30 aa, Neisseria; identical to SEQ ID NO: 7563

SEQ ID NO: 20894 - protein, 11 aa, Neisseria
TRVHYERIEPI

SEQ ID NO: 20895 - protein, 22 aa, Neisseria
SELDPVIDAREDDFKDGAKDAG

SEQ ID NO: 20896 - protein, 13 aa, Neisseria
VEKDVSGVKEIAA

SEQ ID NO: 20897 - protein, 13 aa, Neisseria
LMTDVEALQKEID

SEQ ID NO: 20898 - protein, 9 aa, Neisseria
PPGKVVGGA

SEQ ID NO: 20899 - protein, 38 aa, Neisseria; identical to SEQ ID NO: 7569

SEQ ID NO: 20900 - protein, 20 aa, Neisseria
IETKNKALLEKTDTNFKQVN

SEQ ID NO: 20901 - protein, 23 aa, Neisseria
AKYRTKDGFETYDKLGEADRKAL

SEQ ID NO: 20902 - protein, 7 aa, Neisseria
LAEDLAQ

SEQ ID NO: 20903 - protein, 5 aa, Neisseria
MRKFN

SEQ ID NO: 20904 - protein, 10 aa, Neisseria
QPPEAEKAAP

SEQ ID NO: 20905 - protein, 13 aa, Neisseria
ASGEAQTANEGGS

SEQ ID NO: 20906 - protein, 7 aa, Neisseria
NACEPME

SEQ ID NO: 20907 - protein, 11 aa, Neisseria
NNSGRKLEWEI

SEQ ID NO: 20908 - protein, 9 aa, Neisseria
MVVDERENI

SEQ ID NO: 20909 - protein, 6 aa, Neisseria
LSDKMT

SEQ ID NO: 20910 - protein, 5 aa, Neisseria
GEYEM

SEQ ID NO: 20911 - protein, 7 aa, Neisseria
PRGKLVV

SEQ ID NO: 20912 - protein, 16 aa, Neisseria
SGFKDTANEADLEKLS

SEQ ID NO: 20913 - protein, 30 aa, Neisseria; identical to SEQ ID NO: 7563

SEQ ID NO: 20914 - protein, 11 aa, Neisseria
TRVHYERIEPI

SEQ ID NO: 20915 - protein, 22 aa, Neisseria
SELDPVIDAREDDFKDGAKDAG

SEQ ID NO: 20916 - protein, 13 aa, Neisseria
VEKDVSGVKEIAA

SEQ ID NO: 20917 - protein, 13 aa, Neisseria
LMTDVEALQKEID

SEQ ID NO: 20918 - protein, 8 aa, Neisseria
ELIEEVAG

SEQ ID NO: 20919 - protein, 11 aa, Neisseria
KISGEEDRYSH

SEQ ID NO: 20920 - protein, 9 aa, Neisseria
VDGSKKIVD

SEQ ID NO: 20921 - protein, 16 aa, Neisseria
IETKNKALLEKTDTNF

SEQ ID NO: 20922 - protein, 21 aa, Neisseria
YRTKDGFETYDKLGEADRKAL

SEQ ID NO: 20923 - protein, 7 aa, Neisseria
LAEDLAQ

SEQ ID NO: 20924 - protein, 8 aa, Neisseria
MLRVSKVV

SEQ ID NO: 20925 - protein, 9 aa, Neisseria
LRIMAGVDK

SEQ ID NO: 20926 - protein, 26 aa, Neisseria
VREEVESGLGEVAAAQKRLEEVYAEY

SEQ ID NO: 20927 - protein, 6 aa, Neisseria
PTNHLD

SEQ ID NO: 20928 - protein, 12 aa, Neisseria
EWLEQFLVRFPG

SEQ ID NO: 20929 - protein, 9 aa, Neisseria
ARFEEMSNY

SEQ ID NO: 20930 - protein, 15 aa, Neisseria
LGNEVIEFVNVSKSF

SEQ ID NO: 20931 - protein, 6 aa, Neisseria
STLFKM

SEQ ID NO: 20932 - protein, 5 aa, Neisseria
DNIAE

SEQ ID NO: 20933 - protein, 6 aa, Neisseria
ITGQLS

SEQ ID NO: 20934 - protein, 12 aa, Neisseria
LRALEDALLEFA

SEQ ID NO: 20935 - protein, 12 aa, Neisseria
VPPQKTIIKDIS

SEQ ID NO: 20936 - protein, 9 aa, Neisseria
LNGAGKSTV

SEQ ID NO: 20937 - protein, 11 aa, Neisseria
AGVDKEFEGEA

SEQ ID NO: 20938 - protein, 21 aa, Neisseria
LPQEPELDPEKTVREEVESGL

SEQ ID NO: 20939 - protein, 11 aa, Neisseria
AAAQKRLEEVY

SEQ ID NO: 20940 - protein, 19 aa, Neisseria
YANPDADFDALAEEQGRLE

SEQ ID NO: 20941 - protein, 20 aa, Neisseria
GSSTGGGAEHELEIAADALR

SEQ ID NO: 20942 - protein, 19 aa, Neisseria
PEWDAKIDNLSGGEKRRVA

SEQ ID NO: 20943 - protein, 6 aa, Neisseria
LSKPDM

SEQ ID NO: 20944 - protein, 11 aa, Neisseria
DEPTNHLDAES

SEQ ID NO: 20945 - protein, 6 aa, Neisseria
THDRYF

SEQ ID NO: 20946 - protein, 17 aa, Neisseria
LELDRGHGIPWKGNYSS

SEQ ID NO: 20947 - protein, 28 aa, Neisseria
LEQKEKRLENEAKSEAARVKAMKQELEW

SEQ ID NO: 20948 - protein, 34 aa, Neisseria; identical to SEQ ID NO: 7619

SEQ ID NO: 20949 - protein, 8 aa, Neisseria
AERLGNEV

SEQ ID NO: 20950 - protein, 6 aa, Neisseria
SKSFGD

SEQ ID NO: 20951 - protein, 10 aa, Neisseria
GPNGAGKSTL

SEQ ID NO: 20952 - protein, 13 aa, Neisseria
AGKEQPDSGEVKI

SEQ ID NO: 20953 - protein, 14 aa, Neisseria
DQSREGLQNDKTVF

SEQ ID NO: 20954 - protein, 8 aa, Neisseria
IAEGRDIL

SEQ ID NO: 20955 - protein, 24 aa, Neisseria
GQFEIPARQYLGRFNFKGSDQSKI

SEQ ID NO: 20956 - protein, 13 aa, Neisseria
GQLSGGERGRLHL

SEQ ID NO: 20957 - protein, 6 aa, Neisseria
LLGGGN

SEQ ID NO: 20958 - protein, 12 aa, Neisseria
LDEPSNDLDVET

SEQ ID NO: 20959 - protein, 6 aa, Neisseria
SHDRWF

SEQ ID NO: 20960 - protein, 8 aa, Neisseria
ACEGDSKW

SEQ ID NO: 20961 - protein, 33 aa, Neisseria
FDGNYQEYEADKKRRLGEEGTKPKRIKYKPVTR

SEQ ID NO: 20962 - protein, 11 aa, Neisseria
AGVDKEFEGEA

SEQ ID NO: 20963 - protein, 19 aa, Neisseria
QEPELDPEKTVREEVESGL

SEQ ID NO: 20964 - protein, 11 aa, Neisseria
AAAQKRLEEVY

SEQ ID NO: 20965 - protein, 18 aa, Neisseria
ANPDADFDALAEEQGRLE

SEQ ID NO: 20966 - protein, 15 aa, Neisseria
GGAEHELEIAADALR

SEQ ID NO: 20967 - protein, 9 aa, Neisseria
PEWDAKIDN

SEQ ID NO: 20968 - protein, 9 aa, Neisseria
SGGEKRRVA

SEQ ID NO: 20969 - protein, 5 aa, Neisseria
LSKPD

SEQ ID NO: 20970 - protein, 11 aa, Neisseria
DEPTNHLDAES

SEQ ID NO: 20971 - protein, 7 aa, Neisseria
LELDRGH

SEQ ID NO: 20972 - protein, 28 aa, Neisseria
LEQKEKRLENEAKSEAARVKAMKQELEW

SEQ ID NO: 20973 - protein, 23 aa, Neisseria
RQNAKGRQAKSKARLARFEEMSN

SEQ ID NO: 20974 - protein, 9 aa, Neisseria
EYQKRNETQ

SEQ ID NO: 20975 - protein, 8 aa, Neisseria
AERLGNEV

SEQ ID NO: 20976 - protein, 13 aa, Neisseria
AGKEQPDSGEVKI

SEQ ID NO: 20977 - protein, 14 aa, Neisseria
DQSREGLQNDKTVF

SEQ ID NO: 20978 - protein, 8 aa, Neisseria
IAEGRDIL

SEQ ID NO: 20979 - protein, 10 aa, Neisseria
NFKGSDQSKI

SEQ ID NO: 20980 - protein, 10 aa, Neisseria
SGGERGRLHL

SEQ ID NO: 20981 - protein, 11 aa, Neisseria
DEPSNDLDVET

SEQ ID NO: 20982 - protein, 5 aa, Neisseria
CEGDS

SEQ ID NO: 20983 - protein, 25 aa, Neisseria
NYQEYEADKKRRLGEEGTKPKRIKY

SEQ ID NO: 20984 - protein, 9 aa, Neisseria
SNSLKQLQE

SEQ ID NO: 20985 - protein, 7 aa, Neisseria
WDKFQKL

SEQ ID NO: 20986 - protein, 8 aa, Neisseria
QISRFVSG

SEQ ID NO: 20987 - protein, 9 aa, Neisseria
LRYTRYVNA

SEQ ID NO: 20988 - protein, 12 aa, Neisseria
NREVVKDLEKQQ

SEQ ID NO: 20989 - protein, 10 aa, Neisseria
INNELARLKK

SEQ ID NO: 20990 - protein, 6 aa, Neisseria
ANVQSL

SEQ ID NO: 20991 - protein, 7 aa, Neisseria
DAAEQTE

SEQ ID NO: 20992 - protein, 8 aa, Neisseria
AKIAKDAR

SEQ ID NO: 20993 - protein, 5 aa, Neisseria
NKLLS

SEQ ID NO: 20994 - protein, 29 aa, Neisseria
PSVMGIGSADGFSRMQGRLKKPVDGVPTG

SEQ ID NO: 20995 - protein, 9 aa, Neisseria
PALTVESIA

SEQ ID NO: 20996 - protein, 11 aa, Neisseria
SYADELDGYGK

SEQ ID NO: 20997 - protein, 6 aa, Neisseria
SIYAGL

SEQ ID NO: 20998 - protein, 28 aa, Neisseria
NSLKQLQEERIRQERIRQERIRQARGNL

SEQ ID NO: 20999 - protein, 29 aa, Neisseria
SVNRKQREAWDKFQKLNTELNRLKTEVAA

SEQ ID NO: 21000 - protein, 10 aa, Neisseria
SGNYKNSQPN

SEQ ID NO: 21001 - protein, 10 aa, Neisseria
NAEPGQKNRF

SEQ ID NO: 21002 - protein, 17 aa, Neisseria
VNASNREVVKDLEKQQK

SEQ ID NO: 21003 - protein, 16 aa, Neisseria
QEQKINNELARLKKIQ

SEQ ID NO: 21004 - protein, 40 aa, Neisseria; identical to SEQ ID NO: 7683

SEQ ID NO: 21005 - protein, 64 aa, Neisseria; identical to SEQ ID NO: 7684

SEQ ID NO: 21006 - protein, 22 aa, Neisseria
GSADGFSRMQGRLKKPVDGVPT

SEQ ID NO: 21007 - protein, 9 aa, Neisseria
GQNRSGGDV

SEQ ID NO: 21008 - protein, 10 aa, Neisseria
SYADELDGYG

SEQ ID NO: 21009 - protein, 6 aa, Neisseria
DHGENY

SEQ ID NO: 21010 - protein, 6 aa, Neisseria
SVGKGY

SEQ ID NO: 21011 - protein, 18 aa, Neisseria
AGSKIGSSGSLPDGEEGL

SEQ ID NO: 21012 - protein, 7 aa, Neisseria
VLNPSSW

SEQ ID NO: 21013 - protein, 27 aa, Neisseria
NSLKQLQEERIRQERIRQERIRQARGN

SEQ ID NO: 21014 - protein, 28 aa, Neisseria
VNRKQREAWDKFQKLNTELNRLKTEVAA

SEQ ID NO: 21015 - protein, 5 aa, Neisseria
YKNSQ

SEQ ID NO: 21016 - protein, 10 aa, Neisseria
NAEPGQKNRF

SEQ ID NO: 21017 - protein, 14 aa, Neisseria
SNREVVKDLEKQQK

SEQ ID NO: 21018 - protein, 16 aa, Neisseria
QEQKINNELARLKKIQ

SEQ ID NO: 21019 - protein, 40 aa, Neisseria; identical to SEQ ID NO: 7683

SEQ ID NO: 21020 - protein, 48 aa, Neisseria; identical to SEQ ID NO: 7700

SEQ ID NO: 21021 - protein, 8 aa, Neisseria
TAEDRNIQ

SEQ ID NO: 21022 - protein, 10 aa, Neisseria
MQGRLKKPVD

SEQ ID NO: 21023 - protein, 7 aa, Neisseria
NRSGGDV

SEQ ID NO: 21024 - protein, 9 aa, Neisseria
YADELDGYG

SEQ ID NO: 21025 - protein, 5 aa, Neisseria
SKIGS

SEQ ID NO: 21026 - protein, 9 aa, Neisseria
SLPDGEEGL

SEQ ID NO: 21027 - protein, 12 aa, Neisseria
LVDEIDVPNIGR

SEQ ID NO: 21028 - protein, 7 aa, Neisseria
AGIPTVF

SEQ ID NO: 21029 - protein, 27 aa, Neisseria
GKELQDDINNDAAALEKFEKIRAYGAL

SEQ ID NO: 21030 - protein, 11 aa, Neisseria
MGLISDVSEAA

SEQ ID NO: 21031 - protein, 7 aa, Neisseria
SSGKTVN

SEQ ID NO: 21032 - protein, 13 aa, Neisseria
AAAVPGTLVNLAA

SEQ ID NO: 21033 - protein, 5 aa, Neisseria
GAAAE

SEQ ID NO: 21034 - protein, 18 aa, Neisseria
PTGNLVDEIDVPNIGRLK

SEQ ID NO: 21035 - protein, 26 aa, Neisseria
GYTGKELQDDINNDAAALEKFEKIRA

SEQ ID NO: 21036 - protein, 12 aa, Neisseria
DVSEAAARAHTP

SEQ ID NO: 21037 - protein, 10 aa, Neisseria
YTASSGKTVN

SEQ ID NO: 21038 - protein, 19 aa, Neisseria
AGGGTRKEVRFGHPSGTLR

SEQ ID NO: 21039 - protein, 7 aa, Neisseria
AECQDGQ

SEQ ID NO: 21040 - protein, 9 aa, Neisseria
VMSRSARVM

SEQ ID NO: 21041 - protein, 8 aa, Neisseria
VRVPEDCF

SEQ ID NO: 21042 - protein, 7 aa, Neisseria
LVDEIDV

SEQ ID NO: 21043 - protein, 25 aa, Neisseria
YTGKELQDDINNDAAALEKFEKIRA

SEQ ID NO: 21044 - protein, 11 aa, Neisseria
DVSEAAARAHT

SEQ ID NO: 21045 - protein, 8 aa, Neisseria
ASSGKTVN

SEQ ID NO: 21046 - protein, 9 aa, Neisseria
GGTRKEVRF

SEQ ID NO: 21047 - protein, 5 aa, Neisseria
AECQD

SEQ ID NO: 21048 - protein, 6 aa, Neisseria
RSARVM

SEQ ID NO: 21049 - protein, 6 aa, Neisseria
VPEDCF

SEQ ID NO: 21050 - protein, 5 aa, Neisseria
DKARH

SEQ ID NO: 21051 - protein, 6 aa, Neisseria
VNRHGQ

SEQ ID NO: 21052 - protein, 6 aa, Neisseria
RQIAQI

SEQ ID NO: 21053 - protein, 9 aa, Neisseria
AGLHVCNSV

SEQ ID NO: 21054 - protein, 10 aa, Neisseria
HVIVEMCAWY

SEQ ID NO: 21055 - protein, 9 aa, Neisseria
QCDKARHMR

SEQ ID NO: 21056 - protein, 12 aa, Neisseria
QVNRHGQTGNCG

SEQ ID NO: 21057 - protein, 21 aa, Neisseria
CSLQGNRKAQVFDTDLIDRQI

SEQ ID NO: 21058 - protein, 5 aa, Neisseria
STGEY

SEQ ID NO: 21059 - protein, 6 aa, Neisseria
QMRDYI

SEQ ID NO: 21060 - protein, 9 aa, Neisseria
QCDKARHMR

SEQ ID NO: 21061 - protein, 7 aa, Neisseria
QVNRHGQ

SEQ ID NO: 21062 - protein, 10 aa, Neisseria
QGNRKAQVFD

SEQ ID NO: 21063 - protein, 7 aa, Neisseria
DLIDRQI

SEQ ID NO: 21064 - protein, 10 aa, Neisseria
VMDELNACIP

SEQ ID NO: 21065 - protein, 11 aa, Neisseria
HNPANISGILA

SEQ ID NO: 21066 - protein, 9 aa, Neisseria
HFPGLPNVG

SEQ ID NO: 21067 - protein, 7 aa, Neisseria
SFHQTMP

SEQ ID NO: 21068 - protein, 6 aa, Neisseria
AVPREL

SEQ ID NO: 21069 - protein, 13 aa, Neisseria
GKPLEDIRMIIAH

SEQ ID NO: 21070 - protein, 14 aa, Neisseria
NGASITAIKNGKSV

SEQ ID NO: 21071 - protein, 5 aa, Neisseria
TPIEG

SEQ ID NO: 21072 - protein, 6 aa, Neisseria
YSYLTS

SEQ ID NO: 21073 - protein, 5 aa, Neisseria
LGISE

SEQ ID NO: 21074 - protein, 5 aa, Neisseria
SNDCR

SEQ ID NO: 21075 - protein, 9 aa, Neisseria
RLAKYIASM

SEQ ID NO: 21076 - protein, 5 aa, Neisseria
VSYLD

SEQ ID NO: 21077 - protein, 16 aa, Neisseria
LSSRRRGRNNDRKCGI

SEQ ID NO: 21078 - protein, 36 aa, Neisseria
  VARIANT 23: Xaa is any amino acid
FAQRGRLKHTPPNAHPFSDDPTXKKQPQTTRRNIMS

SEQ ID NO: 21079 - protein, 16 aa, Neisseria
GSSSLKGAVIDRKSGS

SEQ ID NO: 21080 - protein, 10 aa, Neisseria
LGERLTTPEA

SEQ ID NO: 21081 - protein, 19 aa, Neisseria
TFSKDGNKRQVPLSGRNCH

SEQ ID NO: 21082 - protein, 12 aa, Neisseria
ELEKHELHDRIQ

SEQ ID NO: 21083 - protein, 9 aa, Neisseria
AHGGEKYSE

SEQ ID NO: 21084 - protein, 7 aa, Neisseria
AVMDELN

SEQ ID NO: 21085 - protein, 7 aa, Neisseria
TMPERAY

SEQ ID NO: 21086 - protein, 20 aa, Neisseria
RELRKKYAFRRYGFHGTSMR

SEQ ID NO: 21087 - protein, 7 aa, Neisseria
KPLEDIR

SEQ ID NO: 21088 - protein, 5 aa, Neisseria
LGNGA

SEQ ID NO: 21089 - protein, 14 aa, Neisseria
TAIKNGKSVDTSMG

SEQ ID NO: 21090 - protein, 10 aa, Neisseria
TRCGDIDPGV

SEQ ID NO: 21091 - protein, 12 aa, Neisseria
AQVDEMLNKKSG

SEQ ID NO: 21092 - protein, 23 aa, Neisseria
SELSNDCRTLEIAADEGHEGARL

SEQ ID NO: 21093 - protein, 13 aa, Neisseria
GIGENSRNIRAKT

SEQ ID NO: 21094 - protein, 16 aa, Neisseria
IDTKANMEKRYGNSGI

SEQ ID NO: 21095 - protein, 7 aa, Neisseria
SPTDSSP

SEQ ID NO: 21096 - protein, 6 aa, Neisseria
PTNEEL

SEQ ID NO: 21097 - protein, 16 aa, Neisseria
LSSRRRGRNNDRKCGI

SEQ ID NO: 21098 - protein, 11 aa, Neisseria
FAQRGRLKHTP

SEQ ID NO: 21099 - protein, 19 aa, Neisseria
  VARIANT 7: Xaa is any amino acid
FSDDPTXKKQPQTTRRNIM

SEQ ID NO: 21100 - protein, 8 aa, Neisseria
AVIDRKSG

SEQ ID NO: 21101 - protein, 7 aa, Neisseria
LGERLTT

SEQ ID NO: 21102 - protein, 18 aa, Neisseria
FSKDGNKRQVPLSGRNCH

SEQ ID NO: 21103 - protein, 12 aa, Neisseria
ELEKHELHDRIQ

SEQ ID NO: 21104 - protein, 8 aa, Neisseria
HGGEKYSE

SEQ ID NO: 21105 - protein, 7 aa, Neisseria
AVMDELN

SEQ ID NO: 21106 - protein, 6 aa, Neisseria
MPERAY

SEQ ID NO: 21107 - protein, 9 aa, Neisseria
RELRKKYAF

SEQ ID NO: 21108 - protein, 7 aa, Neisseria
KPLEDIR

SEQ ID NO: 21109 - protein, 8 aa, Neisseria
KNGKSVDT

SEQ ID NO: 21110 - protein, 7 aa, Neisseria
RCGDIDP

SEQ ID NO: 21111 - protein, 12 aa, Neisseria
AQVDEMLNKKSG

SEQ ID NO: 21112 - protein, 22 aa, Neisseria
ELSNDCRTLEIAADEGHEGARL

SEQ ID NO: 21113 - protein, 12 aa, Neisseria
IGENSRNIRAKT

SEQ ID NO: 21114 - protein, 12 aa, Neisseria
IDTKANMEKRYG

SEQ ID NO: 21115 - protein, 5 aa, Neisseria
TNEEL

SEQ ID NO: 21116 - protein, 7 aa, Neisseria
HRVVQFA

SEQ ID NO: 21117 - protein, 9 aa, Neisseria
VGGIHGFAT

SEQ ID NO: 21118 - protein, 7 aa, Neisseria
VRAGGSF

SEQ ID NO: 21119 - protein, 16 aa, Neisseria
RTVSADFLEFFQSCGI

SEQ ID NO: 21120 - protein, 18 aa, Neisseria
VVLQLFARVAQVGGIQEN

SEQ ID NO: 21121 - protein, 13 aa, Neisseria
RHINFIDQIAGWE

SEQ ID NO: 21122 - protein, 8 aa, Neisseria
VGWIKKFD

SEQ ID NO: 21123 - protein, 9 aa, Neisseria
FQNCAVLHR

SEQ ID NO: 21124 - protein, 25 aa, Neisseria
AACGKVDQRTGHGGGGRNGNRGGTH

SEQ ID NO: 21125 - protein, 18 aa, Neisseria
GGGRDEGDFRRVRAGGSF

SEQ ID NO: 21126 - protein, 17 aa, Neisseria
GIQENGRNARVDERGFQ

SEQ ID NO: 21127 - protein, 10 aa, Neisseria
YFGCRERYAV

SEQ ID NO: 21128 - protein, 5 aa, Neisseria
MGNNG

SEQ ID NO: 21129 - protein, 8 aa, Neisseria
LPDFDCAD

SEQ ID NO: 21130 - protein, 9 aa, Neisseria
GKVDQRTGH

SEQ ID NO: 21131 - protein, 12 aa, Neisseria
GGGRNGNRGGTH

SEQ ID NO: 21132 - protein, 13 aa, Neisseria
GGRDEGDFRRVRA

SEQ ID NO: 21133 - protein, 16 aa, Neisseria
GIQENGRNARVDERGF

SEQ ID NO: 21134 - protein, 7 aa, Neisseria
CRERYAV

SEQ ID NO: 21135 - protein, 5 aa, Neisseria
FDCAD

SEQ ID NO: 21136 - protein, 8 aa, Neisseria
RQIWKIAD

SEQ ID NO: 21137 - protein, 16 aa, Neisseria
TLFYRFISENFTDYMQ

SEQ ID NO: 21138 - protein, 9 aa, Neisseria
KLKEIFTAI

SEQ ID NO: 21139 - protein, 9 aa, Neisseria
IKGLFDDFD

SEQ ID NO: 21140 - protein, 5 aa, Neisseria
RLGST

SEQ ID NO: 21141 - protein, 9 aa, Neisseria
AVLKGVAEL

SEQ ID NO: 21142 - protein, 14 aa, Neisseria
IDLFGDAYEYLISN

SEQ ID NO: 21143 - protein, 6 aa, Neisseria
AANAGK

SEQ ID NO: 21144 - protein, 7 aa, Neisseria
VSKLIAR

SEQ ID NO: 21145 - protein, 9 aa, Neisseria
EKVNKIYDP

SEQ ID NO: 21146 - protein, 5 aa, Neisseria
FDEHI

SEQ ID NO: 21147 - protein, 11 aa, Neisseria
DSKPFDAVVSN

SEQ ID NO: 21148 - protein, 5 aa, Neisseria
HALNY

SEQ ID NO: 21149 - protein, 5 aa, Neisseria
VSFPG

SEQ ID NO: 21150 - protein, 11 aa, Neisseria
EHIAEIVKLFA

SEQ ID NO: 21151 - protein, 8 aa, Neisseria
AQNAAQQT

SEQ ID NO: 21152 - protein, 6 aa, Neisseria
SYVEPE

SEQ ID NO: 21153 - protein, 7 aa, Neisseria
TREIIDI

SEQ ID NO: 21154 - protein, 25 aa, Neisseria
AEISETVAKIERLRREIDEVIAEIE

SEQ ID NO: 21155 - protein, 7 aa, Neisseria
IQQRAQL

SEQ ID NO: 21156 - protein, 13 aa, Neisseria
IADEVRGAVDGWD

SEQ ID NO: 21157 - protein, 17 aa, Neisseria
ISENFTDYMQAGDSSID

SEQ ID NO: 21158 - protein, 5 aa, Neisseria
AMPDS

SEQ ID NO: 21159 - protein, 10 aa, Neisseria
PEIKDDAVKV

SEQ ID NO: 21160 - protein, 13 aa, Neisseria
AHQNEELNTKLKE

SEQ ID NO: 21161 - protein, 27 aa, Neisseria
ESSASGYPSEQDIKGLFDDFDTTSSRL

SEQ ID NO: 21162 - protein, 8 aa, Neisseria
VADKNKRL

SEQ ID NO: 21163 - protein, 9 aa, Neisseria
DFGSFEDHH

SEQ ID NO: 21164 - protein, 11 aa, Neisseria
NAGKSGGEFFT

SEQ ID NO: 21165 - protein, 17 aa, Neisseria
GQEKVNKIYDPACGSGS

SEQ ID NO: 21166 - protein, 7 aa, Neisseria
QAKKQFD

SEQ ID NO: 21167 - protein, 8 aa, Neisseria
EINHTTYN

SEQ ID NO: 21168 - protein, 18 aa, Neisseria
LGDTLTNPKLKDSKPFDA

SEQ ID NO: 21169 - protein, 15 aa, Neisseria
GSGDPTLINDDRFAP

SEQ ID NO: 21170 - protein, 6 aa, Neisseria
PKSKAD

SEQ ID NO: 21171 - protein, 9 aa, Neisseria
YLSGRGRAA

SEQ ID NO: 21172 - protein, 10 aa, Neisseria
YRGGAEQKIR

SEQ ID NO: 21173 - protein, 9 aa, Neisseria
LSKHKDNTD

SEQ ID NO: 21174 - protein, 18 aa, Neisseria
GGFFKKETNNNVLTEEHI

SEQ ID NO: 21175 - protein, 7 aa, Neisseria
FADKADV

SEQ ID NO: 21176 - protein, 8 aa, Neisseria
QTVKDNGY

SEQ ID NO: 21177 - protein, 11 aa, Neisseria
VEPEDTREIID

SEQ ID NO: 21178 - protein, 21 aa, Neisseria
EISETVAKIERLRREIDEVIA

SEQ ID NO: 21179 - protein, 10 aa, Neisseria
IADEVRGAVD

SEQ ID NO: 21180 - protein, 5 aa, Neisseria
GDSSI

SEQ ID NO: 21181 - protein, 10 aa, Neisseria
PEIKDDAVKV

SEQ ID NO: 21182 - protein, 13 aa, Neisseria
AHQNEELNTKLKE

SEQ ID NO: 21183 - protein, 21 aa, Neisseria
YPSEQDIKGLFDDFDTTSSRL

SEQ ID NO: 21184 - protein, 8 aa, Neisseria
VADKNKRL

SEQ ID NO: 21185 - protein, 6 aa, Neisseria
SFEDHH

SEQ ID NO: 21186 - protein, 6 aa, Neisseria
AGKSGG

SEQ ID NO: 21187 - protein, 10 aa, Neisseria
GQEKVNKIYD

SEQ ID NO: 21188 - protein, 7 aa, Neisseria
QAKKQFD

SEQ ID NO: 21189 - protein, 9 aa, Neisseria
PKLKDSKPF

SEQ ID NO: 21190 - protein, 8 aa, Neisseria
LINDDRFA

SEQ ID NO: 21191 - protein, 6 aa, Neisseria
PKSKAD

SEQ ID NO: 21192 - protein, 5 aa, Neisseria
GRGRA

SEQ ID NO: 21193 - protein, 8 aa, Neisseria
GGAEQKIR

SEQ ID NO: 21194 - protein, 8 aa, Neisseria
SKHKDNTD

SEQ ID NO: 21195 - protein, 8 aa, Neisseria
GFFKKETN

SEQ ID NO: 21196 - protein, 6 aa, Neisseria
LTEEHI

SEQ ID NO: 21197 - protein, 7 aa, Neisseria
FADKADV

SEQ ID NO: 21198 - protein, 7 aa, Neisseria
QTVKDNG

SEQ ID NO: 21199 - protein, 11 aa, Neisseria
VEPEDTREIID

SEQ ID NO: 21200 - protein, 21 aa, Neisseria
EISETVAKIERLRREIDEVIA

SEQ ID NO: 21201 - protein, 9 aa, Neisseria
LLDHMTRDE

SEQ ID NO: 21202 - protein, 7 aa, Neisseria
AHVGNGD

SEQ ID NO: 21203 - protein, 11 aa, Neisseria
LTLIQGVVNTF

SEQ ID NO: 21204 - protein, 5 aa, Neisseria
RIIAN

SEQ ID NO: 21205 - protein, 16 aa, Neisseria
SMVFQILFGFLASLIV

SEQ ID NO: 21206 - protein, 14 aa, Neisseria
KLVGAPKMISALQR

SEQ ID NO: 21207 - protein, 8 aa, Neisseria
DLPEEMNA

SEQ ID NO: 21208 - protein, 12 aa, Neisseria
EVIDTPRTEEEA

SEQ ID NO: 21209 - protein, 13 aa, Neisseria
EAQARQWNLKTPE

SEQ ID NO: 21210 - protein, 7 aa, Neisseria
HSPEPNA

SEQ ID NO: 21211 - protein, 8 aa, Neisseria
TGASRNSS

SEQ ID NO: 21212 - protein, 9 aa, Neisseria
HMTRDEVEA

SEQ ID NO: 21213 - protein, 5 aa, Neisseria
VGNGD

SEQ ID NO: 21214 - protein, 13 aa, Neisseria
IARNNDGSQSQGT

SEQ ID NO: 21215 - protein, 11 aa, Neisseria
RQREYRADAGA

SEQ ID NO: 21216 - protein, 16 aa, Neisseria
LQRLKGNPVDLPEEMN

SEQ ID NO: 21217 - protein, 23 aa, Neisseria
GDTRDSLLSTHPSLDNRIARLKS

SEQ ID NO: 21218 - protein, 12 aa, Neisseria
EVIDTPRTEEEA

SEQ ID NO: 21219 - protein, 5 aa, Neisseria
ASRNS

SEQ ID NO: 21220 - protein, 9 aa, Neisseria
HMTRDEVEA

SEQ ID NO: 21221 - protein, 8 aa, Neisseria
RNNDGSQS

SEQ ID NO: 21222 - protein, 11 aa, Neisseria
RQREYRADAGA

SEQ ID NO: 21223 - protein, 7 aa, Neisseria
QRLKGNP

SEQ ID NO: 21224 - protein, 7 aa, Neisseria
DLPEEMN

SEQ ID NO: 21225 - protein, 7 aa, Neisseria
GDTRDSL

SEQ ID NO: 21226 - protein, 12 aa, Neisseria
PSLDNRIARLKS

SEQ ID NO: 21227 - protein, 8 aa, Neisseria
RLLTALAL

SEQ ID NO: 21228 - protein, 14 aa, Neisseria
FMGIMAALNPMIAQ

SEQ ID NO: 21229 - protein, 7 aa, Neisseria
TDEVGET

SEQ ID NO: 21230 - protein, 33 aa, Neisseria; identical to SEQ ID NO: 7926

SEQ ID NO: 21231 - protein, 12 aa, Neisseria
MVHRALHAYASS

SEQ ID NO: 21232 - protein, 6 aa, Neisseria
FFRPFG

SEQ ID NO: 21233 - protein, 9 aa, Neisseria
FKQIWKIGA

SEQ ID NO: 21234 - protein, 9 aa, Neisseria
ARYISGVSL

SEQ ID NO: 21235 - protein, 7 aa, Neisseria
ITVLSLV

SEQ ID NO: 21236 - protein, 14 aa, Neisseria
FQPADFTQCIASYA

SEQ ID NO: 21237 - protein, 9 aa, Neisseria
YGFWTALIA

SEQ ID NO: 21238 - protein, 5 aa, Neisseria
KEVRL

SEQ ID NO: 21239 - protein, 8 aa, Neisseria
GAGKEDLA

SEQ ID NO: 21240 - protein, 16 aa, Neisseria
GAGKTDEVGETGRQGI

SEQ ID NO: 21241 - protein, 5 aa, Neisseria
PFRNW

SEQ ID NO: 21242 - protein, 8 aa, Neisseria
LSDYVEGT

SEQ ID NO: 21243 - protein, 9 aa, Neisseria
ASSLNRPRL

SEQ ID NO: 21244 - protein, 8 aa, Neisseria
AKFGKPDW

SEQ ID NO: 21245 - protein, 14 aa, Neisseria
SLGRREFSRARYIS

SEQ ID NO: 21246 - protein, 5 aa, Neisseria
YNNDP

SEQ ID NO: 21247 - protein, 7 aa, Neisseria
RGYKVTK

SEQ ID NO: 21248 - protein, 13 aa, Neisseria
LCSREMVRSHKAV

SEQ ID NO: 21249 - protein, 5 aa, Neisseria
KEVRL

SEQ ID NO: 21250 - protein, 8 aa, Neisseria
GAGKEDLA

SEQ ID NO: 21251 - protein, 11 aa, Neisseria
GKTDEVGETGR

SEQ ID NO: 21252 - protein, 5 aa, Neisseria
LNRPR

SEQ ID NO: 21253 - protein, 8 aa, Neisseria
LGRREFSR

SEQ ID NO: 21254 - protein, 5 aa, Neisseria
YKVTK

SEQ ID NO: 21255 - protein, 13 aa, Neisseria
LCSREMVRSHKAV

SEQ ID NO: 21256 - protein, 7 aa, Neisseria
AVQKILQ

SEQ ID NO: 21257 - protein, 5 aa, Neisseria
VLSLL

SEQ ID NO: 21258 - protein, 13 aa, Neisseria
RASDELARIFGTQ

SEQ ID NO: 21259 - protein, 27 aa, Neisseria
DIGHGIKQIGRNIAEQIGRFSREPESA

SEQ ID NO: 21260 - protein, 28 aa, Neisseria
NEALADCLDEISRLRDGVERLNERLDRL

SEQ ID NO: 21261 - protein, 10 aa, Neisseria
LQSPDSRSEL

SEQ ID NO: 21262 - protein, 28 aa, Neisseria
LAGRITEDGLLSAGNGFADTEITFRNSA

SEQ ID NO: 21263 - protein, 15 aa, Neisseria
LQGGEPGAGDIGLEG

SEQ ID NO: 21264 - protein, 12 aa, Neisseria
GSLRSRASDELA

SEQ ID NO: 21265 - protein, 11 aa, Neisseria
TQADIGSRAAD

SEQ ID NO: 21266 - protein, 7 aa, Neisseria
QIGRNIA

SEQ ID NO: 21267 - protein, 16 aa, Neisseria
QIGRFSREPESANIGN

SEQ ID NO: 21268 - protein, 31 aa, Neisseria; identical to SEQ ID NO: 7972

SEQ ID NO: 21269 - protein, 8 aa, Neisseria
SPDSRSEL

SEQ ID NO: 21270 - protein, 10 aa, Neisseria
LAGRITEDGL

SEQ ID NO: 21271 - protein, 7 aa, Neisseria
ADTEITF

SEQ ID NO: 21272 - protein, 6 aa, Neisseria
GEPGAG

SEQ ID NO: 21273 - protein, 5 aa, Neisseria
IGLEG

SEQ ID NO: 21274 - protein, 10 aa, Neisseria
LRSRASDELA

SEQ ID NO: 21275 - protein, 9 aa, Neisseria
ADIGSRAAD

SEQ ID NO: 21276 - protein, 15 aa, Neisseria
QIGRFSREPESANIG

SEQ ID NO: 21277 - protein, 31 aa, Neisseria; identical to SEQ ID NO: 7972

SEQ ID NO: 21278 - protein, 6 aa, Neisseria
TLDAFV

SEQ ID NO: 21279 - protein, 14 aa, Neisseria
HHIFHEFRVFVGFF

SEQ ID NO: 21280 - protein, 6 aa, Neisseria
FEQAVE

SEQ ID NO: 21281 - protein, 5 aa, Neisseria
IDDFL

SEQ ID NO: 21282 - protein, 6 aa, Neisseria
VAVCTV

SEQ ID NO: 21283 - protein, 7 aa, Neisseria
ALDDETL

SEQ ID NO: 21284 - protein, 10 aa, Neisseria
VGNQRSSDIA

SEQ ID NO: 21285 - protein, 9 aa, Neisseria
DFLDTDFGI

SEQ ID NO: 21286 - protein, 8 aa, Neisseria
SQADGNVR

SEQ ID NO: 21287 - protein, 13 aa, Neisseria
GTRAKRGYGNHDL

SEQ ID NO: 21288 - protein, 5 aa, Neisseria
READI

SEQ ID NO: 21289 - protein, 7 aa, Neisseria
ALDDETL

SEQ ID NO: 21290 - protein, 6 aa, Neisseria
QRSSDI

SEQ ID NO: 21291 - protein, 7 aa, Neisseria
SQADGNV

SEQ ID NO: 21292 - protein, 8 aa, Neisseria
TRAKRGYG

SEQ ID NO: 21293 - protein, 5 aa, Neisseria
READI

SEQ ID NO: 21294 - protein, 5 aa, Neisseria
MQFPY

SEQ ID NO: 21295 - protein, 10 aa, Neisseria
SASRMRRMRR

SEQ ID NO: 21296 - protein, 7 aa, Neisseria
ERAQEAY

SEQ ID NO: 21297 - protein, 10 aa, Neisseria
PSTVRALRER

SEQ ID NO: 21298 - protein, 6 aa, Neisseria
IREALE

SEQ ID NO: 21299 - protein, 11 aa, Neisseria
YASAFYGPFRD

SEQ ID NO: 21300 - protein, 8 aa, Neisseria
SGNLGKAD

SEQ ID NO: 21301 - protein, 10 aa, Neisseria
LDVVRRVKDE

SEQ ID NO: 21302 - protein, 5 aa, Neisseria
AAVAN

SEQ ID NO: 21303 - protein, 30 aa, Neisseria
RNVSASRMRRMRRDDFSRRLMREHTLTADD

SEQ ID NO: 21304 - protein, 20 aa, Neisseria
GSAREEDVPSMPGVKRQSLD

SEQ ID NO: 21305 - protein, 6 aa, Neisseria
AEEAVK

SEQ ID NO: 21306 - protein, 17 aa, Neisseria
ANKTERAQEAYNPEGLV

SEQ ID NO: 21307 - protein, 8 aa, Neisseria
RALRERFP

SEQ ID NO: 21308 - protein, 18 aa, Neisseria
GQDGLTDENGYVMNDETV

SEQ ID NO: 21309 - protein, 22 aa, Neisseria
APSDMMDGRIGAIREALEDAGH

SEQ ID NO: 21310 - protein, 32 aa, Neisseria; identical to SEQ ID NO: 8005

SEQ ID NO: 21311 - protein, 8 aa, Neisseria
LDIQEGAD

SEQ ID NO: 21312 - protein, 11 aa, Neisseria
VVRRVKDEFGV

SEQ ID NO: 21313 - protein, 8 aa, Neisseria
WLDGGKVV

SEQ ID NO: 21314 - protein, 7 aa, Neisseria
KRAGADG

SEQ ID NO: 21315 - protein, 8 aa, Neisseria
EAAKMLKR

SEQ ID NO: 21316 - protein, 25 aa, Neisseria
SASRMRRMRRDDFSRRLMREHTLTA

SEQ ID NO: 21317 - protein, 10 aa, Neisseria
GSAREEDVPS

SEQ ID NO: 21318 - protein, 9 aa, Neisseria
PGVKRQSLD

SEQ ID NO: 21319 - protein, 6 aa, Neisseria
AEEAVK

SEQ ID NO: 21320 - protein, 11 aa, Neisseria
NKTERAQEAYN

SEQ ID NO: 21321 - protein, 8 aa, Neisseria
RALRERFP

SEQ ID NO: 21322 - protein, 8 aa, Neisseria
DGLTDENG

SEQ ID NO: 21323 - protein, 6 aa, Neisseria
MNDETV

SEQ ID NO: 21324 - protein, 18 aa, Neisseria
DMMDGRIGAIREALEDAG

SEQ ID NO: 21325 - protein, 6 aa, Neisseria
FRDAVG

SEQ ID NO: 21326 - protein, 11 aa, Neisseria
NLGKADKKTYQ

SEQ ID NO: 21327 - protein, 9 aa, Neisseria
PANTDEALH

SEQ ID NO: 21328 - protein, 8 aa, Neisseria
LDIQEGAD

SEQ ID NO: 21329 - protein, 10 aa, Neisseria
VVRRVKDEFG

SEQ ID NO: 21330 - protein, 5 aa, Neisseria
KRAGA

SEQ ID NO: 21331 - protein, 8 aa, Neisseria
EAAKMLKR

SEQ ID NO: 21332 - protein, 9 aa, Neisseria
CRLFGKLSL

SEQ ID NO: 21333 - protein, 6 aa, Neisseria
RLLLGL

SEQ ID NO: 21334 - protein, 7 aa, Neisseria
RSVRRVI

SEQ ID NO: 21335 - protein, 5 aa, Neisseria
QVVAV

SEQ ID NO: 21336 - protein, 7 aa, Neisseria
VFIEDFV

SEQ ID NO: 21337 - protein, 10 aa, Neisseria
LGFLGNVLRT

SEQ ID NO: 21338 - protein, 13 aa, Neisseria
MPSENRMGKRQLA

SEQ ID NO: 21339 - protein, 10 aa, Neisseria
CRSGVCRGRC

SEQ ID NO: 21340 - protein, 16 aa, Neisseria
FPSRSVRRVIFRRVRI

SEQ ID NO: 21341 - protein, 7 aa, Neisseria
NPADFRI

SEQ ID NO: 21342 - protein, 5 aa, Neisseria
ASQED

SEQ ID NO: 21343 - protein, 13 aa, Neisseria
MPSENRMGKRQLA

SEQ ID NO: 21344 - protein, 7 aa, Neisseria
GVCRGRC

SEQ ID NO: 21345 - protein, 8 aa, Neisseria
VIFRRVRI

SEQ ID NO: 21346 - protein, 5 aa, Neisseria
ADFRI

SEQ ID NO: 21347 - protein, 5 aa, Neisseria
ASQED

SEQ ID NO: 21348 - protein, 9 aa, Neisseria
NIAKKLAGV

SEQ ID NO: 21349 - protein, 13 aa, Neisseria
ADKAVEKCAENVL

SEQ ID NO: 21350 - protein, 5 aa, Neisseria
GNFPN

SEQ ID NO: 21351 - protein, 23 aa, Neisseria
  VARIANT (1)...(23): Xaa is any amino acid
NPYXKLNKSKSPDIFRRFFXGHS

SEQ ID NO: 21352 - protein, 9 aa, Neisseria
IAKKLAGVD

SEQ ID NO: 21353 - protein, 7 aa, Neisseria
IAFDFDG

SEQ ID NO: 21354 - protein, 13 aa, Neisseria
DFGRDDAVRHSGV

SEQ ID NO: 21355 - protein, 8 aa, Neisseria
KAVEKCAE

SEQ ID NO: 21356 - protein, 20 aa, Neisseria
  VARIANT 8: Xaa is any amino acid
GHHRNPYXKLNKSKSPDIFR

SEQ ID NO: 21357 - protein, 9 aa, Neisseria
IAKKLAGVD

SEQ ID NO: 21358 - protein, 8 aa, Neisseria
FGRDDAVR

SEQ ID NO: 21359 - protein, 8 aa, Neisseria
KAVEKCAE

SEQ ID NO: 21360 - protein, 11 aa, Neisseria
KLNKSKSPDIF

SEQ ID NO: 21361 - protein, 5 aa, Neisseria
SRRSL

SEQ ID NO: 21362 - protein, 6 aa, Neisseria
MPRMRS

SEQ ID NO: 21363 - protein, 6 aa, Neisseria
SPMSPA

SEQ ID NO: 21364 - protein, 10 aa, Neisseria
RIFCTALLRK

SEQ ID NO: 21365 - protein, 6 aa, Neisseria
SSVMRP

SEQ ID NO: 21366 - protein, 7 aa, Neisseria
LSGLCRI

SEQ ID NO: 21367 - protein, 18 aa, Neisseria
MSRSSRSRRSLRRSTPSR

SEQ ID NO: 21368 - protein, 8 aa, Neisseria
SSRQSARA

SEQ ID NO: 21369 - protein, 10 aa, Neisseria
FADSGSRENL

SEQ ID NO: 21370 - protein, 22 aa, Neisseria
PKIRANSSDARERRLPSRDSTA

SEQ ID NO: 21371 - protein, 19 aa, Neisseria
PRMRSPSSPMSPAPGSPPW

SEQ ID NO: 21372 - protein, 18 aa, Neisseria
AKPFPAESKPSSVMRPAS

SEQ ID NO: 21373 - protein, 16 aa, Neisseria
KAASSERLSGLCRIRR

SEQ ID NO: 21374 - protein, 15 aa, Neisseria
MMGRRADIFSDRGGE

SEQ ID NO: 21375 - protein, 17 aa, Neisseria
MSRSSRSRRSLRRSTPS

SEQ ID NO: 21376 - protein, 7 aa, Neisseria
SRQSARA

SEQ ID NO: 21377 - protein, 7 aa, Neisseria
SGSRENL

SEQ ID NO: 21378 - protein, 22 aa, Neisseria
PKIRANSSDARERRLPSRDSTA

SEQ ID NO: 21379 - protein, 7 aa, Neisseria
PRMRSPS

SEQ ID NO: 21380 - protein, 12 aa, Neisseria
FPAESKPSSVMR

SEQ ID NO: 21381 - protein, 10 aa, Neisseria
KAASSERLSG

SEQ ID NO: 21382 - protein, 5 aa, Neisseria
CRIRR

SEQ ID NO: 21383 - protein, 15 aa, Neisseria
MMGRRADIFSDRGGE

SEQ ID NO: 21384 - protein, 7 aa, Neisseria
SQFIQQV

SEQ ID NO: 21385 - protein, 8 aa, Neisseria
NLIKTLLD

SEQ ID NO: 21386 - protein, 10 aa, Neisseria
ALFYSLLPVL

SEQ ID NO: 21387 - protein, 27 aa, Neisseria
VAGCDEAKEEVQEIVDYLKAPNRYQSL

SEQ ID NO: 21388 - protein, 7 aa, Neisseria
DFVEMFV

SEQ ID NO: 21389 - protein, 8 aa, Neisseria
RVRDMFEQ

SEQ ID NO: 21390 - protein, 7 aa, Neisseria
EIDAVGR

SEQ ID NO: 21391 - protein, 10 aa, Neisseria
PALQRPGRFD

SEQ ID NO: 21392 - protein, 8 aa, Neisseria
SVDLLSLA

SEQ ID NO: 21393 - protein, 8 aa, Neisseria
ADLANLVN

SEQ ID NO: 21394 - protein, 12 aa, Neisseria
LDGKKEDNGQIE

SEQ ID NO: 21395 - protein, 8 aa, Neisseria
VNNGEVSG

SEQ ID NO: 21396 - protein, 12 aa, Neisseria
LIKGERTDKSTF

SEQ ID NO: 21397 - protein, 8 aa, Neisseria
APLDDNLI

SEQ ID NO: 21398 - protein, 18 aa, Neisseria
LLDKNVRVKVTPEEKPSA

SEQ ID NO: 21399 - protein, 10 aa, Neisseria
MQTGGGGKGG

SEQ ID NO: 21400 - protein, 16 aa, Neisseria
SFGKSRARLLDKDANK

SEQ ID NO: 21401 - protein, 12 aa, Neisseria
AGCDEAKEEVQE

SEQ ID NO: 21402 - protein, 17 aa, Neisseria
LKAPNRYQSLGGRVPRG

SEQ ID NO: 21403 - protein, 10 aa, Neisseria
GSPGTGKTLL

SEQ ID NO: 21404 - protein, 5 aa, Neisseria
SGSDF

SEQ ID NO: 21405 - protein, 16 aa, Neisseria
GASRVRDMFEQAKKNA

SEQ ID NO: 21406 - protein, 25 aa, Neisseria
DEIDAVGRQRGAGLGGGNDEREQTL

SEQ ID NO: 21407 - protein, 8 aa, Neisseria
MDGFESNQ

SEQ ID NO: 21408 - protein, 19 aa, Neisseria
TNRPDVLDPALQRPGRFDR

SEQ ID NO: 21409 - protein, 10 aa, Neisseria
LPDIRGREQI

SEQ ID NO: 21410 - protein, 13 aa, Neisseria
VHSKKVPLDKSVD

SEQ ID NO: 21411 - protein, 8 aa, Neisseria
RGTPGFSG

SEQ ID NO: 21412 - protein, 21 aa, Neisseria
AGRRNKVKVDQSDLKTPKTKS

SEQ ID NO: 21413 - protein, 10 aa, Neisseria
LDGKKEDNGQ

SEQ ID NO: 21414 - protein, 6 aa, Neisseria
NNGEVS

SEQ ID NO: 21415 - protein, 10 aa, Neisseria
IKGERTDKST

SEQ ID NO: 21416 - protein, 7 aa, Neisseria
PLDDNLI

SEQ ID NO: 21417 - protein, 17 aa, Neisseria
LLDKNVRVKVTPEEKPS

SEQ ID NO: 21418 - protein, 14 aa, Neisseria
GKSRARLLDKDANK

SEQ ID NO: 21419 - protein, 12 aa, Neisseria
AGCDEAKEEVQE

SEQ ID NO: 21420 - protein, 5 aa, Neisseria
KAPNR

SEQ ID NO: 21421 - protein, 6 aa, Neisseria
GGRVPR

SEQ ID NO: 21422 - protein, 14 aa, Neisseria
SRVRDMFEQAKKNA

SEQ ID NO: 21423 - protein, 13 aa, Neisseria
DEIDAVGRQRGAG

SEQ ID NO: 21424 - protein, 9 aa, Neisseria
GGNDEREQT

SEQ ID NO: 21425 - protein, 5 aa, Neisseria
DGFES

SEQ ID NO: 21426 - protein, 8 aa, Neisseria
TNRPDVLD

SEQ ID NO: 21427 - protein, 10 aa, Neisseria
ALQRPGRFDR

SEQ ID NO: 21428 - protein, 9 aa, Neisseria
PDIRGREQI

SEQ ID NO: 21429 - protein, 12 aa, Neisseria
HSKKVPLDKSVD

SEQ ID NO: 21430 - protein, 20 aa, Neisseria
AGRRNKVKVDQSDLKTPKTK

SEQ ID NO: 21431 - protein, 6 aa, Neisseria
KMVVGL

SEQ ID NO: 21432 - protein, 7 aa, Neisseria
NPGKEYE

SEQ ID NO: 21433 - protein, 7 aa, Neisseria
FGEVARA

SEQ ID NO: 21434 - protein, 9 aa, Neisseria
VAALAQFYK

SEQ ID NO: 21435 - protein, 8 aa, Neisseria
GHNGLKDI

SEQ ID NO: 21436 - protein, 10 aa, Neisseria
PTDRCRRQIP

SEQ ID NO: 21437 - protein, 10 aa, Neisseria
TRHPCRQMRG

SEQ ID NO: 21438 - protein, 8 aa, Neisseria
TACSRFPY

SEQ ID NO: 21439 - protein, 10 aa, Neisseria
APVQNLPNVA

SEQ ID NO: 21440 - protein, 8 aa, Neisseria
GGIYSLLF

SEQ ID NO: 21441 - protein, 5 aa, Neisseria
FDKAA

SEQ ID NO: 21442 - protein, 12 aa, Neisseria
CFALFSECAQAF

SEQ ID NO: 21443 - protein, 19 aa, Neisseria
ATRTGSLGDVLADMAGTVL

SEQ ID NO: 21444 - protein, 17 aa, Neisseria
LGNPGKEYEQTRHNAGF

SEQ ID NO: 21445 - protein, 10 aa, Neisseria
ASFKEEKKFF

SEQ ID NO: 21446 - protein, 10 aa, Neisseria
VARATLPDGD

SEQ ID NO: 21447 - protein, 12 aa, Neisseria
KPTTFMNRSGQA

SEQ ID NO: 21448 - protein, 5 aa, Neisseria
IKPEE

SEQ ID NO: 21449 - protein, 12 aa, Neisseria
DELDIPCGRIKF

SEQ ID NO: 21450 - protein, 16 aa, Neisseria
LGGGNGGHNGLKDIQA

SEQ ID NO: 21451 - protein, 7 aa, Neisseria
GTADYYR

SEQ ID NO: 21452 - protein, 9 aa, Neisseria
IGHPGDRNL

SEQ ID NO: 21453 - protein, 36 aa, Neisseria
  VARIANT 8: Xaa is any amino acid
LNKPSTEXPPTDRCRRQIPASHTRHPCRQMRGNPLP

SEQ ID NO: 21454 - protein, 28 aa, Neisseria
QMTRCRLKPFQTACSRFPYPNSHDRTQA

SEQ ID NO: 21455 - protein, 17 aa, Neisseria
YPNRIHPRHRRNPRFPA

SEQ ID NO: 21456 - protein, 27 aa, Neisseria
MQHRRRTIRRRSGTMARHTCRTRRQIP

SEQ ID NO: 21457 - protein, 23 aa, Neisseria
PVQNLPNVAGRGGGMKLPRNRFS

SEQ ID NO: 21458 - protein, 16 aa, Neisseria
AADTAPPPFPHFDKAA

SEQ ID NO: 21459 - protein, 9 aa, Neisseria
AFKTGKLPI

SEQ ID NO: 21460 - protein, 8 aa, Neisseria
ATRTGSLG

SEQ ID NO: 21461 - protein, 7 aa, Neisseria
RAADRPD

SEQ ID NO: 21462 - protein, 11 aa, Neisseria
NPGKEYEQTRH

SEQ ID NO: 21463 - protein, 10 aa, Neisseria
ASFKEEKKFF

SEQ ID NO: 21464 - protein, 5 aa, Neisseria
IKPEE

SEQ ID NO: 21465 - protein, 12 aa, Neisseria
DELDIPCGRIKF

SEQ ID NO: 21466 - protein, 8 aa, Neisseria
NGLKDIQA

SEQ ID NO: 21467 - protein, 7 aa, Neisseria
HPGDRNL

SEQ ID NO: 21468 - protein, 16 aa, Neisseria
  VARIANT 5: Xaa is any amino acid
PSTEXPPTDRCRRQIP

SEQ ID NO: 21469 - protein, 14 aa, Neisseria
SHTRHPCRQMRGNP

SEQ ID NO: 21470 - protein, 9 aa, Neisseria
QMTRCRLKP

SEQ ID NO: 21471 - protein, 7 aa, Neisseria
NSHDRTQ

SEQ ID NO: 21472 - protein, 10 aa, Neisseria
IHPRHRRNPR

SEQ ID NO: 21473 - protein, 15 aa, Neisseria
MQHRRRTIRRRSGTM

SEQ ID NO: 21474 - protein, 9 aa, Neisseria
HTCRTRRQI

SEQ ID NO: 21475 - protein, 6 aa, Neisseria
AGRGGG

SEQ ID NO: 21476 - protein, 7 aa, Neisseria
KLPRNRF

SEQ ID NO: 21477 - protein, 5 aa, Neisseria
AADTA

SEQ ID NO: 21478 - protein, 6 aa, Neisseria
HFDKAA

SEQ ID NO: 21479 - protein, 6 aa, Neisseria
AFKTGK

SEQ ID NO: 21480 - protein, 7 aa, Neisseria
RAADRPD

SEQ ID NO: 21481 - protein, 6 aa, Neisseria
KLAALL

SEQ ID NO: 21482 - protein, 8 aa, Neisseria
QLFQTLTN

SEQ ID NO: 21483 - protein, 6 aa, Neisseria
QGGRDL

SEQ ID NO: 21484 - protein, 17 aa, Neisseria
GVIFGILFRSLSSLLSR

SEQ ID NO: 21485 - protein, 5 aa, Neisseria
DPEEF

SEQ ID NO: 21486 - protein, 11 aa, Neisseria
NMFAGFNTVHS

SEQ ID NO: 21487 - protein, 21 aa, Neisseria
AVVGPVSFFGLLAASLANHFS

SEQ ID NO: 21488 - protein, 7 aa, Neisseria
LSVVVEF

SEQ ID NO: 21489 - protein, 7 aa, Neisseria
MPSEKNI

SEQ ID NO: 21490 - protein, 6 aa, Neisseria
AGSSRP

SEQ ID NO: 21491 - protein, 7 aa, Neisseria
NVKGDWD

SEQ ID NO: 21492 - protein, 9 aa, Neisseria
IKQGGRDLP

SEQ ID NO: 21493 - protein, 8 aa, Neisseria
MIDPEEFT

SEQ ID NO: 21494 - protein, 7 aa, Neisseria
WRERYRL

SEQ ID NO: 21495 - protein, 7 aa, Neisseria
LLGRDQA

SEQ ID NO: 21496 - protein, 9 aa, Neisseria
FSPSVKHSV

SEQ ID NO: 21497 - protein, 7 aa, Neisseria
MPSEKNI

SEQ ID NO: 21498 - protein, 7 aa, Neisseria
QGGRDLP

SEQ ID NO: 21499 - protein, 8 aa, Neisseria
MIDPEEFT

SEQ ID NO: 21500 - protein, 7 aa, Neisseria
WRERYRL

SEQ ID NO: 21501 - protein, 7 aa, Neisseria
LLGRDQA

SEQ ID NO: 21502 - protein, 5 aa, Neisseria
VKHSV

SEQ ID NO: 21503 - protein, 12 aa, Neisseria
VAVSALSACRQA

SEQ ID NO: 21504 - protein, 6 aa, Neisseria
ISDRSV

SEQ ID NO: 21505 - protein, 34 aa, Neisseria; identical to SEQ ID NO: 8203

SEQ ID NO: 21506 - protein, 5 aa, Neisseria
QAEKF

SEQ ID NO: 21507 - protein, 24 aa, Neisseria
SACRQAEEGPPPLPRQISDRSVGH

SEQ ID NO: 21508 - protein, 10 aa, Neisseria
NLTEHNGPKA

SEQ ID NO: 21509 - protein, 8 aa, Neisseria
NGKPDQPV

SEQ ID NO: 21510 - protein, 11 aa, Neisseria
YTKLPEEPKGI

SEQ ID NO: 21511 - protein, 17 aa, Neisseria
TDWTNPNADTEWMDAKK

SEQ ID NO: 21512 - protein, 37 aa, Neisseria; identical to SEQ ID NO: 8210

SEQ ID NO: 21513 - protein, 10 aa, Neisseria
RQAEEGPPPL

SEQ ID NO: 21514 - protein, 7 aa, Neisseria
QISDRSV

SEQ ID NO: 21515 - protein, 6 aa, Neisseria
EHNGPK

SEQ ID NO: 21516 - protein, 5 aa, Neisseria
GKPDQ

SEQ ID NO: 21517 - protein, 9 aa, Neisseria
KLPEEPKGI

SEQ ID NO: 21518 - protein, 11 aa, Neisseria
NADTEWMDAKK

SEQ ID NO: 21519 - protein, 6 aa, Neisseria
GAEDAL

SEQ ID NO: 21520 - protein, 16 aa, Neisseria
GNKEQAEKFAKDKGGK

SEQ ID NO: 21521 - protein, 5 aa, Neisseria
DDMPD

SEQ ID NO: 21522 - protein, 10 aa, Neisseria
LPEAVRNLAR

SEQ ID NO: 21523 - protein, 9 aa, Neisseria
EEIIRWLAD

SEQ ID NO: 21524 - protein, 13 aa, Neisseria
ILGQIKDAVRVAQ

SEQ ID NO: 21525 - protein, 9 aa, Neisseria
KKLNALFQK

SEQ ID NO: 21526 - protein, 6 aa, Neisseria
SVAKEV

SEQ ID NO: 21527 - protein, 9 aa, Neisseria
EQIFPDIGD

SEQ ID NO: 21528 - protein, 7 aa, Neisseria
EMIELVA

SEQ ID NO: 21529 - protein, 7 aa, Neisseria
AQELCDK

SEQ ID NO: 21530 - protein, 7 aa, Neisseria
DLPAILH

SEQ ID NO: 21531 - protein, 5 aa, Neisseria
DLNDA

SEQ ID NO: 21532 - protein, 11 aa, Neisseria
VDDMVNIVQSG

SEQ ID NO: 21533 - protein, 10 aa, Neisseria
EKVAEFVRQQ

SEQ ID NO: 21534 - protein, 7 aa, Neisseria
LRDEGEK

SEQ ID NO: 21535 - protein, 13 aa, Neisseria
KQVLENAMKQLAK

SEQ ID NO: 21536 - protein, 15 aa, Neisseria
KLLHSPTQTLNKAGE

SEQ ID NO: 21537 - protein, 7 aa, Neisseria
SIREKLA

SEQ ID NO: 21538 - protein, 12 aa, Neisseria
EAVRNLARSNAA

SEQ ID NO: 21539 - protein, 6 aa, Neisseria
TCNRTE

SEQ ID NO: 21540 - protein, 9 aa, Neisseria
CVGDSEEII

SEQ ID NO: 21541 - protein, 9 aa, Neisseria
PIEEISPYL

SEQ ID NO: 21542 - protein, 5 aa, Neisseria
ETVRH

SEQ ID NO: 21543 - protein, 19 aa, Neisseria
QIKDAVRVAQEQESMGKKL

SEQ ID NO: 21544 - protein, 17 aa, Neisseria
SVAKEVRTDTAVGENSV

SEQ ID NO: 21545 - protein, 6 aa, Neisseria
DIGDLN

SEQ ID NO: 21546 - protein, 5 aa, Neisseria
KSPRL

SEQ ID NO: 21547 - protein, 17 aa, Neisseria
TLARAQELCDKLGVNAE

SEQ ID NO: 21548 - protein, 12 aa, Neisseria
GMVERALKQRQS

SEQ ID NO: 21549 - protein, 15 aa, Neisseria
AVPRDIEAEVGDLND

SEQ ID NO: 21550 - protein, 13 aa, Neisseria
QSGKEARQKAAAA

SEQ ID NO: 21551 - protein, 19 aa, Neisseria
LVSEKVAEFVRQQQGRQSV

SEQ ID NO: 21552 - protein, 15 aa, Neisseria
RALRDEGEKARKQVL

SEQ ID NO: 21553 - protein, 8 aa, Neisseria
ATAEEVLE

SEQ ID NO: 21554 - protein, 24 aa, Neisseria
LTNKLLHSPTQTLNKAGEEDKDLV

SEQ ID NO: 21555 - protein, 7 aa, Neisseria
SIREKLA

SEQ ID NO: 21556 - protein, 12 aa, Neisseria
EAVRNLARSNAA

SEQ ID NO: 21557 - protein, 7 aa, Neisseria
GDSEEII

SEQ ID NO: 21558 - protein, 6 aa, Neisseria
PIEEIS

SEQ ID NO: 21559 - protein, 5 aa, Neisseria
ETVRH

SEQ ID NO: 21560 - protein, 19 aa, Neisseria
QIKDAVRVAQEQESMGKKL

SEQ ID NO: 21561 - protein, 17 aa, Neisseria
SVAKEVRTDTAVGENSV

SEQ ID NO: 21562 - protein, 10 aa, Neisseria
TLARAQELCD

SEQ ID NO: 21563 - protein, 12 aa, Neisseria
GMVERALKQRQS

SEQ ID NO: 21564 - protein, 14 aa, Neisseria
AVPRDIEAEVGDLN

SEQ ID NO: 21565 - protein, 13 aa, Neisseria
QSGKEARQKAAAA

SEQ ID NO: 21566 - protein, 11 aa, Neisseria
LVSEKVAEFVR

SEQ ID NO: 21567 - protein, 6 aa, Neisseria
QQGRQS

SEQ ID NO: 21568 - protein, 15 aa, Neisseria
RALRDEGEKARKQVL

SEQ ID NO: 21569 - protein, 8 aa, Neisseria
ATAEEVLE

SEQ ID NO: 21570 - protein, 13 aa, Neisseria
TLNKAGEEDKDLV

SEQ ID NO: 21571 - protein, 11 aa, Neisseria
LLLGIIGIFLP

SEQ ID NO: 21572 - protein, 7 aa, Neisseria
RFHRWLH

SEQ ID NO: 21573 - protein, 5 aa, Neisseria
PMVHN

SEQ ID NO: 21574 - protein, 9 aa, Neisseria
FPQRWWVGA

SEQ ID NO: 21575 - protein, 10 aa, Neisseria
SSVFCSLVAI

SEQ ID NO: 21576 - protein, 9 aa, Neisseria
KASPRFHRW

SEQ ID NO: 21577 - protein, 9 aa, Neisseria
HRHRYFGPM

SEQ ID NO: 21578 - protein, 12 aa, Neisseria
WEQNGAVPRKAK

SEQ ID NO: 21579 - protein, 5 aa, Neisseria
RRPES

SEQ ID NO: 21580 - protein, 8 aa, Neisseria
GAVPRKAK

SEQ ID NO: 21581 - protein, 5 aa, Neisseria
RRPES

SEQ ID NO: 21582 - protein, 9 aa, Neisseria
SGRIISIAA

SEQ ID NO: 21583 - protein, 10 aa, Neisseria
KMPPEMVYRA

SEQ ID NO: 21584 - protein, 13 aa, Neisseria
RKMKKMTMCTRRV

SEQ ID NO: 21585 - protein, 11 aa, Neisseria
PFKSPQTKMPP

SEQ ID NO: 21586 - protein, 8 aa, Neisseria
ASSSRMKG

SEQ ID NO: 21587 - protein, 16 aa, Neisseria
DAPKTKLNGMRKSNVQ

SEQ ID NO: 21588 - protein, 13 aa, Neisseria
RKMKKMTMCTRRV

SEQ ID NO: 21589 - protein, 8 aa, Neisseria
SPQTKMPP

SEQ ID NO: 21590 - protein, 7 aa, Neisseria
SSSRMKG

SEQ ID NO: 21591 - protein, 16 aa, Neisseria
DAPKTKLNGMRKSNVQ

SEQ ID NO: 21592 - protein, 5 aa, Neisseria
LQNLV

SEQ ID NO: 21593 - protein, 45 aa, Neisseria; identical to SEQ ID NO: 8299

SEQ ID NO: 21594 - protein, 10 aa, Neisseria
GILSAFLDNA

SEQ ID NO: 21595 - protein, 8 aa, Neisseria
FHSLLAVS

SEQ ID NO: 21596 - protein, 17 aa, Neisseria
FMGALTYIGNAPNFMVK

SEQ ID NO: 21597 - protein, 5 aa, Neisseria
TFFGY

SEQ ID NO: 21598 - protein, 10 aa, Neisseria
GLWKPEHPGF

SEQ ID NO: 21599 - protein, 13 aa, Neisseria
TPKQVRAGNEFNF

SEQ ID NO: 21600 - protein, 5 aa, Neisseria
DTAGH

SEQ ID NO: 21601 - protein, 5 aa, Neisseria
AGGDA

SEQ ID NO: 21602 - protein, 9 aa, Neisseria
AIAEQRGVP

SEQ ID NO: 21603 - protein, 7 aa, Neisseria
WKPEHPG

SEQ ID NO: 21604 - protein, 7 aa, Neisseria
KQVRAGN

SEQ ID NO: 21605 - protein, 8 aa, Neisseria
AIAEQRGV

SEQ ID NO: 21606 - protein, 23 aa, Neisseria
CGPPNSCVSMLAAFSDGTSAPAA

SEQ ID NO: 21607 - protein, 7 aa, Neisseria
HTWILRS

SEQ ID NO: 21608 - protein, 10 aa, Neisseria
KPAGCGPPNS

SEQ ID NO: 21609 - protein, 7 aa, Neisseria
FSDGTSA

SEQ ID NO: 21610 - protein, 16 aa, Neisseria
SVKRLNTSKPRLKSSA

SEQ ID NO: 21611 - protein, 8 aa, Neisseria
MANGSAST

SEQ ID NO: 21612 - protein, 23 aa, Neisseria
GRVRSAVHKPDWIRLRRTSSPLK

SEQ ID NO: 21613 - protein, 5 aa, Neisseria
NASGA

SEQ ID NO: 21614 - protein, 16 aa, Neisseria
SVKRLNTSKPRLKSSA

SEQ ID NO: 21615 - protein, 9 aa, Neisseria
GRVRSAVHK

SEQ ID NO: 21616 - protein, 10 aa, Neisseria
DWIRLRRTSS

SEQ ID NO: 21617 - protein, 7 aa, Neisseria
RWSDVFS

SEQ ID NO: 21618 - protein, 8 aa, Neisseria
ISRLPRTF

SEQ ID NO: 21619 - protein, 10 aa, Neisseria
VAALIGMLVF

SEQ ID NO: 21620 - protein, 11 aa, Neisseria
IFGGVVEAVAT

SEQ ID NO: 21621 - protein, 9 aa, Neisseria
MLGVWQQGD

SEQ ID NO: 21622 - protein, 7 aa, Neisseria
GILALFA

SEQ ID NO: 21623 - protein, 7 aa, Neisseria
TILGLGE

SEQ ID NO: 21624 - protein, 17 aa, Neisseria
VVPNIISRLIGDRLRQS

SEQ ID NO: 21625 - protein, 5 aa, Neisseria
IIGRV

SEQ ID NO: 21626 - protein, 6 aa, Neisseria
TVFGVL

SEQ ID NO: 21627 - protein, 6 aa, Neisseria
SLSDSQ

SEQ ID NO: 21628 - protein, 5 aa, Neisseria
RLPRT

SEQ ID NO: 21629 - protein, 13 aa, Neisseria
NRFVEPSMAGAGQ

SEQ ID NO: 21630 - protein, 6 aa, Neisseria
RLPPTA

SEQ ID NO: 21631 - protein, 5 aa, Neisseria
GDFSG

SEQ ID NO: 21632 - protein, 9 aa, Neisseria
LIGDRLRQS

SEQ ID NO: 21633 - protein, 5 aa, Neisseria
RKPAH

SEQ ID NO: 21634 - protein, 8 aa, Neisseria
LIGDRLRQ

SEQ ID NO: 21635 - protein, 5 aa, Neisseria
RKPAH

SEQ ID NO: 21636 - protein, 11 aa, Neisseria
LFPAMFYGMYN

SEQ ID NO: 21637 - protein, 16 aa, Neisseria
PDLLQQSIANDWHYAL

SEQ ID NO: 21638 - protein, 9 aa, Neisseria
GGFWEVLFA

SEQ ID NO: 21639 - protein, 8 aa, Neisseria
FGGTGKNF

SEQ ID NO: 21640 - protein, 14 aa, Neisseria
AVDGYSGATALAQW

SEQ ID NO: 21641 - protein, 8 aa, Neisseria
ADGLKNAI

SEQ ID NO: 21642 - protein, 15 aa, Neisseria
DAFIGKLPGSIGEVS

SEQ ID NO: 21643 - protein, 14 aa, Neisseria
FARIASWRIIAGVM

SEQ ID NO: 21644 - protein, 9 aa, Neisseria
IAMSSLFNF

SEQ ID NO: 21645 - protein, 26 aa, Neisseria
VSASFTNVGKWWYGALIGVMCVLIRV

SEQ ID NO: 21646 - protein, 14 aa, Neisseria
ILFANLFAPIFDYF

SEQ ID NO: 21647 - protein, 8 aa, Neisseria
VRKHEINE

SEQ ID NO: 21648 - protein, 11 aa, Neisseria
EVFGGTGKNFM

SEQ ID NO: 21649 - protein, 9 aa, Neisseria
YPANLSGDA

SEQ ID NO: 21650 - protein, 6 aa, Neisseria
GADGLK

SEQ ID NO: 21651 - protein, 6 aa, Neisseria
LPGSIG

SEQ ID NO: 21652 - protein, 6 aa, Neisseria
GSDTNA

SEQ ID NO: 21653 - protein, 11 aa, Neisseria
NIKRRKARSNG

SEQ ID NO: 21654 - protein, 7 aa, Neisseria
VRKHEIN

SEQ ID NO: 21655 - protein, 11 aa, Neisseria
NIKRRKARSNG

SEQ ID NO: 21656 - protein, 8 aa, Neisseria
LARFVDNV

SEQ ID NO: 21657 - protein, 7 aa, Neisseria
IVDIVEH

SEQ ID NO: 21658 - protein, 11 aa, Neisseria
DIVKHFEPLGK

SEQ ID NO: 21659 - protein, 6 aa, Neisseria
RAGRVP

SEQ ID NO: 21660 - protein, 6 aa, Neisseria
IGRTMQ

SEQ ID NO: 21661 - protein, 13 aa, Neisseria
ERYVRRVYGYGTP

SEQ ID NO: 21662 - protein, 13 aa, Neisseria
PVSFDGCRTVGRP

SEQ ID NO: 21663 - protein, 10 aa, Neisseria
SQFERIARPG

SEQ ID NO: 21664 - protein, 5 aa, Neisseria
GKNAL

SEQ ID NO: 21665 - protein, 5 aa, Neisseria
ADGDI

SEQ ID NO: 21666 - protein, 7 aa, Neisseria
EPLGKHQ

SEQ ID NO: 21667 - protein, 7 aa, Neisseria
VDGETQI

SEQ ID NO: 21668 - protein, 8 aa, Neisseria
AGIGKNAV

SEQ ID NO: 21669 - protein, 14 aa, Neisseria
VADDLRAGRVPNGN

SEQ ID NO: 21670 - protein, 6 aa, Neisseria
QSRVAD

SEQ ID NO: 21671 - protein, 9 aa, Neisseria
MQIDADRII

SEQ ID NO: 21672 - protein, 8 aa, Neisseria
NQGARGSF

SEQ ID NO: 21673 - protein, 6 aa, Neisseria
INTGIH

SEQ ID NO: 21674 - protein, 15 aa, Neisseria
HTGTGNGQVAERYVR

SEQ ID NO: 21675 - protein, 20 aa, Neisseria
VSFDGCRTVGRPFNRNRFVD

SEQ ID NO: 21676 - protein, 17 aa, Neisseria
AGSQFERIARPGAGKCG

SEQ ID NO: 21677 - protein, 5 aa, Neisseria
ADGDI

SEQ ID NO: 21678 - protein, 5 aa, Neisseria
EPLGK

SEQ ID NO: 21679 - protein, 7 aa, Neisseria
VDGETQI

SEQ ID NO: 21680 - protein, 12 aa, Neisseria
VADDLRAGRVPN

SEQ ID NO: 21681 - protein, 5 aa, Neisseria
SRVAD

SEQ ID NO: 21682 - protein, 9 aa, Neisseria
MQIDADRII

SEQ ID NO: 21683 - protein, 8 aa, Neisseria
QVAERYVR

SEQ ID NO: 21684 - protein, 7 aa, Neisseria
DGCRTVG

SEQ ID NO: 21685 - protein, 11 aa, Neisseria
QFERIARPGAG

SEQ ID NO: 21686 - protein, 5 aa, Neisseria
YKNNR

SEQ ID NO: 21687 - protein, 7 aa, Neisseria
LKVFDNI

SEQ ID NO: 21688 - protein, 14 aa, Neisseria
VNYSDIHDNIINKA

SEQ ID NO: 21689 - protein, 5 aa, Neisseria
APVSR

SEQ ID NO: 21690 - protein, 8 aa, Neisseria
QFPAVLPG

SEQ ID NO: 21691 - protein, 8 aa, Neisseria
DGLLKKVE

SEQ ID NO: 21692 - protein, 5 aa, Neisseria
EETAP

SEQ ID NO: 21693 - protein, 8 aa, Neisseria
HNNILDNS

SEQ ID NO: 21694 - protein, 10 aa, Neisseria
AMVRENKIVG

SEQ ID NO: 21695 - protein, 11 aa, Neisseria
ATLRVNERGNG

SEQ ID NO: 21696 - protein, 28 aa, Neisseria
GNDISKGRDGIFSNTSTHNTYKNNRFSD

SEQ ID NO: 21697 - protein, 9 aa, Neisseria
YTNDSEISG

SEQ ID NO: 21698 - protein, 6 aa, Neisseria
ISVGNN

SEQ ID NO: 21699 - protein, 5 aa, Neisseria
ERLKV

SEQ ID NO: 21700 - protein, 8 aa, Neisseria
VGSRDQGI

SEQ ID NO: 21701 - protein, 13 aa, Neisseria
SDIHDNIINKAGK

SEQ ID NO: 21702 - protein, 10 aa, Neisseria
ANYDKLSANH

SEQ ID NO: 21703 - protein, 20 aa, Neisseria
EGTSLHDNSFINNESQVKYV

SEQ ID NO: 21704 - protein, 16 aa, Neisseria
DWSEGGHGNYWSDNSA

SEQ ID NO: 21705 - protein, 17 aa, Neisseria
LNGDGFGDSAYRPNGII

SEQ ID NO: 21706 - protein, 19 aa, Neisseria
GGVVDSKPLMKPYAPKIQT

SEQ ID NO: 21707 - protein, 27 aa, Neisseria
QAMKDGLLKKVETRQLEWGRAENGSLN

SEQ ID NO: 21708 - protein, 10 aa, Neisseria
AMVRENKIVG

SEQ ID NO: 21709 - protein, 10 aa, Neisseria
ATLRVNERGN

SEQ ID NO: 21710 - protein, 9 aa, Neisseria
DISKGRDGI

SEQ ID NO: 21711 - protein, 8 aa, Neisseria
YKNNRFSD

SEQ ID NO: 21712 - protein, 7 aa, Neisseria
NDSEISG

SEQ ID NO: 21713 - protein, 5 aa, Neisseria
ERLKV

SEQ ID NO: 21714 - protein, 6 aa, Neisseria
GSRDQG

SEQ ID NO: 21715 - protein, 6 aa, Neisseria
NYDKLS

SEQ ID NO: 21716 - protein, 8 aa, Neisseria
VVDSKPLM

SEQ ID NO: 21717 - protein, 25 aa, Neisseria
QAMKDGLLKKVETRQLEWGRAENGS

SEQ ID NO: 21718 - protein, 8 aa, Neisseria
SILKSIGI

SEQ ID NO: 21719 - protein, 6 aa, Neisseria
SIKRMS

SEQ ID NO: 21720 - protein, 17 aa, Neisseria
LPAYAERLPDFLAKIQP

SEQ ID NO: 21721 - protein, 5 aa, Neisseria
RYSKP

SEQ ID NO: 21722 - protein, 9 aa, Neisseria
SKPIDTLMA

SEQ ID NO: 21723 - protein, 6 aa, Neisseria
AKLVDH

SEQ ID NO: 21724 - protein, 10 aa, Neisseria
KRMSAFRARI

SEQ ID NO: 21725 - protein, 33 aa, Neisseria
YAERLPDFLAKIQPSEIVPGADRYSKPEGKPMV

SEQ ID NO: 21726 - protein, 8 aa, Neisseria
VYKGDEQL

SEQ ID NO: 21727 - protein, 13 aa, Neisseria
AVNTRGYSSKPID

SEQ ID NO: 21728 - protein, 6 aa, Neisseria
LAKDGT

SEQ ID NO: 21729 - protein, 7 aa, Neisseria
KLVDHHE

SEQ ID NO: 21730 - protein, 10 aa, Neisseria
KRMSAFRARI

SEQ ID NO: 21731 - protein, 6 aa, Neisseria
YAERLP

SEQ ID NO: 21732 - protein, 15 aa, Neisseria
PGADRYSKPEGKPMV

SEQ ID NO: 21733 - protein, 8 aa, Neisseria
VYKGDEQL

SEQ ID NO: 21734 - protein, 6 aa, Neisseria
LAKDGT

SEQ ID NO: 21735 - protein, 7 aa, Neisseria
KLVDHHE

SEQ ID NO: 21736 - protein, 9 aa, Neisseria
CPLSAISAV

SEQ ID NO: 21737 - protein, 8 aa, Neisseria
IKHIVRAF

SEQ ID NO: 21738 - protein, 21 aa, Neisseria
GVSAFKTLRAQEFLQHLRGGV

SEQ ID NO: 21739 - protein, 5 aa, Neisseria
FRGEG

SEQ ID NO: 21740 - protein, 5 aa, Neisseria
DDVRL

SEQ ID NO: 21741 - protein, 16 aa, Neisseria
ADVAVKNLGNLMAAPD

SEQ ID NO: 21742 - protein, 17 aa, Neisseria
VFKGVFHNAVRHADQLQ

SEQ ID NO: 21743 - protein, 8 aa, Neisseria
VDGVTDGA

SEQ ID NO: 21744 - protein, 11 aa, Neisseria
QVDDFGEFAVF

SEQ ID NO: 21745 - protein, 5 aa, Neisseria
FRGVD

SEQ ID NO: 21746 - protein, 17 aa, Neisseria
AELLQWLQHQRAFDAGT

SEQ ID NO: 21747 - protein, 7 aa, Neisseria
ACRRICP

SEQ ID NO: 21748 - protein, 7 aa, Neisseria
VQQEGCG

SEQ ID NO: 21749 - protein, 18 aa, Neisseria
LYEDKESGDDFADKDFLQ

SEQ ID NO: 21750 - protein, 9 aa, Neisseria
VAGDGGKAG

SEQ ID NO: 21751 - protein, 8 aa, Neisseria
FGGGADKL

SEQ ID NO: 21752 - protein, 14 aa, Neisseria
FKNREGADVDSDIA

SEQ ID NO: 21753 - protein, 5 aa, Neisseria
KTLRA

SEQ ID NO: 21754 - protein, 11 aa, Neisseria
FRGEGFDDVRL

SEQ ID NO: 21755 - protein, 11 aa, Neisseria
MGDGCNGRNGM

SEQ ID NO: 21756 - protein, 7 aa, Neisseria
DESDVVA

SEQ ID NO: 21757 - protein, 21 aa, Neisseria
RHADQLQAAADKDVLERAQTG

SEQ ID NO: 21758 - protein, 5 aa, Neisseria
HGGCR

SEQ ID NO: 21759 - protein, 12 aa, Neisseria
FGIDAVDGVTDG

SEQ ID NO: 21760 - protein, 12 aa, Neisseria
CFGDEQQVDDFG

SEQ ID NO: 21761 - protein, 10 aa, Neisseria
FGGNEEEVAL

SEQ ID NO: 21762 - protein, 5 aa, Neisseria
VDVNG

SEQ ID NO: 21763 - protein, 9 aa, Neisseria
FSGNRRAGG

SEQ ID NO: 21764 - protein, 11 aa, Neisseria
RAFDAGTQRNG

SEQ ID NO: 21765 - protein, 6 aa, Neisseria
VMPRNP

SEQ ID NO: 21766 - protein, 6 aa, Neisseria
ACRRIC

SEQ ID NO: 21767 - protein, 17 aa, Neisseria
LYEDKESGDDFADKDFL

SEQ ID NO: 21768 - protein, 5 aa, Neisseria
DGGKA

SEQ ID NO: 21769 - protein, 5 aa, Neisseria
GADKL

SEQ ID NO: 21770 - protein, 13 aa, Neisseria
FKNREGADVDSDI

SEQ ID NO: 21771 - protein, 5 aa, Neisseria
KTLRA

SEQ ID NO: 21772 - protein, 8 aa, Neisseria
EGFDDVRL

SEQ ID NO: 21773 - protein, 8 aa, Neisseria
GCNGRNGM

SEQ ID NO: 21774 - protein, 7 aa, Neisseria
DESDVVA

SEQ ID NO: 21775 - protein, 20 aa, Neisseria
RHADQLQAAADKDVLERAQT

SEQ ID NO: 21776 - protein, 8 aa, Neisseria
AVDGVTDG

SEQ ID NO: 21777 - protein, 12 aa, Neisseria
CFGDEQQVDDFG

SEQ ID NO: 21778 - protein, 8 aa, Neisseria
GNEEEVAL

SEQ ID NO: 21779 - protein, 6 aa, Neisseria
GNRRAG

SEQ ID NO: 21780 - protein, 6 aa, Neisseria
GTQRNG

SEQ ID NO: 21781 - protein, 8 aa, Neisseria
CGRRFDRP

SEQ ID NO: 21782 - protein, 28 aa, Neisseria
MDTAAFLKHIESAFRRIFADGIDLMRYL

SEQ ID NO: 21783 - protein, 12 aa, Neisseria
QFEIQEVLRIAG

SEQ ID NO: 21784 - protein, 8 aa, Neisseria
QPLQEFGD

SEQ ID NO: 21785 - protein, 11 aa, Neisseria
REMQSYYEYTD

SEQ ID NO: 21786 - protein, 5 aa, Neisseria
YWQGN

SEQ ID NO: 21787 - protein, 8 aa, Neisseria
LAKVIDLL

SEQ ID NO: 21788 - protein, 8 aa, Neisseria
AGLRAFQN

SEQ ID NO: 21789 - protein, 10 aa, Neisseria
LENLERYVRN

SEQ ID NO: 21790 - protein, 9 aa, Neisseria
EILYRYVCH

SEQ ID NO: 21791 - protein, 9 aa, Neisseria
VSPVAPVAH

SEQ ID NO: 21792 - protein, 8 aa, Neisseria
ANIVKTLA

SEQ ID NO: 21793 - protein, 5 aa, Neisseria
QMLQK

SEQ ID NO: 21794 - protein, 8 aa, Neisseria
FTIFEGPN

SEQ ID NO: 21795 - protein, 13 aa, Neisseria
MLYAEIYDQFVRA

SEQ ID NO: 21796 - protein, 5 aa, Neisseria
DRLQT

SEQ ID NO: 21797 - protein, 8 aa, Neisseria
LPEDIRSF

SEQ ID NO: 21798 - protein, 7 aa, Neisseria
GKIIARL

SEQ ID NO: 21799 - protein, 11 aa, Neisseria
MPSERSADCCP

SEQ ID NO: 21800 - protein, 41 aa, Neisseria
VKFRKSTLNCGRRFDRPPINGNRQRKPMIHTEPSAQPSTMD

SEQ ID NO: 21801 - protein, 5 aa, Neisseria
IESAF

SEQ ID NO: 21802 - protein, 7 aa, Neisseria
IFADGID

SEQ ID NO: 21803 - protein, 7 aa, Neisseria
LPEDKWL

SEQ ID NO: 21804 - protein, 16 aa, Neisseria
FLDKKYGGRKGSQFEI

SEQ ID NO: 21805 - protein, 5 aa, Neisseria
  VARIANT (1)...(5): Xaa is any amino acid
XXXEG

SEQ ID NO: 21806 - protein, 8 aa, Neisseria
EFGDEAQI

SEQ ID NO: 21807 - protein, 9 aa, Neisseria
VFKGEGGGL

SEQ ID NO: 21808 - protein, 7 aa, Neisseria
TEPETSG

SEQ ID NO: 21809 - protein, 17 aa, Neisseria
AIAREMQSYYEYTDGQT

SEQ ID NO: 21810 - protein, 10 aa, Neisseria
YWQGNSQSDF

SEQ ID NO: 21811 - protein, 11 aa, Neisseria
AKERKNGKLAK

SEQ ID NO: 21812 - protein, 5 aa, Neisseria
KTYIR

SEQ ID NO: 21813 - protein, 9 aa, Neisseria
ETLASEGLR

SEQ ID NO: 21814 - protein, 9 aa, Neisseria
AVNRIDAEM

SEQ ID NO: 21815 - protein, 8 aa, Neisseria
LSQSDAAG

SEQ ID NO: 21816 - protein, 26 aa, Neisseria
NLERYVRNDIRFVDYERREIRRRHQV

SEQ ID NO: 21817 - protein, 11 aa, Neisseria
KGFERGHTAGN

SEQ ID NO: 21818 - protein, 7 aa, Neisseria
EGPNDML

SEQ ID NO: 21819 - protein, 28 aa, Neisseria
ATAEEKEAGMKLDKNQTLLDRLQTDARF

SEQ ID NO: 21820 - protein, 16 aa, Neisseria
AVARDYTLPEDIRSFL

SEQ ID NO: 21821 - protein, 7 aa, Neisseria
AEHEDTA

SEQ ID NO: 21822 - protein, 13 aa, Neisseria
DIRKDILDCRYCG

SEQ ID NO: 21823 - protein, 9 aa, Neisseria
MPSERSADC

SEQ ID NO: 21824 - protein, 28 aa, Neisseria
KFRKSTLNCGRRFDRPPINGNRQRKPMI

SEQ ID NO: 21825 - protein, 5 aa, Neisseria
IESAF

SEQ ID NO: 21826 - protein, 7 aa, Neisseria
LPEDKWL

SEQ ID NO: 21827 - protein, 12 aa, Neisseria
LDKKYGGRKGSQ

SEQ ID NO: 21828 - protein, 8 aa, Neisseria
EFGDEAQI

SEQ ID NO: 21829 - protein, 6 aa, Neisseria
FKGEGG

SEQ ID NO: 21830 - protein, 7 aa, Neisseria
TEPETSG

SEQ ID NO: 21831 - protein, 8 aa, Neisseria
AIAREMQS

SEQ ID NO: 21832 - protein, 11 aa, Neisseria
AKERKNGKLAK

SEQ ID NO: 21833 - protein, 9 aa, Neisseria
AVNRIDAEM

SEQ ID NO: 21834 - protein, 7 aa, Neisseria
SQSDAAG

SEQ ID NO: 21835 - protein, 26 aa, Neisseria
NLERYVRNDIRFVDYERREIRRRHQV

SEQ ID NO: 21836 - protein, 8 aa, Neisseria
KGFERGHT

SEQ ID NO: 21837 - protein, 28 aa, Neisseria
ATAEEKEAGMKLDKNQTLLDRLQTDARF

SEQ ID NO: 21838 - protein, 7 aa, Neisseria
EDIRSFL

SEQ ID NO: 21839 - protein, 7 aa, Neisseria
AEHEDTA

SEQ ID NO: 21840 - protein, 8 aa, Neisseria
DIRKDILD

SEQ ID NO: 21841 - protein, 8 aa, Neisseria
NTLNRCCK

SEQ ID NO: 21842 - protein, 11 aa, Neisseria
RTLPSLNGLTK

SEQ ID NO: 21843 - protein, 9 aa, Neisseria
TPKRCSSSI

SEQ ID NO: 21844 - protein, 11 aa, Neisseria
FLNFMSSCTSL

SEQ ID NO: 21845 - protein, 5 aa, Neisseria
SAKRS

SEQ ID NO: 21846 - protein, 6 aa, Neisseria
SVLPKP

SEQ ID NO: 21847 - protein, 27 aa, Neisseria
EQSNTLNRCCKKSRMTCSSSRSRSCPC

SEQ ID NO: 21848 - protein, 15 aa, Neisseria
PMRASGSRVSSRSRM

SEQ ID NO: 21849 - protein, 24 aa, Neisseria
SLCRKNTCPPRLSSRNTASRTLPS

SEQ ID NO: 21850 - protein, 8 aa, Neisseria
LTARRRLG

SEQ ID NO: 21851 - protein, 10 aa, Neisseria
ISEKSRSPSS

SEQ ID NO: 21852 - protein, 19 aa, Neisseria
TLARRRLSCSFRTPKRCSS

SEQ ID NO: 21853 - protein, 5 aa, Neisseria
SAMPS

SEQ ID NO: 21854 - protein, 7 aa, Neisseria
LKRERLA

SEQ ID NO: 21855 - protein, 10 aa, Neisseria
TGKSAKRSAK

SEQ ID NO: 21856 - protein, 9 aa, Neisseria
CSTRSVVGA

SEQ ID NO: 21857 - protein, 7 aa, Neisseria
NAARRAT

SEQ ID NO: 21858 - protein, 14 aa, Neisseria
VLPKPTSPHTRRSI

SEQ ID NO: 21859 - protein, 5 aa, Neisseria
QSNTL

SEQ ID NO: 21860 - protein, 19 aa, Neisseria
RCCKKSRMTCSSSRSRSCP

SEQ ID NO: 21861 - protein, 14 aa, Neisseria
MRASGSRVSSRSRM

SEQ ID NO: 21862 - protein, 20 aa, Neisseria
LCRKNTCPPRLSSRNTASRT

SEQ ID NO: 21863 - protein, 8 aa, Neisseria
LTARRRLG

SEQ ID NO: 21864 - protein, 9 aa, Neisseria
ISEKSRSPS

SEQ ID NO: 21865 - protein, 9 aa, Neisseria
TLARRRLSC

SEQ ID NO: 21866 - protein, 7 aa, Neisseria
RTPKRCS

SEQ ID NO: 21867 - protein, 7 aa, Neisseria
LKRERLA

SEQ ID NO: 21868 - protein, 8 aa, Neisseria
KSAKRSAK

SEQ ID NO: 21869 - protein, 7 aa, Neisseria
NAARRAT

SEQ ID NO: 21870 - protein, 10 aa, Neisseria
PTSPHTRRSI

SEQ ID NO: 21871 - protein, 10 aa, Neisseria
GKVCRCFEQV

SEQ ID NO: 21872 - protein, 13 aa, Neisseria
TVFRQIIRIVDHA

SEQ ID NO: 21873 - protein, 8 aa, Neisseria
GLVKERAR

SEQ ID NO: 21874 - protein, 6 aa, Neisseria
KVCRCF

SEQ ID NO: 21875 - protein, 10 aa, Neisseria
GTVGQTERGA

SEQ ID NO: 21876 - protein, 17 aa, Neisseria
DHADTERTAAHSGGTRG

SEQ ID NO: 21877 - protein, 8 aa, Neisseria
GLVKERAR

SEQ ID NO: 21878 - protein, 5 aa, Neisseria
VCRCF

SEQ ID NO: 21879 - protein, 8 aa, Neisseria
VGQTERGA

SEQ ID NO: 21880 - protein, 10 aa, Neisseria
DHADTERTAA

SEQ ID NO: 21881 - protein, 7 aa, Neisseria
RIERAVR

SEQ ID NO: 21882 - protein, 9 aa, Neisseria
AVIDVLNVD

SEQ ID NO: 21883 - protein, 8 aa, Neisseria
ALADIRVL

SEQ ID NO: 21884 - protein, 14 aa, Neisseria
AVDLHAVIKLTDTV

SEQ ID NO: 21885 - protein, 6 aa, Neisseria
QGVEQG

SEQ ID NO: 21886 - protein, 5 aa, Neisseria
FKEGN

SEQ ID NO: 21887 - protein, 9 aa, Neisseria
ARTLGNVFH

SEQ ID NO: 21888 - protein, 17 aa, Neisseria
GSGVDGIQAVVAFDQYA

SEQ ID NO: 21889 - protein, 13 aa, Neisseria
MNRRNARIERAVR

SEQ ID NO: 21890 - protein, 24 aa, Neisseria
DAPGSGTLLHQRGKQVGSRNDALA

SEQ ID NO: 21891 - protein, 18 aa, Neisseria
GKKRFVQSRNLVGRKQRN

SEQ ID NO: 21892 - protein, 10 aa, Neisseria
MPQGVEQGCR

SEQ ID NO: 21893 - protein, 16 aa, Neisseria
RTGFDCRLKHFKEGNA

SEQ ID NO: 21894 - protein, 13 aa, Neisseria
SADTSGIDADART

SEQ ID NO: 21895 - protein, 9 aa, Neisseria
NRAGSGVDG

SEQ ID NO: 21896 - protein, 13 aa, Neisseria
MNRRNARIERAVR

SEQ ID NO: 21897 - protein, 14 aa, Neisseria
QRGKQVGSRNDALA

SEQ ID NO: 21898 - protein, 7 aa, Neisseria
GKKRFVQ

SEQ ID NO: 21899 - protein, 9 aa, Neisseria
NLVGRKQRN

SEQ ID NO: 21900 - protein, 8 aa, Neisseria
QGVEQGCR

SEQ ID NO: 21901 - protein, 15 aa, Neisseria
TGFDCRLKHFKEGNA

SEQ ID NO: 21902 - protein, 13 aa, Neisseria
SADTSGIDADART

SEQ ID NO: 21903 - protein, 8 aa, Neisseria
LSAILGLV

SEQ ID NO: 21904 - protein, 10 aa, Neisseria
RDTKHIRKAN

SEQ ID NO: 21905 - protein, 5 aa, Neisseria
SQGNV

SEQ ID NO: 21906 - protein, 6 aa, Neisseria
ELRENK

SEQ ID NO: 21907 - protein, 7 aa, Neisseria
RKAFRSL

SEQ ID NO: 21908 - protein, 18 aa, Neisseria
GTSEPAHRDTKHIRKANK

SEQ ID NO: 21909 - protein, 14 aa, Neisseria
LHPECRKYLERRAA

SEQ ID NO: 21910 - protein, 31 aa, Neisseria
RSQGNVQELRENKKARKAFRSLPYKEQKTQC

SEQ ID NO: 21911 - protein, 12 aa, Neisseria
AFDDFDGSRFRR

SEQ ID NO: 21912 - protein, 18 aa, Neisseria
GTSEPAHRDTKHIRKANK

SEQ ID NO: 21913 - protein, 12 aa, Neisseria
PECRKYLERRAA

SEQ ID NO: 21914 - protein, 17 aa, Neisseria
GNVQELRENKKARKAFR

SEQ ID NO: 21915 - protein, 9 aa, Neisseria
PYKEQKTQC

SEQ ID NO: 21916 - protein, 12 aa, Neisseria
AFDDFDGSRFRR

SEQ ID NO: 21917 - protein, 5 aa, Neisseria
SVCPG

SEQ ID NO: 21918 - protein, 7 aa, Neisseria
LWSELRQ

SEQ ID NO: 21919 - protein, 8 aa, Neisseria
PELVRRHE

SEQ ID NO: 21920 - protein, 6 aa, Neisseria
FNRVIN

SEQ ID NO: 21921 - protein, 5 aa, Neisseria
SGLWQ

SEQ ID NO: 21922 - protein, 14 aa, Neisseria
NYLQYLYGLFGDWP

SEQ ID NO: 21923 - protein, 10 aa, Neisseria
NVGRAINRAR

SEQ ID NO: 21924 - protein, 7 aa, Neisseria
LRMPNET

SEQ ID NO: 21925 - protein, 12 aa, Neisseria
EAIARLAGITQS

SEQ ID NO: 21926 - protein, 9 aa, Neisseria
SNYLNAAPD

SEQ ID NO: 21927 - protein, 7 aa, Neisseria
ISTATGM

SEQ ID NO: 21928 - protein, 10 aa, Neisseria
IADIKRLNNL

SEQ ID NO: 21929 - protein, 8 aa, Neisseria
KTLQTASE

SEQ ID NO: 21930 - protein, 5 aa, Neisseria
  VARIANT 4: Xaa is any amino acid
VRTXT

SEQ ID NO: 21931 - protein, 5 aa, Neisseria
MSKLK

SEQ ID NO: 21932 - protein, 6 aa, Neisseria
QNTSSH

SEQ ID NO: 21933 - protein, 15 aa, Neisseria
LNSSILDLPPTKQYF

SEQ ID NO: 21934 - protein, 25 aa, Neisseria
SELRQGFRMGEVNPELVRRHESKFI

SEQ ID NO: 21935 - protein, 8 aa, Neisseria
VINRSRPY

SEQ ID NO: 21936 - protein, 10 aa, Neisseria
NEVKKRNMPA

SEQ ID NO: 21937 - protein, 11 aa, Neisseria
TKAKSHVGASG

SEQ ID NO: 21938 - protein, 20 aa, Neisseria
ATGRHYGLEKTPVYDGRHDI

SEQ ID NO: 21939 - protein, 37 aa, Neisseria; identical to SEQ ID NO: 8661

SEQ ID NO: 21940 - protein, 10 aa, Neisseria
NISDIDNKPY

SEQ ID NO: 21941 - protein, 14 aa, Neisseria
AVEPDRPLDNEAIA

SEQ ID NO: 21942 - protein, 9 aa, Neisseria
FIPKSKRKL

SEQ ID NO: 21943 - protein, 6 aa, Neisseria
NAAPDS

SEQ ID NO: 21944 - protein, 12 aa, Neisseria
PAAKTSLSDIST

SEQ ID NO: 21945 - protein, 11 aa, Neisseria
ADIKRLNNLNG

SEQ ID NO: 21946 - protein, 13 aa, Neisseria
LVAKNGKTLQTAS

SEQ ID NO: 21947 - protein, 18 aa, Neisseria
IDIDNTPNTYRSNMPAGT

SEQ ID NO: 21948 - protein, 7 aa, Neisseria
ARIRPAA

SEQ ID NO: 21949 - protein, 17 aa, Neisseria
  VARIANT 9: Xaa is any amino acid
LPQKTVRTXTRSPCPYC

SEQ ID NO: 21950 - protein, 20 aa, Neisseria
TCPCDSRSATSNRKTDRHAV

SEQ ID NO: 21951 - protein, 5 aa, Neisseria
MSKLK

SEQ ID NO: 21952 - protein, 22 aa, Neisseria
LRQGFRMGEVNPELVRRHESKF

SEQ ID NO: 21953 - protein, 7 aa, Neisseria
VINRSRP

SEQ ID NO: 21954 - protein, 10 aa, Neisseria
NEVKKRNMPA

SEQ ID NO: 21955 - protein, 7 aa, Neisseria
TKAKSHV

SEQ ID NO: 21956 - protein, 15 aa, Neisseria
YGLEKTPVYDGRHDI

SEQ ID NO: 21957 - protein, 10 aa, Neisseria
AINRARAQGL

SEQ ID NO: 21958 - protein, 16 aa, Neisseria
PTYENLRMPNETRNYV

SEQ ID NO: 21959 - protein, 5 aa, Neisseria
SDIDN

SEQ ID NO: 21960 - protein, 13 aa, Neisseria
VEPDRPLDNEAIA

SEQ ID NO: 21961 - protein, 7 aa, Neisseria
PKSKRKL

SEQ ID NO: 21962 - protein, 5 aa, Neisseria
AKTSL

SEQ ID NO: 21963 - protein, 7 aa, Neisseria
ADIKRLN

SEQ ID NO: 21964 - protein, 10 aa, Neisseria
KNGKTLQTAS

SEQ ID NO: 21965 - protein, 9 aa, Neisseria
DIDNTPNTY

SEQ ID NO: 21966 - protein, 5 aa, Neisseria
ARIRP

SEQ ID NO: 21967 - protein, 9 aa, Neisseria
  VARIANT 6: Xaa is any amino acid
KTVRTXTRS

SEQ ID NO: 21968 - protein, 19 aa, Neisseria
CPCDSRSATSNRKTDRHAV

SEQ ID NO: 21969 - protein, 5 aa, Neisseria
DIFAR

SEQ ID NO: 21970 - protein, 5 aa, Neisseria
RDGDK

SEQ ID NO: 21971 - protein, 17 aa, Neisseria
KGVLKAVEHVNNQIAQA

SEQ ID NO: 21972 - protein, 10 aa, Neisseria
LYRYLGGAGP

SEQ ID NO: 21973 - protein, 5 aa, Neisseria
VINGG

SEQ ID NO: 21974 - protein, 9 aa, Neisseria
KSFREALRC

SEQ ID NO: 21975 - protein, 8 aa, Neisseria
EIFHALKK

SEQ ID NO: 21976 - protein, 12 aa, Neisseria
AEFAEYLEGLVN

SEQ ID NO: 21977 - protein, 8 aa, Neisseria
AEGIEKGV

SEQ ID NO: 21978 - protein, 18 aa, Neisseria
VNQIGTLSETLKAVDLAK

SEQ ID NO: 21979 - protein, 5 aa, Neisseria
DLAVA

SEQ ID NO: 21980 - protein, 26 aa, Neisseria
SLSRSDRMAKYNQLLRIEELAEAADY

SEQ ID NO: 21981 - protein, 12 aa, Neisseria
EILDSRGNPTVE

SEQ ID NO: 21982 - protein, 37 aa, Neisseria; identical to SEQ ID NO: 8723

SEQ ID NO: 21983 - protein, 7 aa, Neisseria
DANEQSY

SEQ ID NO: 21984 - protein, 11 aa, Neisseria
LDGTENKGNLG

SEQ ID NO: 21985 - protein, 9 aa, Neisseria
AAAEDSGLP

SEQ ID NO: 21986 - protein, 6 aa, Neisseria
GGAGPM

SEQ ID NO: 21987 - protein, 10 aa, Neisseria
NGGEHANNSN

SEQ ID NO: 21988 - protein, 11 aa, Neisseria
KSFREALRCGA

SEQ ID NO: 21989 - protein, 19 aa, Neisseria
KKLCDSKGFPTTVGDEGGF

SEQ ID NO: 21990 - protein, 9 aa, Neisseria
NLNSHKEAL

SEQ ID NO: 21991 - protein, 23 aa, Neisseria
CASSEFYKDGKYHLEAEGRSYTN

SEQ ID NO: 21992 - protein, 13 aa, Neisseria
SIEDGMDENDWEG

SEQ ID NO: 21993 - protein, 8 aa, Neisseria
LTEKLGGK

SEQ ID NO: 21994 - protein, 6 aa, Neisseria
LVGDDL

SEQ ID NO: 21995 - protein, 13 aa, Neisseria
NPKILAEGIEKGV

SEQ ID NO: 21996 - protein, 9 aa, Neisseria
DLAKRNRYA

SEQ ID NO: 21997 - protein, 13 aa, Neisseria
MSHRSGETEDSTI

SEQ ID NO: 21998 - protein, 13 aa, Neisseria
KTGSLSRSDRMAK

SEQ ID NO: 21999 - protein, 16 aa, Neisseria
LRIEEELAEAADYPSK

SEQ ID NO: 22000 - protein, 12 aa, Neisseria
EILDSRGNPTVE

SEQ ID NO: 22001 - protein, 19 aa, Neisseria
TGQKEALELRDGDKSRYSG

SEQ ID NO: 22002 - protein, 7 aa, Neisseria
GVLKAVE

SEQ ID NO: 22003 - protein, 10 aa, Neisseria
LDGTENKGNL

SEQ ID NO: 22004 - protein, 7 aa, Neisseria
AAAEDSG

SEQ ID NO: 22005 - protein, 5 aa, Neisseria
GEHAN

SEQ ID NO: 22006 - protein, 11 aa, Neisseria
KSFREALRCGA

SEQ ID NO: 22007 - protein, 8 aa, Neisseria
KKLCDSKG

SEQ ID NO: 22008 - protein, 7 aa, Neisseria
VGDEGGF

SEQ ID NO: 22009 - protein, 7 aa, Neisseria
NSHKEAL

SEQ ID NO: 22010 - protein, 18 aa, Neisseria
EFYKDGKYHLEAEGRSYT

SEQ ID NO: 22011 - protein, 13 aa, Neisseria
SIEDGMDENDWEG

SEQ ID NO: 22012 - protein, 7 aa, Neisseria
LTEKLGG

SEQ ID NO: 22013 - protein, 10 aa, Neisseria
ILAEGIEKGV

SEQ ID NO: 22014 - protein, 8 aa, Neisseria
DLAKRNRY

SEQ ID NO: 22015 - protein, 12 aa, Neisseria
SHRSGETEDSTI

SEQ ID NO: 22016 - protein, 10 aa, Neisseria
SLSRSDRMAK

SEQ ID NO: 22017 - protein, 15 aa, Neisseria
LRIEEELAEAADYPS

SEQ ID NO: 22018 - protein, 13 aa, Neisseria
MRMPEVTKGFSGS

SEQ ID NO: 22019 - protein, 8 aa, Neisseria
TMRKPRLT

SEQ ID NO: 22020 - protein, 8 aa, Neisseria
ALIFTCFA

SEQ ID NO: 22021 - protein, 9 aa, Neisseria
TALAAITCI

SEQ ID NO: 22022 - protein, 8 aa, Neisseria
LGKMEEFN

SEQ ID NO: 22023 - protein, 15 aa, Neisseria
EPMRMPEVTKGFSGS

SEQ ID NO: 22024 - protein, 8 aa, Neisseria
GCRSTRKT

SEQ ID NO: 22025 - protein, 16 aa, Neisseria
VRPETMRKPRLTNSSA

SEQ ID NO: 22026 - protein, 6 aa, Neisseria
NSGCNA

SEQ ID NO: 22027 - protein, 14 aa, Neisseria
CISGPPCRLGKMEE

SEQ ID NO: 22028 - protein, 14 aa, Neisseria
SRHKITPPRGPRRV

SEQ ID NO: 22029 - protein, 8 aa, Neisseria
TKSQNGTG

SEQ ID NO: 22030 - protein, 10 aa, Neisseria
GYSPPATRPA

SEQ ID NO: 22031 - protein, 10 aa, Neisseria
EPMRMPEVTK

SEQ ID NO: 22032 - protein, 6 aa, Neisseria
RSTRKT

SEQ ID NO: 22033 - protein, 12 aa, Neisseria
RPETMRKPRLTN

SEQ ID NO: 22034 - protein, 10 aa, Neisseria
PPCRLGKMEE

SEQ ID NO: 22035 - protein, 11 aa, Neisseria
RHKITPPRGPR

SEQ ID NO: 22036 - protein, 6 aa, Neisseria
PATRPA

SEQ ID NO: 22037 - protein, 9 aa, Neisseria
MARTLGAPE

SEQ ID NO: 22038 - protein, 5 aa, Neisseria
RRPST

SEQ ID NO: 22039 - protein, 8 aa, Neisseria
LASLNKSC

SEQ ID NO: 22040 - protein, 5 aa, Neisseria
GSTSS

SEQ ID NO: 22041 - protein, 13 aa, Neisseria
GAPESVPAGKVAA

SEQ ID NO: 22042 - protein, 9 aa, Neisseria
SFRRPSTLE

SEQ ID NO: 22043 - protein, 11 aa, Neisseria
RPTSLRPKSIN

SEQ ID NO: 22044 - protein, 23 aa, Neisseria
SLNKSCSLARSSAGVLPRRRVPA

SEQ ID NO: 22045 - protein, 25 aa, Neisseria
TMTSSRSRRTRISGEEPTMWKSPKS

SEQ ID NO: 22046 - protein, 7 aa, Neisseria
SFRRPST

SEQ ID NO: 22047 - protein, 7 aa, Neisseria
TSLRPKS

SEQ ID NO: 22048 - protein, 7 aa, Neisseria
CSLARSS

SEQ ID NO: 22049 - protein, 8 aa, Neisseria
LPRRRVPA

SEQ ID NO: 22050 - protein, 18 aa, Neisseria
MTSSRSRRTRISGEEPTM

SEQ ID NO: 22051 - protein, 5 aa, Neisseria
KSPKS

SEQ ID NO: 22052 - protein, 5 aa, Neisseria
PAMLG

SEQ ID NO: 22053 - protein, 6 aa, Neisseria
LGRMFT

SEQ ID NO: 22054 - protein, 11 aa, Neisseria
TALEELAKCAA

SEQ ID NO: 22055 - protein, 6 aa, Neisseria
MRFLAK

SEQ ID NO: 22056 - protein, 8 aa, Neisseria
FLPGILKT

SEQ ID NO: 22057 - protein, 8 aa, Neisseria
KTVDELKA

SEQ ID NO: 22058 - protein, 8 aa, Neisseria
CVLEKMVD

SEQ ID NO: 22059 - protein, 9 aa, Neisseria
QTFDPAENI

SEQ ID NO: 22060 - protein, 20 aa, Neisseria
QQARQMAQRLADELNYVGVL

SEQ ID NO: 22061 - protein, 8 aa, Neisseria
HTVDACAA

SEQ ID NO: 22062 - protein, 5 aa, Neisseria
NILGD

SEQ ID NO: 22063 - protein, 6 aa, Neisseria
MKNISL

SEQ ID NO: 22064 - protein, 7 aa, Neisseria
GGGQLGR

SEQ ID NO: 22065 - protein, 9 aa, Neisseria
VLDPNPNAP

SEQ ID NO: 22066 - protein, 13 aa, Neisseria
PFDNQTALEELAK

SEQ ID NO: 22067 - protein, 10 aa, Neisseria
TEFENVNADA

SEQ ID NO: 22068 - protein, 9 aa, Neisseria
HTNVSPSGD

SEQ ID NO: 22069 - protein, 9 aa, Neisseria
NRIQEKAWI

SEQ ID NO: 22070 - protein, 11 aa, Neisseria
CKAEDITEESI

SEQ ID NO: 22071 - protein, 31 aa, Neisseria
LGYDGKGQIRVKTVDELKAAFAEHRGVDCVL

SEQ ID NO: 22072 - protein, 9 aa, Neisseria
KMVDLRGEI

SEQ ID NO: 22073 - protein, 20 aa, Neisseria
RLNNDNVQTFDPAENIHENG

SEQ ID NO: 22074 - protein, 9 aa, Neisseria
IQQQARQMA

SEQ ID NO: 22075 - protein, 11 aa, Neisseria
IAPRPHNSGHH

SEQ ID NO: 22076 - protein, 6 aa, Neisseria
QFQQQV

SEQ ID NO: 22077 - protein, 9 aa, Neisseria
PPADTKLLS

SEQ ID NO: 22078 - protein, 11 aa, Neisseria
VWQEDGGEPDW

SEQ ID NO: 22079 - protein, 9 aa, Neisseria
PLQSRPDAH

SEQ ID NO: 22080 - protein, 12 aa, Neisseria
GKKTAHKGRKMG

SEQ ID NO: 22081 - protein, 16 aa, Neisseria
LSTDSDTAFQEAKKLH

SEQ ID NO: 22082 - protein, 8 aa, Neisseria
TALEELAK

SEQ ID NO: 22083 - protein, 7 aa, Neisseria
TEFENVN

SEQ ID NO: 22084 - protein, 11 aa, Neisseria
CKAEDITEESI

SEQ ID NO: 22085 - protein, 29 aa, Neisseria
YDGKGQIRVKTVDELKAAFAEHRGVDCVL

SEQ ID NO: 22086 - protein, 9 aa, Neisseria
KMVDLRGEI

SEQ ID NO: 22087 - protein, 5 aa, Neisseria
LNNDN

SEQ ID NO: 22088 - protein, 7 aa, Neisseria
DPAENIH

SEQ ID NO: 22089 - protein, 9 aa, Neisseria
IQQQARQMA

SEQ ID NO: 22090 - protein, 7 aa, Neisseria
IAPRPHN

SEQ ID NO: 22091 - protein, 6 aa, Neisseria
PADTKL

SEQ ID NO: 22092 - protein, 9 aa, Neisseria
WQEDGGEPD

SEQ ID NO: 22093 - protein, 5 aa, Neisseria
SRPDA

SEQ ID NO: 22094 - protein, 12 aa, Neisseria
GKKTAHKGRKMG

SEQ ID NO: 22095 - protein, 14 aa, Neisseria
TDSDTAFQEAKKLH

SEQ ID NO: 22096 - protein, 23 aa, Neisseria
RQYADVVQFIGQTLRHLSRLLLN

SEQ ID NO: 22097 - protein, 5 aa, Neisseria
WDDGV

SEQ ID NO: 22098 - protein, 9 aa, Neisseria
VNVFGRIES

SEQ ID NO: 22099 - protein, 12 aa, Neisseria
QVHHFFQNAIHA

SEQ ID NO: 22100 - protein, 12 aa, Neisseria
IAQCSGFQDAGQ

SEQ ID NO: 22101 - protein, 8 aa, Neisseria
AFFSDVFG

SEQ ID NO: 22102 - protein, 21 aa, Neisseria
VRTRRDFVDDQFMRVADNKHF

SEQ ID NO: 22103 - protein, 12 aa, Neisseria
SGWDDGVGEDTV

SEQ ID NO: 22104 - protein, 5 aa, Neisseria
GRIES

SEQ ID NO: 22105 - protein, 7 aa, Neisseria
TAYDNGN

SEQ ID NO: 22106 - protein, 6 aa, Neisseria
FGKRGF

SEQ ID NO: 22107 - protein, 10 aa, Neisseria
CSGFQDAGQK

SEQ ID NO: 22108 - protein, 7 aa, Neisseria
LIRRGLQ

SEQ ID NO: 22109 - protein, 7 aa, Neisseria
VLRDGNA

SEQ ID NO: 22110 - protein, 10 aa, Neisseria
MFGEKTHRIG

SEQ ID NO: 22111 - protein, 9 aa, Neisseria
FELGRNSRT

SEQ ID NO: 22112 - protein, 11 aa, Neisseria
QSGLVVKRRTQ

SEQ ID NO: 22113 - protein, 7 aa, Neisseria
GKFRCRR

SEQ ID NO: 22114 - protein, 9 aa, Neisseria
FGSNSKHSA

SEQ ID NO: 22115 - protein, 9 aa, Neisseria
VRTRRDFVD

SEQ ID NO: 22116 - protein, 11 aa, Neisseria
QFMRVADNKHF

SEQ ID NO: 22117 - protein, 11 aa, Neisseria
GWDDGVGEDTV

SEQ ID NO: 22118 - protein, 5 aa, Neisseria
GRIES

SEQ ID NO: 22119 - protein, 5 aa, Neisseria
QDAGQ

SEQ ID NO: 22120 - protein, 7 aa, Neisseria
VLRDGNA

SEQ ID NO: 22121 - protein, 9 aa, Neisseria
FGEKTHRIG

SEQ ID NO: 22122 - protein, 7 aa, Neisseria
ELGRNSR

SEQ ID NO: 22123 - protein, 7 aa, Neisseria
VVKRRTQ

SEQ ID NO: 22124 - protein, 10 aa, Neisseria
GKFRCRRIRV

SEQ ID NO: 22125 - protein, 7 aa, Neisseria
SNSKHSA

SEQ ID NO: 22126 - protein, 17 aa, Neisseria
GITDKPFRRLCRDFGAG

SEQ ID NO: 22127 - protein, 6 aa, Neisseria
AVCEML

SEQ ID NO: 22128 - protein, 9 aa, Neisseria
DPQQMADAA

SEQ ID NO: 22129 - protein, 9 aa, Neisseria
AAILEAVVK

SEQ ID NO: 22130 - protein, 8 aa, Neisseria
PVIAKIAE

SEQ ID NO: 22131 - protein, 6 aa, Neisseria
YDRARR

SEQ ID NO: 22132 - protein, 11 aa, Neisseria
PRFETLRRTRC

SEQ ID NO: 22133 - protein, 15 aa, Neisseria
ACLEFGRMYRHYFEP

SEQ ID NO: 22134 - protein, 7 aa, Neisseria
ARVLRRH

SEQ ID NO: 22135 - protein, 16 aa, Neisseria
ITDKPFRRLCRDFGAG

SEQ ID NO: 22136 - protein, 24 aa, Neisseria
LTSDPTLRNTRKTLHRSDFADEGG

SEQ ID NO: 22137 - protein, 13 aa, Neisseria
AGSDPQQMADAAR

SEQ ID NO: 22138 - protein, 10 aa, Neisseria
NMGCPAKKVC

SEQ ID NO: 22139 - protein, 9 aa, Neisseria
GWHDDHQNL

SEQ ID NO: 22140 - protein, 6 aa, Neisseria
IAEDCG

SEQ ID NO: 22141 - protein, 6 aa, Neisseria
  VARIANT 1: Xaa is any amino acid
XPRTHA

SEQ ID NO: 22142 - protein, 55 aa, Neisseria
NVQRRSGLRPDCRNQMPSEHPGLGQRRHYLAAKSPSRPQTNRRRRHYDRARRARQ

SEQ ID NO: 22143 - protein, 12 aa, Neisseria
PRFETLRRTRCF

SEQ ID NO: 22144 - protein, 43 aa, Neisseria
YRHYFEPHPSHARVLRRHRRCAHRTQTHRLVHRRNARRRTDTS

SEQ ID NO: 22145 - protein, 13 aa, Neisseria
ITDKPFRRLCRDF

SEQ ID NO: 22146 - protein, 20 aa, Neisseria
PTLRNTRKTLHRSDFADEGG

SEQ ID NO: 22147 - protein, 12 aa, Neisseria
GSDPQQMADAAR

SEQ ID NO: 22148 - protein, 7 aa, Neisseria
CPAKKVC

SEQ ID NO: 22149 - protein, 6 aa, Neisseria
IAEDCG

SEQ ID NO: 22150 - protein, 30 aa, Neisseria
NVQRRSGLRPDCRNQMPSEHPGLGQRRHYL

SEQ ID NO: 22151 - protein, 23 aa, Neisseria
KSPSRPQTNRRRRHYDRARRARQ

SEQ ID NO: 22152 - protein, 8 aa, Neisseria
ETLRRTRC

SEQ ID NO: 22153 - protein, 15 aa, Neisseria
RVLRRHRRCAHRTQT

SEQ ID NO: 22154 - protein, 14 aa, Neisseria
LVHRRNARRRTDTS

SEQ ID NO: 22155 - protein, 17 aa, Neisseria
PFALLHKLADLTGLLAY

SEQ ID NO: 22156 - protein, 10 aa, Neisseria
KQHFKHMAKL

SEQ ID NO: 22157 - protein, 9 aa, Neisseria
AGRLKSLVR

SEQ ID NO: 22158 - protein, 12 aa, Neisseria
EGLRALVKQFRK

SEQ ID NO: 22159 - protein, 13 aa, Neisseria
TITGLSRIAALAN

SEQ ID NO: 22160 - protein, 5 aa, Neisseria
PAWES

SEQ ID NO: 22161 - protein, 14 aa, Neisseria
QRMNRFIEERVREH

SEQ ID NO: 22162 - protein, 9 aa, Neisseria
VKPRRRIGE

SEQ ID NO: 22163 - protein, 10 aa, Neisseria
WDGKKRKTVL

SEQ ID NO: 22164 - protein, 6 aa, Neisseria
AGRLKS

SEQ ID NO: 22165 - protein, 10 aa, Neisseria
VRYRNKHYLD

SEQ ID NO: 22166 - protein, 7 aa, Neisseria
ALAAGEK

SEQ ID NO: 22167 - protein, 10 aa, Neisseria
YSHQKNKILD

SEQ ID NO: 22168 - protein, 9 aa, Neisseria
QILKGRNRY

SEQ ID NO: 22169 - protein, 8 aa, Neisseria
RTEGLRAL

SEQ ID NO: 22170 - protein, 8 aa, Neisseria
KQFRKSSA

SEQ ID NO: 22171 - protein, 11 aa, Neisseria
PDQDFGRNDSV

SEQ ID NO: 22172 - protein, 8 aa, Neisseria
PVREADNT

SEQ ID NO: 22173 - protein, 31 aa, Neisseria
PAWESFPSEDAQADAQRMNRFIEERVREHPE

SEQ ID NO: 22174 - protein, 14 aa, Neisseria
KRFKTRPEGSPDFY

SEQ ID NO: 22175 - protein, 8 aa, Neisseria
KPRRRIGE

SEQ ID NO: 22176 - protein, 10 aa, Neisseria
WDGKKRKTVL

SEQ ID NO: 22177 - protein, 5 aa, Neisseria
GRLKS

SEQ ID NO: 22178 - protein, 5 aa, Neisseria
VRYRN

SEQ ID NO: 22179 - protein, 7 aa, Neisseria
ALAAGEK

SEQ ID NO: 22180 - protein, 7 aa, Neisseria
QKNKILD

SEQ ID NO: 22181 - protein, 9 aa, Neisseria
QILKGRNRY

SEQ ID NO: 22182 - protein, 8 aa, Neisseria
RTEGLRAL

SEQ ID NO: 22183 - protein, 6 aa, Neisseria
QFRKSS

SEQ ID NO: 22184 - protein, 9 aa, Neisseria
QDFGRNDSV

SEQ ID NO: 22185 - protein, 7 aa, Neisseria
PVREADN

SEQ ID NO: 22186 - protein, 26 aa, Neisseria
FPSEDAQADAQRMNRFIEERVREHPE

SEQ ID NO: 22187 - protein, 11 aa, Neisseria
KRFKTRPEGSP

SEQ ID NO: 22188 - protein, 5 aa, Neisseria
AHRMC

SEQ ID NO: 22189 - protein, 12 aa, Neisseria
ADVFDTAHGAAG

SEQ ID NO: 22190 - protein, 7 aa, Neisseria
ARPVVEI

SEQ ID NO: 22191 - protein, 10 aa, Neisseria
SGGAHRMCGR

SEQ ID NO: 22192 - protein, 8 aa, Neisseria
DVFDTAHG

SEQ ID NO: 22193 - protein, 8 aa, Neisseria
FLQRKLEP

SEQ ID NO: 22194 - protein, 18 aa, Neisseria
IGGGTAVGKDELGVKDVQ

SEQ ID NO: 22195 - protein, 8 aa, Neisseria
AHGDDHEN

SEQ ID NO: 22196 - protein, 9 aa, Neisseria
AIPRQSRPW

SEQ ID NO: 22197 - protein, 9 aa, Neisseria
PLRWCKTRF

SEQ ID NO: 22198 - protein, 7 aa, Neisseria
LQRKLEP

SEQ ID NO: 22199 - protein, 13 aa, Neisseria
AVGKDELGVKDVQ

SEQ ID NO: 22200 - protein, 8 aa, Neisseria
AHGDDHEN

SEQ ID NO: 22201 - protein, 5 aa, Neisseria
PRQSR

SEQ ID NO: 22202 - protein, 7 aa, Neisseria
HYLKDYQ

SEQ ID NO: 22203 - protein, 5 aa, Neisseria
LYASA

SEQ ID NO: 22204 - protein, 15 aa, Neisseria
NLFTQCEPEGFRKIT

SEQ ID NO: 22205 - protein, 9 aa, Neisseria
DVMSKFTTT

SEQ ID NO: 22206 - protein, 10 aa, Neisseria
RHWVKWEDPF

SEQ ID NO: 22207 - protein, 7 aa, Neisseria
SLKNAMK

SEQ ID NO: 22208 - protein, 6 aa, Neisseria
GIESVV

SEQ ID NO: 22209 - protein, 7 aa, Neisseria
EYFHNWT

SEQ ID NO: 22210 - protein, 8 aa, Neisseria
RDWFQLSL

SEQ ID NO: 22211 - protein, 18 aa, Neisseria
DRASRAVRRIENIRLLRQ

SEQ ID NO: 22212 - protein, 14 aa, Neisseria
VRPARYEEMNNFYT

SEQ ID NO: 22213 - protein, 11 aa, Neisseria
GAEVVRMYHTL

SEQ ID NO: 22214 - protein, 6 aa, Neisseria
FQKGMK

SEQ ID NO: 22215 - protein, 15 aa, Neisseria
TEAVVPSLLRGFSAP

SEQ ID NO: 22216 - protein, 10 aa, Neisseria
DAFTRWEAAQ

SEQ ID NO: 22217 - protein, 21 aa, Neisseria
LAALSDGVELPKHEKLLAAVE

SEQ ID NO: 22218 - protein, 8 aa, Neisseria
LDNAFKAL

SEQ ID NO: 22219 - protein, 9 aa, Neisseria
DGAENIDPL

SEQ ID NO: 22220 - protein, 9 aa, Neisseria
LPKWHELNR

SEQ ID NO: 22221 - protein, 11 aa, Neisseria
GWRTLRNVCRA

SEQ ID NO: 22222 - protein, 13 aa, Neisseria
TVAEKYAEMAQNM

SEQ ID NO: 22223 - protein, 5 aa, Neisseria
WGILS

SEQ ID NO: 22224 - protein, 11 aa, Neisseria
RLLAQFADKFS

SEQ ID NO: 22225 - protein, 9 aa, Neisseria
DTLQQVQTA

SEQ ID NO: 22226 - protein, 10 aa, Neisseria
SLIGSFSRNV

SEQ ID NO: 22227 - protein, 12 aa, Neisseria
RLVQAFNLCNKL

SEQ ID NO: 22228 - protein, 9 aa, Neisseria
LKDYQTPAY

SEQ ID NO: 22229 - protein, 5 aa, Neisseria
DINEP

SEQ ID NO: 22230 - protein, 14 aa, Neisseria
VKSRLTVEPKRVGE

SEQ ID NO: 22231 - protein, 7 aa, Neisseria
LVLDGSA

SEQ ID NO: 22232 - protein, 10 aa, Neisseria
ADVPSERFTV

SEQ ID NO: 22233 - protein, 13 aa, Neisseria
VETEILPAENKSL

SEQ ID NO: 22234 - protein, 10 aa, Neisseria
TQCEPEGFRK

SEQ ID NO: 22235 - protein, 8 aa, Neisseria
IDRPDVMS

SEQ ID NO: 22236 - protein, 8 aa, Neisseria
VADKKRYP

SEQ ID NO: 22237 - protein, 27 aa, Neisseria
NGNKIDGGEYSDGRHWVKWEDPFAKPS

SEQ ID NO: 22238 - protein, 6 aa, Neisseria
AVTEDY

SEQ ID NO: 22239 - protein, 8 aa, Neisseria
MSGRNVKI

SEQ ID NO: 22240 - protein, 9 aa, Neisseria
TTEADKPKV

SEQ ID NO: 22241 - protein, 8 aa, Neisseria
MKWDETRF

SEQ ID NO: 22242 - protein, 10 aa, Neisseria
NMGAMENKGL

SEQ ID NO: 22243 - protein, 14 aa, Neisseria
DSRTATDTDFEGIE

SEQ ID NO: 22244 - protein, 15 aa, Neisseria
YFHNWTGNRVTCRDW

SEQ ID NO: 22245 - protein, 5 aa, Neisseria
SLKEG

SEQ ID NO: 22246 - protein, 19 aa, Neisseria
RDQEFSGDRASRAVRRIEN

SEQ ID NO: 22247 - protein, 23 aa, Neisseria
HQFPEDAGPTAHPVRPARYEEMN

SEQ ID NO: 22248 - protein, 8 aa, Neisseria
VYEKGAEV

SEQ ID NO: 22249 - protein, 7 aa, Neisseria
EGFQKGM

SEQ ID NO: 22250 - protein, 15 aa, Neisseria
FQRHDGQAVTCDDFR

SEQ ID NO: 22251 - protein, 6 aa, Neisseria
SQAGTP

SEQ ID NO: 22252 - protein, 9 aa, Neisseria
AQGRLKNNV

SEQ ID NO: 22253 - protein, 16 aa, Neisseria
IKQTVPPTPDMADKQP

SEQ ID NO: 22254 - protein, 7 aa, Neisseria
NCNGEAV

SEQ ID NO: 22255 - protein, 9 aa, Neisseria
DYQGKRATE

SEQ ID NO: 22256 - protein, 6 aa, Neisseria
EAEQTF

SEQ ID NO: 22257 - protein, 10 aa, Neisseria
LNYPYSDDDL

SEQ ID NO: 22258 - protein, 5 aa, Neisseria
HDSDA

SEQ ID NO: 22259 - protein, 13 aa, Neisseria
LSDGVELPKHEKL

SEQ ID NO: 22260 - protein, 10 aa, Neisseria
VEKVISDDLL

SEQ ID NO: 22261 - protein, 18 aa, Neisseria
VPSEAELWDGAENIDPLR

SEQ ID NO: 22262 - protein, 7 aa, Neisseria
HQAREAL

SEQ ID NO: 22263 - protein, 23 aa, Neisseria
HELNRQAAKQENQSYEYSPEAAG

SEQ ID NO: 22264 - protein, 6 aa, Neisseria
TLRNVC

SEQ ID NO: 22265 - protein, 5 aa, Neisseria
ADPAH

SEQ ID NO: 22266 - protein, 8 aa, Neisseria
TVAEKYAE

SEQ ID NO: 22267 - protein, 11 aa, Neisseria
NGNESDTRNRL

SEQ ID NO: 22268 - protein, 11 aa, Neisseria
FADKFSDDALV

SEQ ID NO: 22269 - protein, 10 aa, Neisseria
GSSRRSDTLQ

SEQ ID NO: 22270 - protein, 15 aa, Neisseria
QHPKFSLENPNKARS

SEQ ID NO: 22271 - protein, 8 aa, Neisseria
GSFSRNVP

SEQ ID NO: 22272 - protein, 12 aa, Neisseria
HAEDGSGYRFIA

SEQ ID NO: 22273 - protein, 12 aa, Neisseria
KVIEIDRFNPQV

SEQ ID NO: 22274 - protein, 11 aa, Neisseria
NKLEPHRKNLV

SEQ ID NO: 22275 - protein, 19 aa, Neisseria
ALQRIRAQEGLSKDVGEIV

SEQ ID NO: 22276 - protein, 14 aa, Neisseria
VKSRLTVEPKRVGE

SEQ ID NO: 22277 - protein, 8 aa, Neisseria
VPSERFTV

SEQ ID NO: 22278 - protein, 12 aa, Neisseria
VETEILPAENKS

SEQ ID NO: 22279 - protein, 7 aa, Neisseria
CEPEGFR

SEQ ID NO: 22280 - protein, 7 aa, Neisseria
DRPDVMS

SEQ ID NO: 22281 - protein, 7 aa, Neisseria
VADKKRY

SEQ ID NO: 22282 - protein, 15 aa, Neisseria
NGNKIDGGEYSDGRH

SEQ ID NO: 22283 - protein, 8 aa, Neisseria
VKWEDPFA

SEQ ID NO: 22284 - protein, 6 aa, Neisseria
SGRNVK

SEQ ID NO: 22285 - protein, 7 aa, Neisseria
EADKPKV

SEQ ID NO: 22286 - protein, 8 aa, Neisseria
MKWDETRF

SEQ ID NO: 22287 - protein, 6 aa, Neisseria
AMENKG

SEQ ID NO: 22288 - protein, 14 aa, Neisseria
DSRTATDTDFEGIE

SEQ ID NO: 22289 - protein, 5 aa, Neisseria
SLKEG

SEQ ID NO: 22290 - protein, 19 aa, Neisseria
RDQEFSGDRASRAVRRIEN

SEQ ID NO: 22291 - protein, 8 aa, Neisseria
QFPEDAGP

SEQ ID NO: 22292 - protein, 9 aa, Neisseria
RPARYEEMN

SEQ ID NO: 22293 - protein, 8 aa, Neisseria
VYEKGAEV

SEQ ID NO: 22294 - protein, 7 aa, Neisseria
EGFQKGM

SEQ ID NO: 22295 - protein, 5 aa, Neisseria
RHDGQ

SEQ ID NO: 22296 - protein, 6 aa, Neisseria
TCDDFR

SEQ ID NO: 22297 - protein, 9 aa, Neisseria
AQGRLKNNV

SEQ ID NO: 22298 - protein, 8 aa, Neisseria
PDMADKQP

SEQ ID NO: 22299 - protein, 8 aa, Neisseria
YQGKRATE

SEQ ID NO: 22300 - protein, 6 aa, Neisseria
YSDDDL

SEQ ID NO: 22301 - protein, 5 aa, Neisseria
HDSDA

SEQ ID NO: 22302 - protein, 11 aa, Neisseria
DGVELPKHEKL

SEQ ID NO: 22303 - protein, 6 aa, Neisseria
VEKVIS

SEQ ID NO: 22304 - protein, 5 aa, Neisseria
SEAEL

SEQ ID NO: 22305 - protein, 8 aa, Neisseria
DGAENIDP

SEQ ID NO: 22306 - protein, 7 aa, Neisseria
HQAREAL

SEQ ID NO: 22307 - protein, 14 aa, Neisseria
HELNRQAAKQENQS

SEQ ID NO: 22308 - protein, 5 aa, Neisseria
ADPAH

SEQ ID NO: 22309 - protein, 8 aa, Neisseria
TVAEKYAE

SEQ ID NO: 22310 - protein, 11 aa, Neisseria
NGNESDTRNRL

SEQ ID NO: 22311 - protein, 7 aa, Neisseria
FADKFSD

SEQ ID NO: 22312 - protein, 7 aa, Neisseria
SSRRSDT

SEQ ID NO: 22313 - protein, 7 aa, Neisseria
NPNKARS

SEQ ID NO: 22314 - protein, 7 aa, Neisseria
HAEDGSG

SEQ ID NO: 22315 - protein, 9 aa, Neisseria
KVIEIDRFN

SEQ ID NO: 22316 - protein, 11 aa, Neisseria
NKLEPHRKNLV

SEQ ID NO: 22317 - protein, 19 aa, Neisseria
ALQRIRAQEGLSKDVGEIV

SEQ ID NO: 22318 - protein, 10 aa, Neisseria
GYDILKQGGS

SEQ ID NO: 22319 - protein, 7 aa, Neisseria
LKFMEAV

SEQ ID NO: 22320 - protein, 11 aa, Neisseria
NHQSNSGEGVL

SEQ ID NO: 22321 - protein, 7 aa, Neisseria
NQGKVNT

SEQ ID NO: 22322 - protein, 10 aa, Neisseria
ADAHTPEHAT

SEQ ID NO: 22323 - protein, 6 aa, Neisseria
LTEQKQ

SEQ ID NO: 22324 - protein, 9 aa, Neisseria
ILKQGGSAA

SEQ ID NO: 22325 - protein, 9 aa, Neisseria
EPQSSGLGG

SEQ ID NO: 22326 - protein, 6 aa, Neisseria
DNTAKT

SEQ ID NO: 22327 - protein, 10 aa, Neisseria
TTFDGRETAP

SEQ ID NO: 22328 - protein, 8 aa, Neisseria
FLDKDGQP

SEQ ID NO: 22329 - protein, 5 aa, Neisseria
SNSGE

SEQ ID NO: 22330 - protein, 7 aa, Neisseria
NQGKVNT

SEQ ID NO: 22331 - protein, 7 aa, Neisseria
DAHTPEH

SEQ ID NO: 22332 - protein, 6 aa, Neisseria
LTEQKQ

SEQ ID NO: 22333 - protein, 5 aa, Neisseria
GGSAA

SEQ ID NO: 22334 - protein, 8 aa, Neisseria
FDGRETAP

SEQ ID NO: 22335 - protein, 8 aa, Neisseria
FLDKDGQP

SEQ ID NO: 22336 - protein, 18 aa, Neisseria
IADFLQPARVERLPHLAA

SEQ ID NO: 22337 - protein, 5 aa, Neisseria
KTAQF

SEQ ID NO: 22338 - protein, 7 aa, Neisseria
IAAVAEI

SEQ ID NO: 22339 - protein, 10 aa, Neisseria
IARGVDAVQR

SEQ ID NO: 22340 - protein, 19 aa, Neisseria
TDQLRRMFFNQLEKFGDNH

SEQ ID NO: 22341 - protein, 9 aa, Neisseria
VIHLADCTD

SEQ ID NO: 22342 - protein, 11 aa, Neisseria
KMMLHKIPTRL

SEQ ID NO: 22343 - protein, 7 aa, Neisseria
IVSDPLD

SEQ ID NO: 22344 - protein, 9 aa, Neisseria
SAADQTETQ

SEQ ID NO: 22345 - protein, 7 aa, Neisseria
ARVERLP

SEQ ID NO: 22346 - protein, 7 aa, Neisseria
LARKTAQ

SEQ ID NO: 22347 - protein, 13 aa, Neisseria
RHIRPRLVKREQI

SEQ ID NO: 22348 - protein, 7 aa, Neisseria
RGVDAVQ

SEQ ID NO: 22349 - protein, 8 aa, Neisseria
VMQNRQVE

SEQ ID NO: 22350 - protein, 6 aa, Neisseria
PTDQLR

SEQ ID NO: 22351 - protein, 6 aa, Neisseria
LEKFGD

SEQ ID NO: 22352 - protein, 5 aa, Neisseria
DCTDM

SEQ ID NO: 22353 - protein, 12 aa, Neisseria
PPTHAARNRHNL

SEQ ID NO: 22354 - protein, 5 aa, Neisseria
IPTRL

SEQ ID NO: 22355 - protein, 14 aa, Neisseria
GQRGRQVIQRTDTL

SEQ ID NO: 22356 - protein, 10 aa, Neisseria
IESQNRGHDS

SEQ ID NO: 22357 - protein, 6 aa, Neisseria
IVSDPL

SEQ ID NO: 22358 - protein, 9 aa, Neisseria
SAADQTETQ

SEQ ID NO: 22359 - protein, 7 aa, Neisseria
ARVERLP

SEQ ID NO: 22360 - protein, 7 aa, Neisseria
LARKTAQ

SEQ ID NO: 22361 - protein, 13 aa, Neisseria
RHIRPRLVKREQI

SEQ ID NO: 22362 - protein, 7 aa, Neisseria
RGVDAVQ

SEQ ID NO: 22363 - protein, 5 aa, Neisseria
EKFGD

SEQ ID NO: 22364 - protein, 9 aa, Neisseria
HAARNRHNL

SEQ ID NO: 22365 - protein, 12 aa, Neisseria
QRGRQVIQRTDT

SEQ ID NO: 22366 - protein, 7 aa, Neisseria
SQNRGHD

SEQ ID NO: 22367 - protein, 6 aa, Neisseria
KLHRAF

SEQ ID NO: 22368 - protein, 8 aa, Neisseria
QIFRHVQS

SEQ ID NO: 22369 - protein, 6 aa, Neisseria
KPPNTA

SEQ ID NO: 22370 - protein, 12 aa, Neisseria
MRRIIKKHQPVN

SEQ ID NO: 22371 - protein, 18 aa, Neisseria
GRKRPHHHDRSLRRQHGI

SEQ ID NO: 22372 - protein, 22 aa, Neisseria
VQSSNRQNGRQPVCTKPPNTAS

SEQ ID NO: 22373 - protein, 7 aa, Neisseria
ADIKRIL

SEQ ID NO: 22374 - protein, 10 aa, Neisseria
MRRIIKKHQP

SEQ ID NO: 22375 - protein, 17 aa, Neisseria
GRKRPHHHDRSLRRQHG

SEQ ID NO: 22376 - protein, 18 aa, Neisseria
QSSNRQNGRQPVCTKPPN

SEQ ID NO: 22377 - protein, 7 aa, Neisseria
ADIKRIL

SEQ ID NO: 22378 - protein, 5 aa, Neisseria
RSCFG

SEQ ID NO: 22379 - protein, 8 aa, Neisseria
VKNASGVS

SEQ ID NO: 22380 - protein, 5 aa, Neisseria
ITRSA

SEQ ID NO: 22381 - protein, 7 aa, Neisseria
VGSSNNI

SEQ ID NO: 22382 - protein, 5 aa, Neisseria
FSACS

SEQ ID NO: 22383 - protein, 9 aa, Neisseria
CRNCLARSC

SEQ ID NO: 22384 - protein, 14 aa, Neisseria
NASGVSSSRICPLS

SEQ ID NO: 22385 - protein, 13 aa, Neisseria
KITRSATSRANPI

SEQ ID NO: 22386 - protein, 31 aa, Neisseria; identical to SEQ ID NO: 9172

SEQ ID NO: 22387 - protein, 12 aa, Neisseria
CCWPPESWEGKA

SEQ ID NO: 22388 - protein, 9 aa, Neisseria
ASPTRSKSS

SEQ ID NO: 22389 - protein, 6 aa, Neisseria
NTVRCG

SEQ ID NO: 22390 - protein, 11 aa, Neisseria
KITRSATSRAN

SEQ ID NO: 22391 - protein, 7 aa, Neisseria
SSAEVGS

SEQ ID NO: 22392 - protein, 9 aa, Neisseria
SIAKPRAIA

SEQ ID NO: 22393 - protein, 6 aa, Neisseria
PTRSKS

SEQ ID NO: 22394 - protein, 5 aa, Neisseria
TPRIA

SEQ ID NO: 22395 - protein, 6 aa, Neisseria
RLFIRY

SEQ ID NO: 22396 - protein, 28 aa, Neisseria
FNAPNTPPKMRLAKPKPTAETAPVSSER

SEQ ID NO: 22397 - protein, 41 aa, Neisseria
QAMTNREMNDRANANRRGWNDAKAMSAKGAAKSLAKKKATT

SEQ ID NO: 22398 - protein, 7 aa, Neisseria
RIADSTM

SEQ ID NO: 22399 - protein, 11 aa, Neisseria
AETRRSATGRL

SEQ ID NO: 22400 - protein, 5 aa, Neisseria [sequence omitted]

SEQ ID NO: 22401 - protein, 15 aa, Neisseria
TPPKMRLAKPKPTAE

SEQ ID NO: 22402 - protein, 7 aa, Neisseria
APVSSER

SEQ ID NO: 22403 - protein, 39 aa, Neisseria
MTNREMNDRANANRRGWNDAKAMSAKGAAKSLAKKKATT

SEQ ID NO: 22404 - protein, 8 aa, Neisseria
AETRRSAT

SEQ ID NO: 22405 - protein, 10 aa, Neisseria
RAVDIIKAQK

SEQ ID NO: 22406 - protein, 10 aa, Neisseria
AALPPFVSVV

SEQ ID NO: 22407 - protein, 12 aa, Neisseria
AQNIRRILAEVP

SEQ ID NO: 22408 - protein, 10 aa, Neisseria
AFCRQFHRPY

SEQ ID NO: 22409 - protein, 15 aa, Neisseria
RVQTASDIRNAADRF

SEQ ID NO: 22410 - protein, 6 aa, Neisseria
HPSEYG

SEQ ID NO: 22411 - protein, 6 aa, Neisseria
NVDEAI

SEQ ID NO: 22412 - protein, 5 aa, Neisseria
TGAEA

SEQ ID NO: 22413 - protein, 18 aa, Neisseria
MRKIRTKICGITTPEDAL

SEQ ID NO: 22414 - protein, 14 aa, Neisseria
PQSPRAVDIIKAQK

SEQ ID NO: 22415 - protein, 11 aa, Neisseria
ESAQNIRRILA

SEQ ID NO: 22416 - protein, 9 aa, Neisseria
FHGDEDDAF

SEQ ID NO: 22417 - protein, 16 aa, Neisseria
QTASDIRNAADRFPDA

SEQ ID NO: 22418 - protein, 14 aa, Neisseria
YHPSEYGGTGHRFD

SEQ ID NO: 22419 - protein, 6 aa, Neisseria
EYSGKP

SEQ ID NO: 22420 - protein, 13 aa, Neisseria
GGLTPENVDEAIR

SEQ ID NO: 22421 - protein, 20 aa, Neisseria
EAVDVSGGVEASKGKKDPAK

SEQ ID NO: 22422 - protein, 7 aa, Neisseria
TANRLSR

SEQ ID NO: 22423 - protein, 8 aa, Neisseria
MRKIRTKI

SEQ ID NO: 22424 - protein, 6 aa, Neisseria
TPEDAL

SEQ ID NO: 22425 - protein, 6 aa, Neisseria
SPRAVD

SEQ ID NO: 22426 - protein, 5 aa, Neisseria
IKAQK

SEQ ID NO: 22427 - protein, 10 aa, Neisseria
SAQNIRRILA

SEQ ID NO: 22428 - protein, 8 aa, Neisseria
HGDEDDAF

SEQ ID NO: 22429 - protein, 12 aa, Neisseria
SDIRNAADRFPD

SEQ ID NO: 22430 - protein, 8 aa, Neisseria
ENVDEAIR

SEQ ID NO: 22431 - protein, 12 aa, Neisseria
VEASKGKKDPAK

SEQ ID NO: 22432 - protein, 5 aa, Neisseria
NRLSR

SEQ ID NO: 22433 - protein, 18 aa, Neisseria
LNDRLNQNVTEALGGVDV

SEQ ID NO: 22434 - protein, 5 aa, Neisseria
RFTDA

SEQ ID NO: 22435 - protein, 8 aa, Neisseria
VVLKQLPK

SEQ ID NO: 22436 - protein, 13 aa, Neisseria
RIANLLELIKPYL

SEQ ID NO: 22437 - protein, 9 aa, Neisseria
KLFRYLGEE

SEQ ID NO: 22438 - protein, 9 aa, Neisseria
GERLKKIST

SEQ ID NO: 22439 - protein, 5 aa, Neisseria
MEKLF

SEQ ID NO: 22440 - protein, 8 aa, Neisseria
LKVWVKVK

SEQ ID NO: 22441 - protein, 11 aa, Neisseria
LAGERAADGYR

SEQ ID NO: 22442 - protein, 10 aa, Neisseria
VGRPNVGKST

SEQ ID NO: 22443 - protein, 15 aa, Neisseria
SITSKKAQTTRNRVT

SEQ ID NO: 22444 - protein, 6 aa, Neisseria
YTDDTA

SEQ ID NO: 22445 - protein, 22 aa, Neisseria
TPGFQTDHRNALNDRLNQNVTE

SEQ ID NO: 22446 - protein, 9 aa, Neisseria
RFTDADRVV

SEQ ID NO: 22447 - protein, 6 aa, Neisseria
QLPKHT

SEQ ID NO: 22448 - protein, 12 aa, Neisseria
KIDKDKAKDRYA

SEQ ID NO: 22449 - protein, 5 aa, Neisseria
VRAEF

SEQ ID NO: 22450 - protein, 9 aa, Neisseria
IKPYLPESV

SEQ ID NO: 22451 - protein, 13 aa, Neisseria
MYPEDMVTDKSAR

SEQ ID NO: 22452 - protein, 7 aa, Neisseria
IVREKLF

SEQ ID NO: 22453 - protein, 6 aa, Neisseria
LGEELP

SEQ ID NO: 22454 - protein, 13 aa, Neisseria
VEVEQFEEEDGLN

SEQ ID NO: 22455 - protein, 7 aa, Neisseria
VDKESQK

SEQ ID NO: 22456 - protein, 23 aa, Neisseria
GKGGERLKKISTEARLDMEKLFD

SEQ ID NO: 22457 - protein, 13 aa, Neisseria
VKSGWADDIRFLR

SEQ ID NO: 22458 - protein, 11 aa, Neisseria
LAGERAADGYR

SEQ ID NO: 22459 - protein, 13 aa, Neisseria
ITSKKAQTTRNRV

SEQ ID NO: 22460 - protein, 6 aa, Neisseria
YTDDTA

SEQ ID NO: 22461 - protein, 12 aa, Neisseria
TDHRNALNDRLN

SEQ ID NO: 22462 - protein, 9 aa, Neisseria
RFTDADRVV

SEQ ID NO: 22463 - protein, 12 aa, Neisseria
KIDKDKAKDRYA

SEQ ID NO: 22464 - protein, 5 aa, Neisseria
VRAEF

SEQ ID NO: 22465 - protein, 9 aa, Neisseria
DMVTDKSAR

SEQ ID NO: 22466 - protein, 7 aa, Neisseria
IVREKLF

SEQ ID NO: 22467 - protein, 6 aa, Neisseria
LGEELP

SEQ ID NO: 22468 - protein, 13 aa, Neisseria
VEVEQFEEEDGLN

SEQ ID NO: 22469 - protein, 7 aa, Neisseria
VDKESQK

SEQ ID NO: 22470 - protein, 22 aa, Neisseria
KGGERLKKISTEARLDMEKLFD

SEQ ID NO: 22471 - protein, 11 aa, Neisseria
SGWADDIRFLR

SEQ ID NO: 22472 - protein, 6 aa, Neisseria
VYQSLI

SEQ ID NO: 22473 - protein, 18 aa, Neisseria
TAAPEIAKNIREMPDFAK

SEQ ID NO: 22474 - protein, 10 aa, Neisseria
AAEYIRQIRP

SEQ ID NO: 22475 - protein, 12 aa, Neisseria
TACHELSAMPET

SEQ ID NO: 22476 - protein, 24 aa, Neisseria
IEVTKTFGGTDGHKFVNGILDKLA

SEQ ID NO: 22477 - protein, 12 aa, Neisseria
MKTARRRSRELA

SEQ ID NO: 22478 - protein, 20 aa, Neisseria
EIAKNIREMPDFAKADEELF

SEQ ID NO: 22479 - protein, 5 aa, Neisseria
TQTNA

SEQ ID NO: 22480 - protein, 19 aa, Neisseria
RQIRPLLDRDEKDLNPIER

SEQ ID NO: 22481 - protein, 7 aa, Neisseria
AMPETPY

SEQ ID NO: 22482 - protein, 17 aa, Neisseria
EAIEVTKTFGGTDGHKF

SEQ ID NO: 22483 - protein, 13 aa, Neisseria
LAAQIRPDEPKRR

SEQ ID NO: 22484 - protein, 12 aa, Neisseria
MKTARRRSRELA

SEQ ID NO: 22485 - protein, 20 aa, Neisseria
EIAKNIREMPDFAKADEELF

SEQ ID NO: 22486 - protein, 19 aa, Neisseria
RQIRPLLDRDEKDLNPIER

SEQ ID NO: 22487 - protein, 5 aa, Neisseria
EAIEV

SEQ ID NO: 22488 - protein, 9 aa, Neisseria
IRPDEPKRR

SEQ ID NO: 22489 - protein, 22 aa, Neisseria
RFTNEIGSEMLKVCCRTLQELG

SEQ ID NO: 22490 - protein, 5 aa, Neisseria
ALIAI

SEQ ID NO: 22491 - protein, 12 aa, Neisseria
QAIERIEEKASD

SEQ ID NO: 22492 - protein, 11 aa, Neisseria
ECANLVNLLLE

SEQ ID NO: 22493 - protein, 9 aa, Neisseria
PNLDGKHLR

SEQ ID NO: 22494 - protein, 6 aa, Neisseria
IGSEML

SEQ ID NO: 22495 - protein, 7 aa, Neisseria
GVADENI

SEQ ID NO: 22496 - protein, 6 aa, Neisseria
SSEKFD

SEQ ID NO: 22497 - protein, 6 aa, Neisseria
IRGETY

SEQ ID NO: 22498 - protein, 9 aa, Neisseria
VSNESGAGV

SEQ ID NO: 22499 - protein, 23 aa, Neisseria
TENDAQAIERIEEKASDAAKVAV

SEQ ID NO: 22500 - protein, 7 aa, Neisseria
EQFEDEE

SEQ ID NO: 22501 - protein, 7 aa, Neisseria
LDGKHLR

SEQ ID NO: 22502 - protein, 6 aa, Neisseria
IGSEML

SEQ ID NO: 22503 - protein, 7 aa, Neisseria
GVADENI

SEQ ID NO: 22504 - protein, 6 aa, Neisseria
SSEKFD

SEQ ID NO: 22505 - protein, 6 aa, Neisseria
IRGETY

SEQ ID NO: 22506 - protein, 8 aa, Neisseria
VSNESGAG

SEQ ID NO: 22507 - protein, 23 aa, Neisseria
TENDAQAIERIEEKASDAAKVAV

SEQ ID NO: 22508 - protein, 7 aa, Neisseria
EQFEDEE

SEQ ID NO: 22509 - protein, 8 aa, Neisseria
ARLCRFRR

SEQ ID NO: 22510 - protein, 18 aa, Neisseria
LTPFRRVNHFVAFTRFNQ

SEQ ID NO: 22511 - protein, 7 aa, Neisseria
IDFIDAD

SEQ ID NO: 22512 - protein, 6 aa, Neisseria
FDGLLA

SEQ ID NO: 22513 - protein, 6 aa, Neisseria
HLVGRF

SEQ ID NO: 22514 - protein, 9 aa, Neisseria
CRPVDDLDD

SEQ ID NO: 22515 - protein, 14 aa, Neisseria
AFFINQLIKLVFQC

SEQ ID NO: 22516 - protein, 11 aa, Neisseria
CRFRRHSRSVD

SEQ ID NO: 22517 - protein, 9 aa, Neisseria
DVFDRKDFN

SEQ ID NO: 22518 - protein, 16 aa, Neisseria
RFNQTTSQRRNPRNFV

SEQ ID NO: 22519 - protein, 8 aa, Neisseria
IDADDFDG

SEQ ID NO: 22520 - protein, 11 aa, Neisseria
QQTDGRAEKHL

SEQ ID NO: 22521 - protein, 8 aa, Neisseria
GINDDGGF

SEQ ID NO: 22522 - protein, 9 aa, Neisseria
LGQETDAAV

SEQ ID NO: 22523 - protein, 10 aa, Neisseria
RPVDDLDDFG

SEQ ID NO: 22524 - protein, 6 aa, Neisseria
PSGGRN

SEQ ID NO: 22525 - protein, 11 aa, Neisseria
CRFRRHSRSVD

SEQ ID NO: 22526 - protein, 8 aa, Neisseria
DVFDRKDF

SEQ ID NO: 22527 - protein, 8 aa, Neisseria
TSQRRNPR

SEQ ID NO: 22528 - protein, 7 aa, Neisseria
IDADDFD

SEQ ID NO: 22529 - protein, 11 aa, Neisseria
QQTDGRAEKHL

SEQ ID NO: 22530 - protein, 6 aa, Neisseria
INDDGG

SEQ ID NO: 22531 - protein, 8 aa, Neisseria
GQETDAAV

SEQ ID NO: 22532 - protein, 8 aa, Neisseria
RPVDDLDD

SEQ ID NO: 22533 - protein, 6 aa, Neisseria
LVSAII

SEQ ID NO: 22534 - protein, 5 aa, Neisseria
MRGVI

SEQ ID NO: 22535 - protein, 5 aa, Neisseria
FAAPF

SEQ ID NO: 22536 - protein, 13 aa, Neisseria
LIQKILRSLLTGA

SEQ ID NO: 22537 - protein, 14 aa, Neisseria
RILGGVFGALKGIL

SEQ ID NO: 22538 - protein, 5 aa, Neisseria
PDTEE

SEQ ID NO: 22539 - protein, 16 aa, Neisseria
SKTDLPDTEEWRQSYT

SEQ ID NO: 22540 - protein, 12 aa, Neisseria
HSGGTAETPEDD

SEQ ID NO: 22541 - protein, 13 aa, Neisseria
SKTDLPDTEEWRQ

SEQ ID NO: 22542 - protein, 9 aa, Neisseria
GTAETPEDD

SEQ ID NO: 22543 - protein, 11 aa, Neisseria
FSEEAKFISAM

SEQ ID NO: 22544 - protein, 5 aa, Neisseria
LPVGD

SEQ ID NO: 22545 - protein, 6 aa, Neisseria
RLGEQC

SEQ ID NO: 22546 - protein, 18 aa, Neisseria
IGEADDAEVVRVVGVFVG

SEQ ID NO: 22547 - protein, 6 aa, Neisseria
KCVHCG

SEQ ID NO: 22548 - protein, 11 aa, Neisseria
  VARIANT 1: Xaa is any amino acid
XGGKLADFTTI

SEQ ID NO: 22549 - protein, 26 aa, Neisseria
CAPFAALRCFCIFGVWKRIRAVFCGR

SEQ ID NO: 22550 - protein, 8 aa, Neisseria
NFSEEAKF

SEQ ID NO: 22551 - protein, 11 aa, Neisseria
ATPNSWRVRQQ

SEQ ID NO: 22552 - protein, 6 aa, Neisseria
LVKRAC

SEQ ID NO: 22553 - protein, 10 aa, Neisseria
PMRRCLPSRL

SEQ ID NO: 22554 - protein, 11 aa, Neisseria
GGFGMPSEGSV

SEQ ID NO: 22555 - protein, 7 aa, Neisseria
PVGDGLE

SEQ ID NO: 22556 - protein, 11 aa, Neisseria
AFRLGEQCGGF

SEQ ID NO: 22557 - protein, 10 aa, Neisseria
DIGEADDAEV

SEQ ID NO: 22558 - protein, 6 aa, Neisseria
AAEETP

SEQ ID NO: 22559 - protein, 5 aa, Neisseria
FKNGG

SEQ ID NO: 22560 - protein, 7 aa, Neisseria
AVEEADG

SEQ ID NO: 22561 - protein, 17 aa, Neisseria
DGVGGDAAVECRGKCLC

SEQ ID NO: 22562 - protein, 10 aa, Neisseria
  VARIANT 4: Xaa is any amino acid
GNTXGGKLAD

SEQ ID NO: 22563 - protein, 6 aa, Neisseria
SADGGG

SEQ ID NO: 22564 - protein, 5 aa, Neisseria
FCGRR

SEQ ID NO: 22565 - protein, 8 aa, Neisseria
NFSEEAKF

SEQ ID NO: 22566 - protein, 5 aa, Neisseria
WRVRQ

SEQ ID NO: 22567 - protein, 6 aa, Neisseria
LVKRAC

SEQ ID NO: 22568 - protein, 7 aa, Neisseria
PMRRCLP

SEQ ID NO: 22569 - protein, 5 aa, Neisseria
SEGSV

SEQ ID NO: 22570 - protein, 7 aa, Neisseria
AFRLGEQ

SEQ ID NO: 22571 - protein, 10 aa, Neisseria
DIGEADDAEV

SEQ ID NO: 22572 - protein, 6 aa, Neisseria
AAEETP

SEQ ID NO: 22573 - protein, 7 aa, Neisseria
AVEEADG

SEQ ID NO: 22574 - protein, 10 aa, Neisseria
AAVECRGKCL

SEQ ID NO: 22575 - protein, 7 aa, Neisseria
  VARIANT 1: Xaa is any amino acid
XGGKLAD

SEQ ID NO: 22576 - protein, 5 aa, Neisseria
FCGRR

SEQ ID NO: 22577 - protein, 16 aa, Neisseria
RLRKCGRILSGICEPF

SEQ ID NO: 22578 - protein, 11 aa, Neisseria
SYGKWRKNWDI

SEQ ID NO: 22579 - protein, 10 aa, Neisseria
SSTRLRKCGR

SEQ ID NO: 22580 - protein, 9 aa, Neisseria
RFPTDRPIL

SEQ ID NO: 22581 - protein, 22 aa, Neisseria
ISPRTGFRYPTRSLPKSKKAYG

SEQ ID NO: 22582 - protein, 7 aa, Neisseria
KWRKNWD

SEQ ID NO: 22583 - protein, 8 aa, Neisseria
TRLRKCGR

SEQ ID NO: 22584 - protein, 7 aa, Neisseria
PTDRPIL

SEQ ID NO: 22585 - protein, 10 aa, Neisseria
SLPKSKKAYG

SEQ ID NO: 22586 - protein, 16 aa, Neisseria
TPDKSARWENIGTISN

SEQ ID NO: 22587 - protein, 6 aa, Neisseria
SSLQLF

SEQ ID NO: 22588 - protein, 8 aa, Neisseria
RPMSILSG

SEQ ID NO: 22589 - protein, 12 aa, Neisseria
CSTPDKSARWEN

SEQ ID NO: 22590 - protein, 6 aa, Neisseria
GTISNG

SEQ ID NO: 22591 - protein, 11 aa, Neisseria
INKDSVRKNGN

SEQ ID NO: 22592 - protein, 15 aa, Neisseria
  VARIANT 1: Xaa is any amino acid
XDKKVVTNLKQERFA

SEQ ID NO: 22593 - protein, 8 aa, Neisseria
CNNKTYRL

SEQ ID NO: 22594 - protein, 10 aa, Neisseria
FDTKNTEIST

SEQ ID NO: 22595 - protein, 7 aa, Neisseria
TASSLRP

SEQ ID NO: 22596 - protein, 9 aa, Neisseria
GTLTEKQYE

SEQ ID NO: 22597 - protein, 6 aa, Neisseria
VCGKKL

SEQ ID NO: 22598 - protein, 11 aa, Neisseria
STPDKSARWEN

SEQ ID NO: 22599 - protein, 10 aa, Neisseria
INKDSVRKNG

SEQ ID NO: 22600 - protein, 7 aa, Neisseria
  VARIANT 1: Xaa is any amino acid
XDKKVVT

SEQ ID NO: 22601 - protein, 7 aa, Neisseria
LKQERFA

SEQ ID NO: 22602 - protein, 8 aa, Neisseria
DTKNTEIS

SEQ ID NO: 22603 - protein, 7 aa, Neisseria
LTEKQYE

SEQ ID NO: 22604 - protein, 6 aa, Neisseria
VCGKKL

SEQ ID NO: 22605 - protein, 7 aa, Neisseria
AACGTVQ

SEQ ID NO: 22606 - protein, 5 aa, Neisseria
LAEPL

SEQ ID NO: 22607 - protein, 23 aa, Neisseria
WADTLDDMLEAALSNAFNRLDST

SEQ ID NO: 22608 - protein, 12 aa, Neisseria
WTVYIDAFQGSY

SEQ ID NO: 22609 - protein, 18 aa, Neisseria
AMTAALEQGLKQAAQQMV

SEQ ID NO: 22610 - protein, 31 aa, Neisseria; identical to SEQ ID NO: 9385

SEQ ID NO: 22611 - protein, 10 aa, Neisseria
TDPYRLNTAQ

SEQ ID NO: 22612 - protein, 7 aa, Neisseria
TLDDMLE

SEQ ID NO: 22613 - protein, 7 aa, Neisseria
NRLDSTR

SEQ ID NO: 22614 - protein, 9 aa, Neisseria
ASRSGSTEK

SEQ ID NO: 22615 - protein, 10 aa, Neisseria
FQGSYTGKTL

SEQ ID NO: 22616 - protein, 21 aa, Neisseria
LPDGTNRPFHIETEQQGDGYA

SEQ ID NO: 22617 - protein, 7 aa, Neisseria
QGLKQAA

SEQ ID NO: 22618 - protein, 7 aa, Neisseria
PDSRYIR

SEQ ID NO: 22619 - protein, 21 aa, Neisseria
ATQGGETAVEVRLAEPLKRGG

SEQ ID NO: 22620 - protein, 7 aa, Neisseria
TLDDMLE

SEQ ID NO: 22621 - protein, 5 aa, Neisseria
NRLDS

SEQ ID NO: 22622 - protein, 8 aa, Neisseria
SRSGSTEK

SEQ ID NO: 22623 - protein, 10 aa, Neisseria
FHIETEQQGD

SEQ ID NO: 22624 - protein, 7 aa, Neisseria
QGLKQAA

SEQ ID NO: 22625 - protein, 8 aa, Neisseria
NFAFCGVV

SEQ ID NO: 22626 - protein, 5 aa, Neisseria
CAVLL

SEQ ID NO: 22627 - protein, 10 aa, Neisseria
WAALDTLTEL

SEQ ID NO: 22628 - protein, 7 aa, Neisseria
YEALHRY

SEQ ID NO: 22629 - protein, 11 aa, Neisseria
GAEAYEQLAKN

SEQ ID NO: 22630 - protein, 14 aa, Neisseria
EKQMETLARIFGKE

SEQ ID NO: 22631 - protein, 5 aa, Neisseria
DALFA

SEQ ID NO: 22632 - protein, 10 aa, Neisseria
AVEVLDNALV

SEQ ID NO: 22633 - protein, 9 aa, Neisseria
AAEQLKEAF

SEQ ID NO: 22634 - protein, 20 aa, Neisseria
LNNKHSYSYAKEPHTVKPRF

SEQ ID NO: 22635 - protein, 11 aa, Neisseria
SPEPAAEKTVS

SEQ ID NO: 22636 - protein, 17 aa, Neisseria
PTARGDAVVPKNPERVA

SEQ ID NO: 22637 - protein, 6 aa, Neisseria
AFDKAA

SEQ ID NO: 22638 - protein, 12 aa, Neisseria
FEPDYEALHRYN

SEQ ID NO: 22639 - protein, 16 aa, Neisseria
GGPGAEAYEQLAKNAT

SEQ ID NO: 22640 - protein, 19 aa, Neisseria
LTVDNGNIRTSGEKQMETL

SEQ ID NO: 22641 - protein, 14 aa, Neisseria
FGKEARAAELKAQI

SEQ ID NO: 22642 - protein, 13 aa, Neisseria
QTREAAKGKGRGL

SEQ ID NO: 22643 - protein, 15 aa, Neisseria
VTGNKVSAFGTQSRL

SEQ ID NO: 22644 - protein, 19 aa, Neisseria
GDIGLPPVDESLRNEGHGQ

SEQ ID NO: 22645 - protein, 10 aa, Neisseria
YIKEKNPDWI

SEQ ID NO: 22646 - protein, 11 aa, Neisseria
RTAAIGQEGPA

SEQ ID NO: 22647 - protein, 9 aa, Neisseria
GTNAWKRKQ

SEQ ID NO: 22648 - protein, 6 aa, Neisseria
GGSRQL

SEQ ID NO: 22649 - protein, 12 aa, Neisseria
EQLKEAFEKAEP

SEQ ID NO: 22650 - protein, 5 aa, Neisseria
AAGKE

SEQ ID NO: 22651 - protein, 9 aa, Neisseria
YAKEPHTVK

SEQ ID NO: 22652 - protein, 11 aa, Neisseria
SPEPAAEKTVS

SEQ ID NO: 22653 - protein, 8 aa, Neisseria
TARGDAVV

SEQ ID NO: 22654 - protein, 7 aa, Neisseria
KNPERVA

SEQ ID NO: 22655 - protein, 6 aa, Neisseria
AFDKAA

SEQ ID NO: 22656 - protein, 5 aa, Neisseria
PDYEA

SEQ ID NO: 22657 - protein, 8 aa, Neisseria
EAYEQLAK

SEQ ID NO: 22658 - protein, 14 aa, Neisseria
GNIRTSGEKQMETL

SEQ ID NO: 22659 - protein, 14 aa, Neisseria
FGKEARAAELKAQI

SEQ ID NO: 22660 - protein, 12 aa, Neisseria
QTREAAKGKGRG

SEQ ID NO: 22661 - protein, 12 aa, Neisseria
PVDESLRNEGHG

SEQ ID NO: 22662 - protein, 7 aa, Neisseria
YIKEKNP

SEQ ID NO: 22663 - protein, 6 aa, Neisseria
GQEGPA

SEQ ID NO: 22664 - protein, 7 aa, Neisseria
NAWKRKQ

SEQ ID NO: 22665 - protein, 12 aa, Neisseria
EQLKEAFEKAEP

SEQ ID NO: 22666 - protein, 5 aa, Neisseria
AAGKE

SEQ ID NO: 22667 - protein, 22 aa, Neisseria
DVFDDICSAVESFGGIARSVQL

SEQ ID NO: 22668 - protein, 12 aa, Neisseria
TTGIVETVDKPL

SEQ ID NO: 22669 - protein, 5 aa, Neisseria
VEADI

SEQ ID NO: 22670 - protein, 13 aa, Neisseria
IPRAFGSGIAAAL

SEQ ID NO: 22671 - protein, 11 aa, Neisseria
NFSCRADDVFD

SEQ ID NO: 22672 - protein, 8 aa, Neisseria
LRQHTTGI

SEQ ID NO: 22673 - protein, 10 aa, Neisseria
ETVDKPLSGA

SEQ ID NO: 22674 - protein, 5 aa, Neisseria
VEADI

SEQ ID NO: 22675 - protein, 13 aa, Neisseria
DAVKAESVNGTTG

SEQ ID NO: 22676 - protein, 8 aa, Neisseria
CRADDVFD

SEQ ID NO: 22677 - protein, 8 aa, Neisseria
ETVDKPLS

SEQ ID NO: 22678 - protein, 5 aa, Neisseria
VEADI

SEQ ID NO: 22679 - protein, 9 aa, Neisseria
DAVKAESVN

SEQ ID NO: 22680 - protein, 6 aa, Neisseria
AALFAL

SEQ ID NO: 22681 - protein, 13 aa, Neisseria
KVEVLEFFGYFCP

SEQ ID NO: 22682 - protein, 15 aa, Neisseria
CAHLEPVLSKHAKSF

SEQ ID NO: 22683 - protein, 7 aa, Neisseria
LARLAAA

SEQ ID NO: 22684 - protein, 5 aa, Neisseria
FDAMV

SEQ ID NO: 22685 - protein, 8 aa, Neisseria
PEVLKKWL

SEQ ID NO: 22686 - protein, 14 aa, Neisseria
QARADKMQELTETF

SEQ ID NO: 22687 - protein, 5 aa, Neisseria
MKSKH

SEQ ID NO: 22688 - protein, 15 aa, Neisseria
CDSKVQTSVPADSAP

SEQ ID NO: 22689 - protein, 8 aa, Neisseria
GLVEGQNY

SEQ ID NO: 22690 - protein, 12 aa, Neisseria
PIPQQQAGKVEV

SEQ ID NO: 22691 - protein, 12 aa, Neisseria
KHAKSFKDDMYL

SEQ ID NO: 22692 - protein, 10 aa, Neisseria
AAADSKDVAN

SEQ ID NO: 22693 - protein, 12 aa, Neisseria
QKIKLQEPEVLK

SEQ ID NO: 22694 - protein, 8 aa, Neisseria
TAFDGKKV

SEQ ID NO: 22695 - protein, 17 aa, Neisseria
ESPESQARADKMQELTE

SEQ ID NO: 22696 - protein, 7 aa, Neisseria
FQIDGTP

SEQ ID NO: 22697 - protein, 11 aa, Neisseria
VGGKYKVEFAD

SEQ ID NO: 22698 - protein, 6 aa, Neisseria
ESGMNT

SEQ ID NO: 22699 - protein, 13 aa, Neisseria
LADKVREEQKAAH

SEQ ID NO: 22700 - protein, 5 aa, Neisseria
MKSKH

SEQ ID NO: 22701 - protein, 7 aa, Neisseria
CDSKVQT

SEQ ID NO: 22702 - protein, 7 aa, Neisseria
VPADSAP

SEQ ID NO: 22703 - protein, 7 aa, Neisseria
QAGKVEV

SEQ ID NO: 22704 - protein, 12 aa, Neisseria
KHAKSFKDDMYL

SEQ ID NO: 22705 - protein, 9 aa, Neisseria
AAADSKDVA

SEQ ID NO: 22706 - protein, 12 aa, Neisseria
QKIKLQEPEVLK

SEQ ID NO: 22707 - protein, 8 aa, Neisseria
TAFDGKKV

SEQ ID NO: 22708 - protein, 17 aa, Neisseria
ESPESQARADKMQELTE

SEQ ID NO: 22709 - protein, 9 aa, Neisseria
GKYKVEFAD

SEQ ID NO: 22710 - protein, 13 aa, Neisseria
LADKVREEQKAAH

SEQ ID NO: 22711 - protein, 7 aa, Neisseria
LSALLGL

SEQ ID NO: 22712 - protein, 8 aa, Neisseria
GNALQNAA

SEQ ID NO: 22713 - protein, 7 aa, Neisseria
YPSRFAQ

SEQ ID NO: 22714 - protein, 5 aa, Neisseria
ISVNK

SEQ ID NO: 22715 - protein, 11 aa, Neisseria
IIQGNELEPRA

SEQ ID NO: 22716 - protein, 9 aa, Neisseria
LRPGMTKDQ

SEQ ID NO: 22717 - protein, 9 aa, Neisseria
AFHTDRWDY

SEQ ID NO: 22718 - protein, 13 aa, Neisseria
NTSRNGIIKDRSN

SEQ ID NO: 22719 - protein, 7 aa, Neisseria
VRTEGNA

SEQ ID NO: 22720 - protein, 15 aa, Neisseria
NAAEALRVKQNADKQ

SEQ ID NO: 22721 - protein, 7 aa, Neisseria
NELEPRA

SEQ ID NO: 22722 - protein, 6 aa, Neisseria
GMTKDQ

SEQ ID NO: 22723 - protein, 8 aa, Neisseria
GIIKDRSN

SEQ ID NO: 22724 - protein, 7 aa, Neisseria
VRTEGNA

SEQ ID NO: 22725 - protein, 15 aa, Neisseria
NAAEALRVKQNADKQ

SEQ ID NO: 22726 - protein, 9 aa, Neisseria
YPEMSEKLM

SEQ ID NO: 22727 - protein, 9 aa, Neisseria
VLMAMLVTL

SEQ ID NO: 22728 - protein, 9 aa, Neisseria
LPAIPEMAQ

SEQ ID NO: 22729 - protein, 8 aa, Neisseria
AFGQVVGG

SEQ ID NO: 22730 - protein, 5 aa, Neisseria
IKGRK

SEQ ID NO: 22731 - protein, 12 aa, Neisseria
LNLRVVQAFGAG

SEQ ID NO: 22732 - protein, 8 aa, Neisseria
FALIGIIL

SEQ ID NO: 22733 - protein, 18 aa, Neisseria
PMVGALLQGLGGWQAIFV

SEQ ID NO: 22734 - protein, 7 aa, Neisseria
LGLVQYF

SEQ ID NO: 22735 - protein, 6 aa, Neisseria
KIGRDV

SEQ ID NO: 22736 - protein, 6 aa, Neisseria
RFKRVL

SEQ ID NO: 22737 - protein, 7 aa, Neisseria
SFGSMFA

SEQ ID NO: 22738 - protein, 8 aa, Neisseria
MMFFNRIT

SEQ ID NO: 22739 - protein, 12 aa, Neisseria
AANLSQLAAVLF

SEQ ID NO: 22740 - protein, 10 aa, Neisseria
VLGVFQSLIG

SEQ ID NO: 22741 - protein, 6 aa, Neisseria
FRRRAV

SEQ ID NO: 22742 - protein, 8 aa, Neisseria
IGREFMPS

SEQ ID NO: 22743 - protein, 6 aa, Neisseria
EMSEKL

SEQ ID NO: 22744 - protein, 7 aa, Neisseria
DVHRIEQ

SEQ ID NO: 22745 - protein, 11 aa, Neisseria
SVSDIKGRKPV

SEQ ID NO: 22746 - protein, 12 aa, Neisseria
MVRDYYSGRKAA

SEQ ID NO: 22747 - protein, 14 aa, Neisseria
PKPAVGGKIGRDVF

SEQ ID NO: 22748 - protein, 10 aa, Neisseria
RFKRVLKTRA

SEQ ID NO: 22749 - protein, 6 aa, Neisseria
LKTGVH

SEQ ID NO: 22750 - protein, 7 aa, Neisseria
FKEEGGS

SEQ ID NO: 22751 - protein, 12 aa, Neisseria
RAWKENGQSEYL

SEQ ID NO: 22752 - protein, 6 aa, Neisseria
FRRRAV

SEQ ID NO: 22753 - protein, 6 aa, Neisseria
IGREFM

SEQ ID NO: 22754 - protein, 6 aa, Neisseria
EMSEKL

SEQ ID NO: 22755 - protein, 7 aa, Neisseria
DVHRIEQ

SEQ ID NO: 22756 - protein, 11 aa, Neisseria
SVSDIKGRKPV

SEQ ID NO: 22757 - protein, 8 aa, Neisseria
YYSGRKAA

SEQ ID NO: 22758 - protein, 6 aa, Neisseria
KIGRDV

SEQ ID NO: 22759 - protein, 10 aa, Neisseria
RFKRVLKTRA

SEQ ID NO: 22760 - protein, 7 aa, Neisseria
FKEEGGS

SEQ ID NO: 22761 - protein, 8 aa, Neisseria
RAWKENGQ

SEQ ID NO: 22762 - protein, 7 aa, Neisseria
ASSTASA

SEQ ID NO: 22763 - protein, 10 aa, Neisseria
SAPDNVKQAE

SEQ ID NO: 22764 - protein, 26 aa, Neisseria
VPPSNCTDLHPATGIDDLMQQIAEHI

SEQ ID NO: 22765 - protein, 8 aa, Neisseria
GYDNIQRL

SEQ ID NO: 22766 - protein, 10 aa, Neisseria
RTISRQAQDA

SEQ ID NO: 22767 - protein, 7 aa, Neisseria
PKRTRYF

SEQ ID NO: 22768 - protein, 14 aa, Neisseria
GNFQYIGQLPGYLK

SEQ ID NO: 22769 - protein, 6 aa, Neisseria
MKNKTS

SEQ ID NO: 22770 - protein, 13 aa, Neisseria
SPSKEDKTKENGA

SEQ ID NO: 22771 - protein, 10 aa, Neisseria
ASSSAPQTDL

SEQ ID NO: 22772 - protein, 30 aa, Neisseria
SAPDNVKQAESVPPSNCTDLHPATGIDDLM

SEQ ID NO: 22773 - protein, 7 aa, Neisseria
EHIDSDC

SEQ ID NO: 22774 - protein, 7 aa, Neisseria
HELETRF

SEQ ID NO: 22775 - protein, 10 aa, Neisseria
LPGGGYDNIQ

SEQ ID NO: 22776 - protein, 12 aa, Neisseria
PDIRPEDPDYHQ

SEQ ID NO: 22777 - protein, 15 aa, Neisseria
EDLRYGKRTISRQAQ

SEQ ID NO: 22778 - protein, 11 aa, Neisseria
ALMEQERRLRE

SEQ ID NO: 22779 - protein, 18 aa, Neisseria
QGSQETRGQGEEPKRTRY

SEQ ID NO: 22780 - protein, 17 aa, Neisseria
SATPAYSSRHNNGLGGN

SEQ ID NO: 22781 - protein, 10 aa, Neisseria
HGEMLENQSL

SEQ ID NO: 22782 - protein, 14 aa, Neisseria
RLSNRERNPDKPFL

SEQ ID NO: 22783 - protein, 9 aa, Neisseria
HFDENGKIT

SEQ ID NO: 22784 - protein, 15 aa, Neisseria
VYEKNIYFNPNLGRR

SEQ ID NO: 22785 - protein, 5 aa, Neisseria
MKNKT

SEQ ID NO: 22786 - protein, 13 aa, Neisseria
SPSKEDKTKENGA

SEQ ID NO: 22787 - protein, 7 aa, Neisseria
SAPQTDL

SEQ ID NO: 22788 - protein, 13 aa, Neisseria
SAPDNVKQAESVP

SEQ ID NO: 22789 - protein, 6 aa, Neisseria
GIDDLM

SEQ ID NO: 22790 - protein, 5 aa, Neisseria
EHIDS

SEQ ID NO: 22791 - protein, 5 aa, Neisseria
HELET

SEQ ID NO: 22792 - protein, 9 aa, Neisseria
IRPEDPDYH

SEQ ID NO: 22793 - protein, 15 aa, Neisseria
EDLRYGKRTISRQAQ

SEQ ID NO: 22794 - protein, 11 aa, Neisseria
ALMEQERRLRE

SEQ ID NO: 22795 - protein, 17 aa, Neisseria
GSQETRGQGEEPKRTRY

SEQ ID NO: 22796 - protein, 7 aa, Neisseria
YSSRHNN

SEQ ID NO: 22797 - protein, 6 aa, Neisseria
HGEMLE

SEQ ID NO: 22798 - protein, 12 aa, Neisseria
LSNRERNPDKPF

SEQ ID NO: 22799 - protein, 9 aa, Neisseria
HFDENGKIT

SEQ ID NO: 22800 - protein, 5 aa, Neisseria
KPAAS

SEQ ID NO: 22801 - protein, 9 aa, Neisseria
HNELRKIRA

SEQ ID NO: 22802 - protein, 5 aa, Neisseria
RYLSG

SEQ ID NO: 22803 - protein, 5 aa, Neisseria
CRFAK

SEQ ID NO: 22804 - protein, 28 aa, Neisseria
LNDFQPNCDIRRLGLTQGQHNELRKIRA

SEQ ID NO: 22805 - protein, 12 aa, Neisseria
MAGDRARLKVMH

SEQ ID NO: 22806 - protein, 8 aa, Neisseria
EHSRRRSV

SEQ ID NO: 22807 - protein, 32 aa, Neisseria; identical to SEQ ID NO: 9604

SEQ ID NO: 22808 - protein, 6 aa, Neisseria
TPQQQQ

SEQ ID NO: 22809 - protein, 5 aa, Neisseria
SSCLK

SEQ ID NO: 22810 - protein, 7 aa, Neisseria
CDIRRLG

SEQ ID NO: 22811 - protein, 10 aa, Neisseria
QHNELRKIRA

SEQ ID NO: 22812 - protein, 12 aa, Neisseria
MAGDRARLKVMH

SEQ ID NO: 22813 - protein, 8 aa, Neisseria
EHSRRRSV

SEQ ID NO: 22814 - protein, 12 aa, Neisseria
VFNRNEARDYVE

SEQ ID NO: 22815 - protein, 8 aa, Neisseria
FAVDELEI

SEQ ID NO: 22816 - protein, 13 aa, Neisseria
CRCSESIRRIRRN

SEQ ID NO: 22817 - protein, 12 aa, Neisseria
LGYVFKPLAVFV

SEQ ID NO: 22818 - protein, 7 aa, Neisseria
QGFGQLH

SEQ ID NO: 22819 - protein, 8 aa, Neisseria
TRQLRGFK

SEQ ID NO: 22820 - protein, 9 aa, Neisseria
FDVFQVFGN

SEQ ID NO: 22821 - protein, 6 aa, Neisseria
QFVEHH

SEQ ID NO: 22822 - protein, 26 aa, Neisseria
DAGEVGRVVGRGYGAAVFDFFQRFQL

SEQ ID NO: 22823 - protein, 15 aa, Neisseria
VQSQRRGRHLEDFGD

SEQ ID NO: 22824 - protein, 10 aa, Neisseria
VGKLDQFDGV

SEQ ID NO: 22825 - protein, 9 aa, Neisseria
FDHIAEVAD

SEQ ID NO: 22826 - protein, 32 aa, Neisseria; identical to SEQ ID NO: 9623

SEQ ID NO: 22827 - protein, 16 aa, Neisseria
GGFDGRPVDIGKARFL

SEQ ID NO: 22828 - protein, 7 aa, Neisseria
AVDDGKI

SEQ ID NO: 22829 - protein, 15 aa, Neisseria
ATRQLRGFKLDDFDV

SEQ ID NO: 22830 - protein, 10 aa, Neisseria
RFGCGQRIDA

SEQ ID NO: 22831 - protein, 16 aa, Neisseria
HHQDAGEVGRVVGRGY

SEQ ID NO: 22832 - protein, 16 aa, Neisseria
RVQSQRRGRHLEDFGD

SEQ ID NO: 22833 - protein, 5 aa, Neisseria
EDVDV

SEQ ID NO: 22834 - protein, 8 aa, Neisseria
GKLDQFDG

SEQ ID NO: 22835 - protein, 14 aa, Neisseria
AEVADGRAEDDFFF

SEQ ID NO: 22836 - protein, 13 aa, Neisseria
AVVGGGRSGCGGR

SEQ ID NO: 22837 - protein, 18 aa, Neisseria
AAGGEDERECGGGKGFEE

SEQ ID NO: 22838 - protein, 27 aa, Neisseria
RCSESIRRIRRNGREWRIKGQKCRLNT

SEQ ID NO: 22839 - protein, 10 aa, Neisseria
FDGRPVDIGK

SEQ ID NO: 22840 - protein, 7 aa, Neisseria
AVDDGKI

SEQ ID NO: 22841 - protein, 14 aa, Neisseria
ATRQLRGFKLDDFD

SEQ ID NO: 22842 - protein, 13 aa, Neisseria
HHQDAGEVGRVVG

SEQ ID NO: 22843 - protein, 14 aa, Neisseria
QSQRRGRHLEDFGD

SEQ ID NO: 22844 - protein, 5 aa, Neisseria
EDVDV

SEQ ID NO: 22845 - protein, 7 aa, Neisseria
GKLDQFD

SEQ ID NO: 22846 - protein, 14 aa, Neisseria
AEVADGRAEDDFFF

SEQ ID NO: 22847 - protein, 7 aa, Neisseria
GGRSGCG

SEQ ID NO: 22848 - protein, 10 aa, Neisseria
GGEDERECGG

SEQ ID NO: 22849 - protein, 5 aa, Neisseria
KGFEE

SEQ ID NO: 22850 - protein, 6 aa, Neisseria
RGRACR

SEQ ID NO: 22851 - protein, 6 aa, Neisseria
CRHFAQ

SEQ ID NO: 22852 - protein, 7 aa, Neisseria
VAVGRIG

SEQ ID NO: 22853 - protein, 6 aa, Neisseria
FCQLFD

SEQ ID NO: 22854 - protein, 5 aa, Neisseria
DIFLV

SEQ ID NO: 22855 - protein, 6 aa, Neisseria
IADIGE

SEQ ID NO: 22856 - protein, 14 aa, Neisseria
RGLADIGEFVGVSD

SEQ ID NO: 22857 - protein, 8 aa, Neisseria
HQRASRIK

SEQ ID NO: 22858 - protein, 11 aa, Neisseria
RARRHFRQVFN

SEQ ID NO: 22859 - protein, 6 aa, Neisseria
DFVAHI

SEQ ID NO: 22860 - protein, 5 aa, Neisseria
AARIG

SEQ ID NO: 22861 - protein, 14 aa, Neisseria
SASGTRQKCRLKPV

SEQ ID NO: 22862 - protein, 8 aa, Neisseria
PKHSTPAS

SEQ ID NO: 22863 - protein, 7 aa, Neisseria
GQDEHNA

SEQ ID NO: 22864 - protein, 6 aa, Neisseria
PPSAYG

SEQ ID NO: 22865 - protein, 10 aa, Neisseria
HFGRGRACRY

SEQ ID NO: 22866 - protein, 9 aa, Neisseria
RIDSARCRH

SEQ ID NO: 22867 - protein, 10 aa, Neisseria
RIGRTDHNHD

SEQ ID NO: 22868 - protein, 12 aa, Neisseria
FDGGLPVGRRIA

SEQ ID NO: 22869 - protein, 15 aa, Neisseria
ADIGETRVQRGDDVF

SEQ ID NO: 22870 - protein, 9 aa, Neisseria
IDRERGLAD

SEQ ID NO: 22871 - protein, 23 aa, Neisseria
HISDRFDQKHFARRKLPHRSFDL

SEQ ID NO: 22872 - protein, 9 aa, Neisseria
LMPDHDDFT

SEQ ID NO: 22873 - protein, 15 aa, Neisseria
RHQRASRIKHAETAL

SEQ ID NO: 22874 - protein, 8 aa, Neisseria
LPHRLRYA

SEQ ID NO: 22875 - protein, 9 aa, Neisseria
NQCRARRHF

SEQ ID NO: 22876 - protein, 7 aa, Neisseria
VFNKHRT

SEQ ID NO: 22877 - protein, 7 aa, Neisseria
INRRAEL

SEQ ID NO: 22878 - protein, 8 aa, Neisseria
TFDNTDCP

SEQ ID NO: 22879 - protein, 14 aa, Neisseria
TSAEAARIGKDDGF

SEQ ID NO: 22880 - protein, 16 aa, Neisseria
YGGRCCPTPPTPHRRR

SEQ ID NO: 22881 - protein, 11 aa, Neisseria
SGTRQKCRLKP

SEQ ID NO: 22882 - protein, 7 aa, Neisseria
GQDEHNA

SEQ ID NO: 22883 - protein, 7 aa, Neisseria
GRGRACR

SEQ ID NO: 22884 - protein, 9 aa, Neisseria
RIDSARCRH

SEQ ID NO: 22885 - protein, 9 aa, Neisseria
RIGRTDHNH

SEQ ID NO: 22886 - protein, 6 aa, Neisseria
VGRRIA

SEQ ID NO: 22887 - protein, 13 aa, Neisseria
ADIGETRVQRGDD

SEQ ID NO: 22888 - protein, 9 aa, Neisseria
IDRERGLAD

SEQ ID NO: 22889 - protein, 23 aa, Neisseria
HISDRFDQKHFARRKLPHRSFDL

SEQ ID NO: 22890 - protein, 5 aa, Neisseria
PDHDD

SEQ ID NO: 22891 - protein, 15 aa, Neisseria
RHQRASRIKHAETAL

SEQ ID NO: 22892 - protein, 9 aa, Neisseria
NQCRARRHF

SEQ ID NO: 22893 - protein, 5 aa, Neisseria
FNKHR

SEQ ID NO: 22894 - protein, 7 aa, Neisseria
INRRAEL

SEQ ID NO: 22895 - protein, 5 aa, Neisseria
FDNTD

SEQ ID NO: 22896 - protein, 11 aa, Neisseria
AEAARIGKDDG

SEQ ID NO: 22897 - protein, 6 aa, Neisseria
TPHRRR

SEQ ID NO: 22898 - protein, 17 aa, Neisseria
HPQRFSKPAERYADCPH

SEQ ID NO: 22899 - protein, 8 aa, Neisseria
CSSPVSRN

SEQ ID NO: 22900 - protein, 5 aa, Neisseria
DRLDY

SEQ ID NO: 22901 - protein, 8 aa, Neisseria
VRLSNEVE

SEQ ID NO: 22902 - protein, 5 aa, Neisseria
ALEHA

SEQ ID NO: 22903 - protein, 5 aa, Neisseria
VQKLD

SEQ ID NO: 22904 - protein, 18 aa, Neisseria
VETAQNLYNQALKHYKSG

SEQ ID NO: 22905 - protein, 8 aa, Neisseria
AASLLKGA

SEQ ID NO: 22906 - protein, 7 aa, Neisseria
CESVIEI

SEQ ID NO: 22907 - protein, 8 aa, Neisseria
YANRFKDS

SEQ ID NO: 22908 - protein, 14 aa, Neisseria
ARATWRSLIQTYPG

SEQ ID NO: 22909 - protein, 9 aa, Neisseria
CPARRHHCH

SEQ ID NO: 22910 - protein, 12 aa, Neisseria
FVERKGDARSGF

SEQ ID NO: 22911 - protein, 41 aa, Neisseria
AAQRRHPQRFSKPAERYADCPHHPARRRRFDPASEKIMKTK

SEQ ID NO: 22912 - protein, 26 aa, Neisseria
SPVSRNIQDMRLEPQAEAGSSDAIPY

SEQ ID NO: 22913 - protein, 7 aa, Neisseria
LQDRLDY

SEQ ID NO: 22914 - protein, 38 aa, Neisseria
LSNEVETLNGKVKALEHAKTHPSSRAYVQKLDDRKLKE

SEQ ID NO: 22915 - protein, 9 aa, Neisseria
YLNTEGGSA

SEQ ID NO: 22916 - protein, 10 aa, Neisseria
ALKHYKSGRF

SEQ ID NO: 22917 - protein, 13 aa, Neisseria
KGADGGDGGSIAQ

SEQ ID NO: 22918 - protein, 9 aa, Neisseria
QSRARMGNC

SEQ ID NO: 22919 - protein, 16 aa, Neisseria
IGGRYANRFKDSPTAP

SEQ ID NO: 22920 - protein, 5 aa, Neisseria
GECQY

SEQ ID NO: 22921 - protein, 7 aa, Neisseria
LQQKDIA

SEQ ID NO: 22922 - protein, 17 aa, Neisseria
YPGSPAAKRAAAAVRKR

SEQ ID NO: 22923 - protein, 8 aa, Neisseria
CPARRHHC

SEQ ID NO: 22924 - protein, 12 aa, Neisseria
FVERKGDARSGF

SEQ ID NO: 22925 - protein, 19 aa, Neisseria
AAQRRHPQRFSKPAERYAD

SEQ ID NO: 22926 - protein, 21 aa, Neisseria
PHHPARRRRFDPASEKIMKTK

SEQ ID NO: 22927 - protein, 21 aa, Neisseria
PVSRNIQDMRLEPQAEAGSSD

SEQ ID NO: 22928 - protein, 7 aa, Neisseria
LQDRLDY

SEQ ID NO: 22929 - protein, 24 aa, Neisseria
LSNEVETLNGKVKALEHAKTHPSS

SEQ ID NO: 22930 - protein, 12 aa, Neisseria
YVQKLDDRKLKE

SEQ ID NO: 22931 - protein, 8 aa, Neisseria
KHYKSGRF

SEQ ID NO: 22932 - protein, 13 aa, Neisseria
KGADGGDGGSIAQ

SEQ ID NO: 22933 - protein, 7 aa, Neisseria
SRARMGN

SEQ ID NO: 22934 - protein, 12 aa, Neisseria
YANRFKDSPTAP

SEQ ID NO: 22935 - protein, 5 aa, Neisseria
GECQY

SEQ ID NO: 22936 - protein, 7 aa, Neisseria
LQQKDIA

SEQ ID NO: 22937 - protein, 13 aa, Neisseria
PAAKRAAAAVRKR

SEQ ID NO: 22938 - protein, 27 aa, Neisseria
FGGIFHFVCRFLSRVGSFVQSIFSCFS

SEQ ID NO: 22939 - protein, 6 aa, Neisseria
IFDLVF

SEQ ID NO: 22940 - protein, 14 aa, Neisseria
GLNRFLNLLFGFLR

SEQ ID NO: 22941 - protein, 6 aa, Neisseria
CQGNKL

SEQ ID NO: 22942 - protein, 14 aa, Neisseria
FDGRSGRLGGRSRS

SEQ ID NO: 22943 - protein, 13 aa, Neisseria
TSCQGSRHHCGNQ

SEQ ID NO: 22944 - protein, 14 aa, Neisseria
FDGRSGRLGGRSRS

SEQ ID NO: 22945 - protein, 9 aa, Neisseria
SCQGSRHHC

SEQ ID NO: 22946 - protein, 19 aa, Neisseria
TLLSVLIPMFAGFFIRVPK

SEQ ID NO: 22947 - protein, 11 aa, Neisseria
LPALDKVLSVL

SEQ ID NO: 22948 - protein, 8 aa, Neisseria
RVEDLGSR

SEQ ID NO: 22949 - protein, 8 aa, Neisseria
ALAVLGKL

SEQ ID NO: 22950 - protein, 6 aa, Neisseria
SWVKGL

SEQ ID NO: 22951 - protein, 8 aa, Neisseria
WYSLSGLV

SEQ ID NO: 22952 - protein, 18 aa, Neisseria
YGAVWGSIALLNDLAREL

SEQ ID NO: 22953 - protein, 6 aa, Neisseria
RGAGGL

SEQ ID NO: 22954 - protein, 7 aa, Neisseria
RVPKPYL

SEQ ID NO: 22955 - protein, 14 aa, Neisseria
SRVEDLGSRLDDMA

SEQ ID NO: 22956 - protein, 10 aa, Neisseria
WRIKGKGKGV

SEQ ID NO: 22957 - protein, 7 aa, Neisseria
ASGKLMR

SEQ ID NO: 22958 - protein, 8 aa, Neisseria
MPSENAGM

SEQ ID NO: 22959 - protein, 8 aa, Neisseria
LKSSGVSL

SEQ ID NO: 22960 - protein, 9 aa, Neisseria
LVNRRGIRL

SEQ ID NO: 22961 - protein, 5 aa, Neisseria
RFPDA

SEQ ID NO: 22962 - protein, 7 aa, Neisseria
GAGGLEA

SEQ ID NO: 22963 - protein, 14 aa, Neisseria
SRVEDLGSRLDDMA

SEQ ID NO: 22964 - protein, 8 aa, Neisseria
IKGKGKGV

SEQ ID NO: 22965 - protein, 7 aa, Neisseria
LKSSGVS

SEQ ID NO: 22966 - protein, 8 aa, Neisseria
LVNRRGIR

SEQ ID NO: 22967 - protein, 5 aa, Neisseria
FQVAG

SEQ ID NO: 22968 - protein, 13 aa, Neisseria
PNSFASFKRFSSI

SEQ ID NO: 22969 - protein, 8 aa, Neisseria
QSTPSSPT

SEQ ID NO: 22970 - protein, 6 aa, Neisseria
TSPEAG

SEQ ID NO: 22971 - protein, 7 aa, Neisseria
KRFSSIS

SEQ ID NO: 22972 - protein, 7 aa, Neisseria
GKADIPT

SEQ ID NO: 22973 - protein, 11 aa, Neisseria
KASLNNRATSS

SEQ ID NO: 22974 - protein, 7 aa, Neisseria
SGSGTRL

SEQ ID NO: 22975 - protein, 5 aa, Neisseria
GKADI

SEQ ID NO: 22976 - protein, 8 aa, Neisseria
SLNNRATS

SEQ ID NO: 22977 - protein, 7 aa, Neisseria
CSGLVTV

SEQ ID NO: 22978 - protein, 5 aa, Neisseria
KISRG

SEQ ID NO: 22979 - protein, 7 aa, Neisseria
MPCSKAS

SEQ ID NO: 22980 - protein, 10 aa, Neisseria
LARDSCSPGL

SEQ ID NO: 22981 - protein, 6 aa, Neisseria
TAPASS

SEQ ID NO: 22982 - protein, 18 aa, Neisseria
LAIRRMASRPTGVRRVIS

SEQ ID NO: 22983 - protein, 14 aa, Neisseria
GMPPSTRAWDKSMA

SEQ ID NO: 22984 - protein, 7 aa, Neisseria
KISRGVS

SEQ ID NO: 22985 - protein, 5 aa, Neisseria
RWDRL

SEQ ID NO: 22986 - protein, 6 aa, Neisseria
ARDSCS

SEQ ID NO: 22987 - protein, 17 aa, Neisseria
AIRRMASRPTGVRRVIS

SEQ ID NO: 22988 - protein, 5 aa, Neisseria
RAWDK

SEQ ID NO: 22989 - protein, 5 aa, Neisseria
RWDRL

SEQ ID NO: 22990 - protein, 8 aa, Neisseria
QTLATVNG

SEQ ID NO: 22991 - protein, 10 aa, Neisseria
EVVNTVVAQE

SEQ ID NO: 22992 - protein, 6 aa, Neisseria
LDRSAE

SEQ ID NO: 22993 - protein, 12 aa, Neisseria
AAYDNISGFYKG

SEQ ID NO: 22994 - protein, 5 aa, Neisseria
FDAVL

SEQ ID NO: 22995 - protein, 22 aa, Neisseria
VPLKDLEQGVPPLYQAIKDLKK

SEQ ID NO: 22996 - protein, 5 aa, Neisseria
VPSFD

SEQ ID NO: 22997 - protein, 9 aa, Neisseria
RIDRAVGAL

SEQ ID NO: 22998 - protein, 5 aa, Neisseria
MKAKI

SEQ ID NO: 22999 - protein, 10 aa, Neisseria
VNGQKIDSSV

SEQ ID NO: 23000 - protein, 15 aa, Neisseria
FRAENSRAEDTPQLR

SEQ ID NO: 23001 - protein, 38 aa, Neisseria; identical to SEQ ID NO: 9797

SEQ ID NO: 23002 - protein, 14 aa, Neisseria
KTQPVSEQEVKAAY

SEQ ID NO: 23003 - protein, 14 aa, Neisseria
NISGFYKGTQEVQL

SEQ ID NO: 23004 - protein, 22 aa, Neisseria
ILTDKEENAKKAVADLKAKKGF

SEQ ID NO: 23005 - protein, 15 aa, Neisseria
YSLNDRTKQTGAPVG

SEQ ID NO: 23006 - protein, 9 aa, Neisseria
KDLEQGVPP

SEQ ID NO: 23007 - protein, 18 aa, Neisseria
KDLKKGEFTATPLKNGDF

SEQ ID NO: 23008 - protein, 18 aa, Neisseria
YVNDSREVKVPSFDEMKG

SEQ ID NO: 23009 - protein, 10 aa, Neisseria
LQAERIDRAV

SEQ ID NO: 23010 - protein, 7 aa, Neisseria
ANIKPAK

SEQ ID NO: 23011 - protein, 5 aa, Neisseria
MKAKI

SEQ ID NO: 23012 - protein, 7 aa, Neisseria
QKIDSSV

SEQ ID NO: 23013 - protein, 15 aa, Neisseria
FRAENSRAEDTPQLR

SEQ ID NO: 23014 - protein, 36 aa, Neisseria; identical to SEQ ID NO: 9810

SEQ ID NO: 23015 - protein, 12 aa, Neisseria
QPVSEQEVKAAY

SEQ ID NO: 23016 - protein, 22 aa, Neisseria
ILTDKEENAKKAVADLKAKKGF

SEQ ID NO: 23017 - protein, 10 aa, Neisseria
SLNDRTKQTG

SEQ ID NO: 23018 - protein, 5 aa, Neisseria
KDLEQ

SEQ ID NO: 23019 - protein, 8 aa, Neisseria
KDLKKGEF

SEQ ID NO: 23020 - protein, 16 aa, Neisseria
NDSREVKVPSFDEMKG

SEQ ID NO: 23021 - protein, 10 aa, Neisseria
LQAERIDRAV

SEQ ID NO: 23022 - protein, 7 aa, Neisseria
ANIKPAK

SEQ ID NO: 23023 - protein, 15 aa, Neisseria
GCQAVAQSIIDAGLG

SEQ ID NO: 23024 - protein, 23 aa, Neisseria
QEILDQIRLYDLPEVQSDFVETH

SEQ ID NO: 23025 - protein, 5 aa, Neisseria
LGMMQ

SEQ ID NO: 23026 - protein, 14 aa, Neisseria
LQILHWGGFLMVLP

SEQ ID NO: 23027 - protein, 8 aa, Neisseria
QGALRDLK

SEQ ID NO: 23028 - protein, 12 aa, Neisseria
AIIMTFIAGVYS

SEQ ID NO: 23029 - protein, 7 aa, Neisseria
FMEHIAR

SEQ ID NO: 23030 - protein, 28 aa, Neisseria
AGDAAERLVKLIPAFCHHMPDYPDTQET

SEQ ID NO: 23031 - protein, 17 aa, Neisseria
GGTRLSHIVRLLDRALA

SEQ ID NO: 23032 - protein, 6 aa, Neisseria
ELAEQY

SEQ ID NO: 23033 - protein, 7 aa, Neisseria
AIETLAQ

SEQ ID NO: 23034 - protein, 5 aa, Neisseria
ISLLR

SEQ ID NO: 23035 - protein, 9 aa, Neisseria
LNRIGEGVG

SEQ ID NO: 23036 - protein, 13 aa, Neisseria
LKDSAAEAVRQLA

SEQ ID NO: 23037 - protein, 8 aa, Neisseria
ETARALGV

SEQ ID NO: 23038 - protein, 9 aa, Neisseria
EYVKALQKE

SEQ ID NO: 23039 - protein, 10 aa, Neisseria
DLRTVAHLLD

SEQ ID NO: 23040 - protein, 12 aa, Neisseria
AVLGYVQPWIAA

SEQ ID NO: 23041 - protein, 5 aa, Neisseria
LAVLG

SEQ ID NO: 23042 - protein, 7 aa, Neisseria
ALRLHKR

SEQ ID NO: 23043 - protein, 5 aa, Neisseria
MKKTC

SEQ ID NO: 23044 - protein, 7 aa, Neisseria
GLDVPEN

SEQ ID NO: 23045 - protein, 11 aa, Neisseria
RYENEDRETCC

SEQ ID NO: 23046 - protein, 24 aa, Neisseria
LGSYYKQRTADAQKTELPPQEILD

SEQ ID NO: 23047 - protein, 17 aa, Neisseria
PEVQSDFVETHGGTREA

SEQ ID NO: 23048 - protein, 9 aa, Neisseria
QLLRTDGIV

SEQ ID NO: 23049 - protein, 8 aa, Neisseria
LNYSTHRC

SEQ ID NO: 23050 - protein, 10 aa, Neisseria
VVWDDGKIRL

SEQ ID NO: 23051 - protein, 18 aa, Neisseria
PYDAQKIEAANQKERKQY

SEQ ID NO: 23052 - protein, 9 aa, Neisseria
YGGDIEPDF

SEQ ID NO: 23053 - protein, 16 aa, Neisseria
ALRDLKNRRVGMDTPI

SEQ ID NO: 23054 - protein, 14 aa, Neisseria
IARRKAGDAAERLV

SEQ ID NO: 23055 - protein, 12 aa, Neisseria
MPDYPDTQETCE

SEQ ID NO: 23056 - protein, 9 aa, Neisseria
AVVKLKAGD

SEQ ID NO: 23057 - protein, 12 aa, Neisseria
KPGETIPVDGTV

SEQ ID NO: 23058 - protein, 8 aa, Neisseria
GSSAVNES

SEQ ID NO: 23059 - protein, 5 aa, Neisseria
LTGES

SEQ ID NO: 23060 - protein, 9 aa, Neisseria
KMPSEKVTA

SEQ ID NO: 23061 - protein, 11 aa, Neisseria
IRTDRTGGGTR

SEQ ID NO: 23062 - protein, 13 aa, Neisseria
ALAQKPRTAELAE

SEQ ID NO: 23063 - protein, 7 aa, Neisseria
TLAREGI

SEQ ID NO: 23064 - protein, 6 aa, Neisseria
GGKQAI

SEQ ID NO: 23065 - protein, 17 aa, Neisseria
IFDKTGTLTQGKPAVRR

SEQ ID NO: 23066 - protein, 10 aa, Neisseria
SLLRGTDEAF

SEQ ID NO: 23067 - protein, 9 aa, Neisseria
LEQQSEHPL

SEQ ID NO: 23068 - protein, 9 aa, Neisseria
CRISDGSVP

SEQ ID NO: 23069 - protein, 14 aa, Neisseria
IAIKQRLNRIGEGV

SEQ ID NO: 23070 - protein, 6 aa, Neisseria
VNGETQ

SEQ ID NO: 23071 - protein, 15 aa, Neisseria
AEISGKEPQTEGGGS

SEQ ID NO: 23072 - protein, 14 aa, Neisseria
LQDPLKDSAAEAVR

SEQ ID NO: 23073 - protein, 6 aa, Neisseria
LAGKNL

SEQ ID NO: 23074 - protein, 10 aa, Neisseria
ILSGDRETAV

SEQ ID NO: 23075 - protein, 9 aa, Neisseria
AMPEDKLEY

SEQ ID NO: 23076 - protein, 9 aa, Neisseria
KALQKEGKK

SEQ ID NO: 23077 - protein, 7 aa, Neisseria
GDGINDA

SEQ ID NO: 23078 - protein, 13 aa, Neisseria
AAGGTDIARDGAD

SEQ ID NO: 23079 - protein, 5 aa, Neisseria
EDLRT

SEQ ID NO: 23080 - protein, 10 aa, Neisseria
DQARRTRHII

SEQ ID NO: 23081 - protein, 17 aa, Neisseria
RLHKRGKMQSEKMPSEQ

SEQ ID NO: 23082 - protein, 5 aa, Neisseria
MKKTC

SEQ ID NO: 23083 - protein, 10 aa, Neisseria
RYENEDRETC

SEQ ID NO: 23084 - protein, 15 aa, Neisseria
YKQRTADAQKTELPP

SEQ ID NO: 23085 - protein, 9 aa, Neisseria
PEVQSDFVE

SEQ ID NO: 23086 - protein, 7 aa, Neisseria
HGGTREA

SEQ ID NO: 23087 - protein, 9 aa, Neisseria
QLLRTDGIV

SEQ ID NO: 23088 - protein, 10 aa, Neisseria
VVWDDGKIRL

SEQ ID NO: 23089 - protein, 16 aa, Neisseria
DAQKIEAANQKERKQY

SEQ ID NO: 23090 - protein, 7 aa, Neisseria
GDIEPDF

SEQ ID NO: 23091 - protein, 12 aa, Neisseria
ALRDLKNRRVGM

SEQ ID NO: 23092 - protein, 14 aa, Neisseria
IARRKAGDAAERLV

SEQ ID NO: 23093 - protein, 10 aa, Neisseria
DYPDTQETCE

SEQ ID NO: 23094 - protein, 9 aa, Neisseria
AVVKLKAGD

SEQ ID NO: 23095 - protein, 7 aa, Neisseria
MPSEKVT

SEQ ID NO: 23096 - protein, 11 aa, Neisseria
IRTDRTGGGTR

SEQ ID NO: 23097 - protein, 13 aa, Neisseria
ALAQKPRTAELAE

SEQ ID NO: 23098 - protein, 7 aa, Neisseria
TLAREGI

SEQ ID NO: 23099 - protein, 9 aa, Neisseria
TQGKPAVRR

SEQ ID NO: 23100 - protein, 5 aa, Neisseria
RGTDE

SEQ ID NO: 23101 - protein, 9 aa, Neisseria
LEQQSEHPL

SEQ ID NO: 23102 - protein, 7 aa, Neisseria
RISDGSV

SEQ ID NO: 23103 - protein, 12 aa, Neisseria
IAIKQRLNRIGE

SEQ ID NO: 23104 - protein, 12 aa, Neisseria
ISGKEPQTEGGG

SEQ ID NO: 23105 - protein, 12 aa, Neisseria
DPLKDSAAEAVR

SEQ ID NO: 23106 - protein, 8 aa, Neisseria
SGDRETAV

SEQ ID NO: 23107 - protein, 9 aa, Neisseria
AMPEDKLEY

SEQ ID NO: 23108 - protein, 9 aa, Neisseria
KALQKEGKK

SEQ ID NO: 23109 - protein, 8 aa, Neisseria
DIARDGAD

SEQ ID NO: 23110 - protein, 5 aa, Neisseria
EDLRT

SEQ ID NO: 23111 - protein, 10 aa, Neisseria
DQARRTRHII

SEQ ID NO: 23112 - protein, 17 aa, Neisseria
RLHKRGKMQSEKMPSEQ

SEQ ID NO: 23113 - protein, 6 aa, Neisseria
KILLKL

SEQ ID NO: 23114 - protein, 5 aa, Neisseria
DPIPA

SEQ ID NO: 23115 - protein, 12 aa, Neisseria
YMQTFRRIVAPQ

SEQ ID NO: 23116 - protein, 9 aa, Neisseria
NEFIGLFKN

SEQ ID NO: 23117 - protein, 12 aa, Neisseria
VVTVTELFRVAQ

SEQ ID NO: 23118 - protein, 5 aa, Neisseria
TANRT

SEQ ID NO: 23119 - protein, 7 aa, Neisseria
TETRADM

SEQ ID NO: 23120 - protein, 7 aa, Neisseria
VPKGQWE

SEQ ID NO: 23121 - protein, 6 aa, Neisseria
PPLSNE

SEQ ID NO: 23122 - protein, 10 aa, Neisseria
AQETANRTYD

SEQ ID NO: 23123 - protein, 12 aa, Neisseria
ARLEKRFDRYVA

SEQ ID NO: 23124 - protein, 7 aa, Neisseria
TETRADM

SEQ ID NO: 23125 - protein, 8 aa, Neisseria
AQETANRT

SEQ ID NO: 23126 - protein, 12 aa, Neisseria
ARLEKRFDRYVA

SEQ ID NO: 23127 - protein, 9 aa, Neisseria
LVSRWLNSY

SEQ ID NO: 23128 - protein, 7 aa, Neisseria
RLIHAVR

SEQ ID NO: 23129 - protein, 15 aa, Neisseria
IYSKAVERMLGTVIG

SEQ ID NO: 23130 - protein, 10 aa, Neisseria
TASALAGWAA

SEQ ID NO: 23131 - protein, 6 aa, Neisseria
RAMNVL

SEQ ID NO: 23132 - protein, 19 aa, Neisseria
LADNLTDCSKMIAEISNGR

SEQ ID NO: 23133 - protein, 8 aa, Neisseria
TRERLEEN

SEQ ID NO: 23134 - protein, 12 aa, Neisseria
MEAMQHAHRKIV

SEQ ID NO: 23135 - protein, 7 aa, Neisseria
ALAEHLH

SEQ ID NO: 23136 - protein, 9 aa, Neisseria
MNTSQRNRL

SEQ ID NO: 23137 - protein, 14 aa, Neisseria
SRWLNSYERYRYRR

SEQ ID NO: 23138 - protein, 7 aa, Neisseria
KAVERML

SEQ ID NO: 23139 - protein, 7 aa, Neisseria
HYFHGNL

SEQ ID NO: 23140 - protein, 6 aa, Neisseria
GKNGYV

SEQ ID NO: 23141 - protein, 9 aa, Neisseria
GDNGSEWFD

SEQ ID NO: 23142 - protein, 34 aa, Neisseria
NLTDCSKMIAEISNGRRMTRERLEENMAKMRQIN

SEQ ID NO: 23143 - protein, 19 aa, Neisseria
RMVKSRSHLAATSGESRIS

SEQ ID NO: 23144 - protein, 7 aa, Neisseria
AHRKIVN

SEQ ID NO: 23145 - protein, 16 aa, Neisseria
KLQSPKLNGSEIRLLD

SEQ ID NO: 23146 - protein, 21 aa, Neisseria
GRHARRIRIDTAINPELEALA

SEQ ID NO: 23147 - protein, 8 aa, Neisseria
STNMRQEI

SEQ ID NO: 23148 - protein, 16 aa, Neisseria
QRTRRKWLDAHERQHL

SEQ ID NO: 23149 - protein, 9 aa, Neisseria
SLLETREHS

SEQ ID NO: 23150 - protein, 7 aa, Neisseria
TSQRNRL

SEQ ID NO: 23151 - protein, 8 aa, Neisseria
YERYRYRR

SEQ ID NO: 23152 - protein, 7 aa, Neisseria
KAVERML

SEQ ID NO: 23153 - protein, 6 aa, Neisseria
NGSEWF

SEQ ID NO: 23154 - protein, 10 aa, Neisseria
NLTDCSKMIA

SEQ ID NO: 23155 - protein, 22 aa, Neisseria
SNGRRMTRERLEENMAKMRQIN

SEQ ID NO: 23156 - protein, 8 aa, Neisseria
RMVKSRSH

SEQ ID NO: 23157 - protein, 7 aa, Neisseria
TSGESRI

SEQ ID NO: 23158 - protein, 7 aa, Neisseria
AHRKIVN

SEQ ID NO: 23159 - protein, 16 aa, Neisseria
KLQSPKLNGSEIRLLD

SEQ ID NO: 23160 - protein, 8 aa, Neisseria
RHARRIRI

SEQ ID NO: 23161 - protein, 7 aa, Neisseria
PELEALA

SEQ ID NO: 23162 - protein, 6 aa, Neisseria
NMRQEI

SEQ ID NO: 23163 - protein, 16 aa, Neisseria
QRTRRKWLDAHERQHL

SEQ ID NO: 23164 - protein, 9 aa, Neisseria
SLLETREHS

SEQ ID NO: 23165 - protein, 8 aa, Neisseria
NLSRLQKA

SEQ ID NO: 23166 - protein, 13 aa, Neisseria
EQGLENLRRLPSV

SEQ ID NO: 23167 - protein, 8 aa, Neisseria
GGKTTGKY

SEQ ID NO: 23168 - protein, 7 aa, Neisseria
RYHEATE

SEQ ID NO: 23169 - protein, 10 aa, Neisseria
TRQTYKYIDD

SEQ ID NO: 23170 - protein, 11 aa, Neisseria
HKPKGFQTTNT

SEQ ID NO: 23171 - protein, 6 aa, Neisseria
  VARIANT 1: Xaa is any amino acid
XKETAF

SEQ ID NO: 23172 - protein, 12 aa, Neisseria
GSNNLSRLQKAA

SEQ ID NO: 23173 - protein, 9 aa, Neisseria
PQNMDSGIL

SEQ ID NO: 23174 - protein, 25 aa, Neisseria
  VARIANT 18: Xaa is any amino acid
RVSAGEIGDIRYEEKRDXKSAEGSI

SEQ ID NO: 23175 - protein, 15 aa, Neisseria
  VARIANT 6: Xaa is any amino acid
AFNNKXPLYRNKILN

SEQ ID NO: 23176 - protein, 20 aa, Neisseria
RDVEQGLENLRRLPSVKTDI

SEQ ID NO: 23177 - protein, 11 aa, Neisseria
IPSEEEGKSDL

SEQ ID NO: 23178 - protein, 9 aa, Neisseria
KWQQNKPIR

SEQ ID NO: 23179 - protein, 16 aa, Neisseria
IGIDDAGGKTTGKYQG

SEQ ID NO: 23180 - protein, 8 aa, Neisseria
  VARIANT 1: Xaa is any amino acid
XDNPLGLS

SEQ ID NO: 23181 - protein, 22 aa, Neisseria
  VARIANT 9: Xaa is any amino acid
LVHKTDLTXATGTETESGSRSY

SEQ ID NO: 23182 - protein, 27 aa, Neisseria
FNHNGHRYHEATEGYSVNYDYNGKQYQ

SEQ ID NO: 23183 - protein, 27 aa, Neisseria
QTYKYIDDAEIEVQRRRSAGWEAELRH

SEQ ID NO: 23184 - protein, 37 aa, Neisseria
  VARIANT (1)...(37): Xaa is any amino acid
QLDGKLSYKRGTGMRQSMPAPEENGGGTIPXXSRMKI

SEQ ID NO: 23185 - protein, 6 aa, Neisseria
QWNKTP

SEQ ID NO: 23186 - protein, 33 aa, Neisseria; identical to SEQ ID NO: 9986

SEQ ID NO: 23187 - protein, 11 aa, Neisseria
ADYGRVSGESA

SEQ ID NO: 23188 - protein, 5 aa, Neisseria
VSGKQ

SEQ ID NO: 23189 - protein, 9 aa, Neisseria
FRGGHKVGG

SEQ ID NO: 23190 - protein, 10 aa, Neisseria
KPLHKPKGFQ

SEQ ID NO: 23191 - protein, 6 aa, Neisseria
  VARIANT 1: Xaa is any amino acid
XKETAF

SEQ ID NO: 23192 - protein, 9 aa, Neisseria
NLSRLQKAA

SEQ ID NO: 23193 - protein, 19 aa, Neisseria
  VARIANT 13: Xaa is any amino acid
EIGDIRYEEKRDXKSAEGS

SEQ ID NO: 23194 - protein, 20 aa, Neisseria
RDVEQGLENLRRLPSVKTDI

SEQ ID NO: 23195 - protein, 10 aa, Neisseria
PSEEEGKSDL

SEQ ID NO: 23196 - protein, 14 aa, Neisseria
IGIDDAGGKTTGKY

SEQ ID NO: 23197 - protein, 7 aa, Neisseria
LVHKTDL

SEQ ID NO: 23198 - protein, 11 aa, Neisseria
TGTETESGSRS

SEQ ID NO: 23199 - protein, 7 aa, Neisseria
RYHEATE

SEQ ID NO: 23200 - protein, 17 aa, Neisseria
YIDDAEIEVQRRRSAGW

SEQ ID NO: 23201 - protein, 5 aa, Neisseria
AELRH

SEQ ID NO: 23202 - protein, 23 aa, Neisseria
GKLSYKRGTGMRQSMPAPEENGG

SEQ ID NO: 23203 - protein, 7 aa, Neisseria
  VARIANT (1)...(7): Xaa is any amino acid
XXSRMKI

SEQ ID NO: 23204 - protein, 7 aa, Neisseria
AQDKLSI

SEQ ID NO: 23205 - protein, 6 aa, Neisseria
GFDGEQ

SEQ ID NO: 23206 - protein, 9 aa, Neisseria
DYGRVSGES

SEQ ID NO: 23207 - protein, 7 aa, Neisseria
PLHKPKG

SEQ ID NO: 23208 - protein, 13 aa, Neisseria
PSRAEKANQVSNI

SEQ ID NO: 23209 - protein, 11 aa, Neisseria
ASIEDALKSDP

SEQ ID NO: 23210 - protein, 6 aa, Neisseria
IYQYLK

SEQ ID NO: 23211 - protein, 5 aa, Neisseria
AQESF

SEQ ID NO: 23212 - protein, 8 aa, Neisseria
NRPAESMA

SEQ ID NO: 23213 - protein, 5 aa, Neisseria
FDKAL

SEQ ID NO: 23214 - protein, 6 aa, Neisseria
IANLNK

SEQ ID NO: 23215 - protein, 8 aa, Neisseria
PAFKELAR

SEQ ID NO: 23216 - protein, 7 aa, Neisseria
KALGNAQ

SEQ ID NO: 23217 - protein, 9 aa, Neisseria
PFKPSKRIS

SEQ ID NO: 23218 - protein, 16 aa, Neisseria
ACSTSYRPSRAEKANQ

SEQ ID NO: 23219 - protein, 25 aa, Neisseria
  VARIANT 10: Xaa is any amino acid
YMRGQDYRQXTASIEDALKSDPKNE

SEQ ID NO: 23220 - protein, 11 aa, Neisseria
KVNDKAQESFR

SEQ ID NO: 23221 - protein, 14 aa, Neisseria
LSIKPDSAEINNNY

SEQ ID NO: 23222 - protein, 9 aa, Neisseria
CGRLNRPAE

SEQ ID NO: 23223 - protein, 9 aa, Neisseria
  VARIANT 9: Xaa is any amino acid
ALADPTYPX

SEQ ID NO: 23224 - protein, 11 aa, Neisseria
NKGICSAKQGQ

SEQ ID NO: 23225 - protein, 11 aa, Neisseria
PAFKELARTKM

SEQ ID NO: 23226 - protein, 23 aa, Neisseria
LGDADYYFKKYQSRVEVLQADDL

SEQ ID NO: 23227 - protein, 8 aa, Neisseria
FPYSEELQ

SEQ ID NO: 23228 - protein, 6 aa, Neisseria
KPSKRI

SEQ ID NO: 23229 - protein, 11 aa, Neisseria
YRPSRAEKANQ

SEQ ID NO: 23230 - protein, 25 aa, Neisseria
  VARIANT 10: Xaa is any amino acid
YMRGQDYRQXTASIEDALKSDPKNE

SEQ ID NO: 23231 - protein, 11 aa, Neisseria
KVNDKAQESFR

SEQ ID NO: 23232 - protein, 8 aa, Neisseria
IKPDSAEI

SEQ ID NO: 23233 - protein, 7 aa, Neisseria
RLNRPAE

SEQ ID NO: 23234 - protein, 7 aa, Neisseria
ICSAKQG

SEQ ID NO: 23235 - protein, 10 aa, Neisseria
AFKELARTKM

SEQ ID NO: 23236 - protein, 13 aa, Neisseria
YQSRVEVLQADDL

SEQ ID NO: 23237 - protein, 9 aa, Neisseria
SLLDMPRGE

SEQ ID NO: 23238 - protein, 10 aa, Neisseria
VVVALIAAMG

SEQ ID NO: 23239 - protein, 12 aa, Neisseria
PHMSIIAAIVVL

SEQ ID NO: 23240 - protein, 7 aa, Neisseria
ARGLKYN

SEQ ID NO: 23241 - protein, 10 aa, Neisseria
QGMIGALNQG

SEQ ID NO: 23242 - protein, 8 aa, Neisseria
SAFALCSV

SEQ ID NO: 23243 - protein, 8 aa, Neisseria
SLTTCATV

SEQ ID NO: 23244 - protein, 9 aa, Neisseria
  VARIANT 9: Xaa is any amino acid
KMSPLSDTX

SEQ ID NO: 23245 - protein, 14 aa, Neisseria
IDLFEHIKNMMYTT

SEQ ID NO: 23246 - protein, 6 aa, Neisseria
  VARIANT 3: Xaa is any amino acid
MLXLLP

SEQ ID NO: 23247 - protein, 8 aa, Neisseria
LNSVESFR

SEQ ID NO: 23248 - protein, 18 aa, Neisseria
TGLVHCYSLIPFALLVVL

SEQ ID NO: 23249 - protein, 14 aa, Neisseria
AMLFTVIAAVAVTY

SEQ ID NO: 23250 - protein, 11 aa, Neisseria
TPDLRQLGAWF

SEQ ID NO: 23251 - protein, 12 aa, Neisseria
  VARIANT (1)...(12): Xaa is any amino acid
XXDIAKLISRGG

SEQ ID NO: 23252 - protein, 16 aa, Neisseria
LGAIPSLLDAVRSFLT

SEQ ID NO: 23253 - protein, 5 aa, Neisseria
TFKPV

SEQ ID NO: 23254 - protein, 29 aa, Neisseria
  VARIANT 28: Xaa is any amino acid
RNLSRTLEDAGTVINPLVPWSVCGVFIXH

SEQ ID NO: 23255 - protein, 7 aa, Neisseria
DMPRGEA

SEQ ID NO: 23256 - protein, 9 aa, Neisseria
RGLKYNDMQ

SEQ ID NO: 23257 - protein, 16 aa, Neisseria
  VARIANT (1)...(16): Xaa is any amino acid
XXGXKMSPLSDTXGXS

SEQ ID NO: 23258 - protein, 11 aa, Neisseria
NSVESFRSQLE

SEQ ID NO: 23259 - protein, 7 aa, Neisseria
STPDLRQ

SEQ ID NO: 23260 - protein, 23 aa, Neisseria
  VARIANT (1)...(23): Xaa is any amino acid
GGYKLEGEAXXDIAKLISRGGLE

SEQ ID NO: 23261 - protein, 7 aa, Neisseria
  VARIANT 6: Xaa is any amino acid
TNAGRXT

SEQ ID NO: 23262 - protein, 29 aa, Neisseria
LSGETFKPVYDKLGLHSRNLSRTLEDAGT

SEQ ID NO: 23263 - protein, 7 aa, Neisseria
DMPRGEA

SEQ ID NO: 23264 - protein, 7 aa, Neisseria
LKYNDMQ

SEQ ID NO: 23265 - protein, 13 aa, Neisseria
  VARIANT (1)...(13): Xaa is any amino acid
XGXKMSPLSDTXG

SEQ ID NO: 23266 - protein, 8 aa, Neisseria
ESFRSQLE

SEQ ID NO: 23267 - protein, 5 aa, Neisseria
PDLRQ

SEQ ID NO: 23268 - protein, 15 aa, Neisseria
  VARIANT (1)...(15): Xaa is any amino acid
KLEGEAXXDIAKLIS

SEQ ID NO: 23269 - protein, 10 aa, Neisseria
NLSRTLEDAG

SEQ ID NO: 23270 - protein, 13 aa, Neisseria
KIRLMRELNKWSQ

SEQ ID NO: 23271 - protein, 6 aa, Neisseria
GYAKIE

SEQ ID NO: 23272 - protein, 19 aa, Neisseria
PRLEQLAQIFKIDMWDLLK

SEQ ID NO: 23273 - protein, 6 aa, Neisseria
CKEMLE

SEQ ID NO: 23274 - protein, 26 aa, Neisseria
METHEKIRLMRELNKWSQEDMAEKLA

SEQ ID NO: 23275 - protein, 17 aa, Neisseria
AKIERGETQLNIPRLEQ

SEQ ID NO: 23276 - protein, 7 aa, Neisseria
LKSGGGG

SEQ ID NO: 23277 - protein, 9 aa, Neisseria
NDVDTNSGE

SEQ ID NO: 23278 - protein, 7 aa, Neisseria
AQDASGK

SEQ ID NO: 23279 - protein, 25 aa, Neisseria
MELKHCKEMLEHKDKEIELLRKLTE

SEQ ID NO: 23280 - protein, 26 aa, Neisseria
METHEKIRLMRELNKWSQEDMAEKLA

SEQ ID NO: 23281 - protein, 8 aa, Neisseria
AKIERGET

SEQ ID NO: 23282 - protein, 5 aa, Neisseria
PRLEQ

SEQ ID NO: 23283 - protein, 8 aa, Neisseria
NDVDTNSG

SEQ ID NO: 23284 - protein, 25 aa, Neisseria
MELKHCKEMLEHKDKEIELLRKLTE

SEQ ID NO: 23285 - protein, 22 aa, Neisseria
AESYRNLTASEIAKVYTIARMT

SEQ ID NO: 23286 - protein, 9 aa, Neisseria
DLDMLNDIK

SEQ ID NO: 23287 - protein, 13 aa, Neisseria
SGQSFDDWRKGIL

SEQ ID NO: 23288 - protein, 27 aa, Neisseria
GKDIIDPATGEVFGSPRRLETIYRTNM

SEQ ID NO: 23289 - protein, 7 aa, Neisseria
GQYQGYM

SEQ ID NO: 23290 - protein, 5 aa, Neisseria
SAIDG

SEQ ID NO: 23291 - protein, 5 aa, Neisseria
VERQG

SEQ ID NO: 23292 - protein, 8 aa, Neisseria
SDNLVETH

SEQ ID NO: 23293 - protein, 11 aa, Neisseria
KYDRALAHQFA

SEQ ID NO: 23294 - protein, 9 aa, Neisseria
FKQLEKEFY

SEQ ID NO: 23295 - protein, 7 aa, Neisseria
QELAGMT

SEQ ID NO: 23296 - protein, 7 aa, Neisseria
SREGQNF

SEQ ID NO: 23297 - protein, 15 aa, Neisseria
DSYYAFLPDMLQNPE

SEQ ID NO: 23298 - protein, 13 aa, Neisseria
WAVLKYIKEVDEI

SEQ ID NO: 23299 - protein, 10 aa, Neisseria
RISNDKEIAK

SEQ ID NO: 23300 - protein, 9 aa, Neisseria
SLPPKKAIE

SEQ ID NO: 23301 - protein, 15 aa, Neisseria
LESKKVTAESYRNLT

SEQ ID NO: 23302 - protein, 7 aa, Neisseria
NDIKTSM

SEQ ID NO: 23303 - protein, 16 aa, Neisseria
ESAKSGQSFDDWRKGI

SEQ ID NO: 23304 - protein, 40 aa, Neisseria; identical to SEQ ID NO: 10106

SEQ ID NO: 23305 - protein, 7 aa, Neisseria
NAGQYQG

SEQ ID NO: 23306 - protein, 9 aa, Neisseria
ANIDARPYW

SEQ ID NO: 23307 - protein, 13 aa, Neisseria
AVGDSRTRPAHSA

SEQ ID NO: 23308 - protein, 8 aa, Neisseria
YRYDDPFW

SEQ ID NO: 23309 - protein, 10 aa, Neisseria
PPNGYNCRCS

SEQ ID NO: 23310 - protein, 23 aa, Neisseria
LSERDVERQGRIVGQSTSDNLVE

SEQ ID NO: 23311 - protein, 9 aa, Neisseria
KIYNKKGDT

SEQ ID NO: 23312 - protein, 35 aa, Neisseria; identical to SEQ ID NO: 10114

SEQ ID NO: 23313 - protein, 46 aa, Neisseria; identical to SEQ ID NO: 10115

SEQ ID NO: 23314 - protein, 7 aa, Neisseria
LSKETQE

SEQ ID NO: 23315 - protein, 22 aa, Neisseria
SDDTLVKQVDSREGQNFDDSYY

SEQ ID NO: 23316 - protein, 13 aa, Neisseria
LQNPEHVIRDNRE

SEQ ID NO: 23317 - protein, 6 aa, Neisseria
ARYKGS

SEQ ID NO: 23318 - protein, 7 aa, Neisseria
YIKEVDE

SEQ ID NO: 23319 - protein, 11 aa, Neisseria
SYRISNDKEIA

SEQ ID NO: 23320 - protein, 8 aa, Neisseria
MAKKKVLK

SEQ ID NO: 23321 - protein, 7 aa, Neisseria
PPKKAIE

SEQ ID NO: 23322 - protein, 12 aa, Neisseria
LESKKVTAESYR

SEQ ID NO: 23323 - protein, 7 aa, Neisseria
NDIKTSM

SEQ ID NO: 23324 - protein, 14 aa, Neisseria
ESAKSGQSFDDWRK

SEQ ID NO: 23325 - protein, 8 aa, Neisseria
HNGKDIID

SEQ ID NO: 23326 - protein, 8 aa, Neisseria
GSPRRLET

SEQ ID NO: 23327 - protein, 10 aa, Neisseria
AVGDSRTRPA

SEQ ID NO: 23328 - protein, 13 aa, Neisseria
LSERDVERQGRIV

SEQ ID NO: 23329 - protein, 8 aa, Neisseria
STSDNLVE

SEQ ID NO: 23330 - protein, 9 aa, Neisseria
KIYNKKGDT

SEQ ID NO: 23331 - protein, 7 aa, Neisseria
TTDRGFD

SEQ ID NO: 23332 - protein, 14 aa, Neisseria
MNYRPDLDKYDRAL

SEQ ID NO: 23333 - protein, 46 aa, Neisseria; identical to SEQ ID NO: 10115

SEQ ID NO: 23334 - protein, 7 aa, Neisseria
LSKETQE

SEQ ID NO: 23335 - protein, 16 aa, Neisseria
DTLVKQVDSREGQNFD

SEQ ID NO: 23336 - protein, 8 aa, Neisseria
HVIRDNRE

SEQ ID NO: 23337 - protein, 7 aa, Neisseria
YIKEVDE

SEQ ID NO: 23338 - protein, 8 aa, Neisseria
ISNDKEIA

SEQ ID NO: 23339 - protein, 8 aa, Neisseria
MAKKKVLK

SEQ ID NO: 23340 - protein, 6 aa, Neisseria
EHRHWE

SEQ ID NO: 23341 - protein, 13 aa, Neisseria
DAAKKLAAPWPQI

SEQ ID NO: 23342 - protein, 13 aa, Neisseria
TVWQALTHIANSV

SEQ ID NO: 23343 - protein, 7 aa, Neisseria
DNLAALQ

SEQ ID NO: 23344 - protein, 5 aa, Neisseria
QAKKQ

SEQ ID NO: 23345 - protein, 7 aa, Neisseria
MQNNSYG

SEQ ID NO: 23346 - protein, 19 aa, Neisseria
RVGGKEHRHWERYDIDSDF

SEQ ID NO: 23347 - protein, 20 aa, Neisseria
RLGPEAAIPDLSGESCEVVI

SEQ ID NO: 23348 - protein, 21 aa, Neisseria
GSQRHGKSKGGRELSLSGRDL

SEQ ID NO: 23349 - protein, 5 aa, Neisseria
LNVKG

SEQ ID NO: 23350 - protein, 6 aa, Neisseria
DAAKKL

SEQ ID NO: 23351 - protein, 18 aa, Neisseria
VENNPALDKIDIEPGETV

SEQ ID NO: 23352 - protein, 8 aa, Neisseria
WLEPDGTL

SEQ ID NO: 23353 - protein, 24 aa, Neisseria
SRTDSRRNIERMDIEWDTDNRFSE

SEQ ID NO: 23354 - protein, 13 aa, Neisseria
SHGRSGDSAKHDL

SEQ ID NO: 23355 - protein, 17 aa, Neisseria
WVYKDPTMTLHRPKTVV

SEQ ID NO: 23356 - protein, 5 aa, Neisseria
SDADN

SEQ ID NO: 23357 - protein, 9 aa, Neisseria
QKQAKKQLA

SEQ ID NO: 23358 - protein, 9 aa, Neisseria
VGGHKTRDG

SEQ ID NO: 23359 - protein, 9 aa, Neisseria
HVIDDEHGI

SEQ ID NO: 23360 - protein, 56 aa, Neisseria; identical to SEQ ID NO: 10215

SEQ ID NO: 23361 - protein, 16 aa, Neisseria
VGGKEHRHWERYDIDS

SEQ ID NO: 23362 - protein, 10 aa, Neisseria
LSGESCEVVI

SEQ ID NO: 23363 - protein, 19 aa, Neisseria
QRHGKSKGGRELSLSGRDL

SEQ ID NO: 23364 - protein, 6 aa, Neisseria
DAAKKL

SEQ ID NO: 23365 - protein, 12 aa, Neisseria
PALDKIDIEPGE

SEQ ID NO: 23366 - protein, 5 aa, Neisseria
LEPDG

SEQ ID NO: 23367 - protein, 22 aa, Neisseria
RTDSRRNIERMDIEWDTDNRFS

SEQ ID NO: 23368 - protein, 13 aa, Neisseria
SHGRSGDSAKHDL

SEQ ID NO: 23369 - protein, 5 aa, Neisseria
HRPKT

SEQ ID NO: 23370 - protein, 5 aa, Neisseria
SDADN

SEQ ID NO: 23371 - protein, 9 aa, Neisseria
QKQAKKQLA

SEQ ID NO: 23372 - protein, 6 aa, Neisseria
GHKTRD

SEQ ID NO: 23373 - protein, 9 aa, Neisseria
HVIDDEHGI

SEQ ID NO: 23374 - protein, 17 aa, Neisseria
RMDGTQTELRLKEDGIW

SEQ ID NO: 23375 - protein, 32 aa, Neisseria; identical to SEQ ID NO: 10231

SEQ ID NO: 23376 - protein, 7 aa, Neisseria
ILRGLLP

SEQ ID NO: 23377 - protein, 18 aa, Neisseria
LDAVAESAQSVADAVDPS

SEQ ID NO: 23378 - protein, 12 aa, Neisseria
QMLADWERVLGL

SEQ ID NO: 23379 - protein, 10 aa, Neisseria
AVMAKLNETG

SEQ ID NO: 23380 - protein, 5 aa, Neisseria
LAEAA

SEQ ID NO: 23381 - protein, 5 aa, Neisseria
EPQPF

SEQ ID NO: 23382 - protein, 10 aa, Neisseria
AGVNRAGDRL

SEQ ID NO: 23383 - protein, 21 aa, Neisseria
AGDRLTDYSDAVIESLFNRLK

SEQ ID NO: 23384 - protein, 19 aa, Neisseria
SYARNAPRVRAQAEIDGAA

SEQ ID NO: 23385 - protein, 9 aa, Neisseria
AVAESAQSV

SEQ ID NO: 23386 - protein, 9 aa, Neisseria
DAVDPSSAG

SEQ ID NO: 23387 - protein, 14 aa, Neisseria
LGLDGTGKNRQRRV

SEQ ID NO: 23388 - protein, 8 aa, Neisseria
KLNETGGL

SEQ ID NO: 23389 - protein, 21 aa, Neisseria
QIDEPQPFRAGVNRAGDRLAP

SEQ ID NO: 23390 - protein, 15 aa, Neisseria
VRGGNNRITRFRAGI

SEQ ID NO: 23391 - protein, 14 aa, Neisseria
AAGDRLTDYSDAVI

SEQ ID NO: 23392 - protein, 7 aa, Neisseria
LFNRLKP

SEQ ID NO: 23393 - protein, 16 aa, Neisseria
RNAPRVRAQAEIDGAA

SEQ ID NO: 23394 - protein, 9 aa, Neisseria
AVAESAQSV

SEQ ID NO: 23395 - protein, 7 aa, Neisseria
DAVDPSS

SEQ ID NO: 23396 - protein, 10 aa, Neisseria
GTGKNRQRRV

SEQ ID NO: 23397 - protein, 8 aa, Neisseria
QIDEPQPF

SEQ ID NO: 23398 - protein, 11 aa, Neisseria
GVNRAGDRLAP

SEQ ID NO: 23399 - protein, 12 aa, Neisseria
RGGNNRITRFRA

SEQ ID NO: 23400 - protein, 14 aa, Neisseria
AAGDRLTDYSDAVI

SEQ ID NO: 23401 - protein, 7 aa, Neisseria
LFNRLKP

SEQ ID NO: 23402 - protein, 9 aa, Neisseria
QIERLGNGI

SEQ ID NO: 23403 - protein, 8 aa, Neisseria
RRLSETMH

SEQ ID NO: 23404 - protein, 12 aa, Neisseria
LSDSGRLKDSFS

SEQ ID NO: 23405 - protein, 6 aa, Neisseria
IHNFGG

SEQ ID NO: 23406 - protein, 15 aa, Neisseria
QIERLGNGIENRYLL

SEQ ID NO: 23407 - protein, 37 aa, Neisseria
YAGRPKWLGLKYRDGKPLSDSGRLKDSFSTLSDNDTA

SEQ ID NO: 23408 - protein, 17 aa, Neisseria
GGMAGRNRKVRIPQREF

SEQ ID NO: 23409 - protein, 14 aa, Neisseria
TDDDKQALMDDVQD

SEQ ID NO: 23410 - protein, 7 aa, Neisseria
QIERLGN

SEQ ID NO: 23411 - protein, 18 aa, Neisseria
KYRDGKPLSDSGRLKDSF

SEQ ID NO: 23412 - protein, 5 aa, Neisseria
SDNDT

SEQ ID NO: 23413 - protein, 13 aa, Neisseria
AGRNRKVRIPQRE

SEQ ID NO: 23414 - protein, 14 aa, Neisseria
TDDDKQALMDDVQD

SEQ ID NO: 23415 - protein, 8 aa, Neisseria
GVHKSAHG

SEQ ID NO: 23416 - protein, 12 aa, Neisseria
ATVKKTHKHTKA

SEQ ID NO: 23417 - protein, 5 aa, Neisseria
MNKNI

SEQ ID NO: 23418 - protein, 80 aa, Neisseria; identical to SEQ ID NO: 10274

SEQ ID NO: 23419 - protein, 7 aa, Neisseria
AANKPAS

SEQ ID NO: 23420 - protein, 7 aa, Neisseria
GVHKSAH

SEQ ID NO: 23421 - protein, 10 aa, Neisseria
GASKSAEGSC

SEQ ID NO: 23422 - protein, 15 aa, Neisseria
AGSKAGEGKCGEGKC

SEQ ID NO: 23423 - protein, 32 aa, Neisseria; identical to SEQ ID NO: 10279

SEQ ID NO: 23424 - protein, 7 aa, Neisseria
AVYALAN

SEQ ID NO: 23425 - protein, 5 aa, Neisseria
LHRGL

SEQ ID NO: 23426 - protein, 5 aa, Neisseria
SIAYW

SEQ ID NO: 23427 - protein, 7 aa, Neisseria
AGLEQLG

SEQ ID NO: 23428 - protein, 18 aa, Neisseria
QSIFSTVWTPYIFRAIEA

SEQ ID NO: 23429 - protein, 9 aa, Neisseria
TGIFSPLAS

SEQ ID NO: 23430 - protein, 7 aa, Neisseria
LNVVRKT

SEQ ID NO: 23431 - protein, 8 aa, Neisseria
LATLGALA

SEQ ID NO: 23432 - protein, 12 aa, Neisseria
SSCRLWQPLKRL

SEQ ID NO: 23433 - protein, 5 aa, Neisseria
CFGTP

SEQ ID NO: 23434 - protein, 8 aa, Neisseria
GVWAVYLA

SEQ ID NO: 23435 - protein, 9 aa, Neisseria
KDLHKLFHY

SEQ ID NO: 23436 - protein, 5 aa, Neisseria
MDTKE

SEQ ID NO: 23437 - protein, 7 aa, Neisseria
PADDIGR

SEQ ID NO: 23438 - protein, 6 aa, Neisseria
ADKDTL

SEQ ID NO: 23439 - protein, 9 aa, Neisseria
SRPSLPSEI

SEQ ID NO: 23440 - protein, 5 aa, Neisseria
MEGRA

SEQ ID NO: 23441 - protein, 15 aa, Neisseria
NRCRLKAVRRAPFSS

SEQ ID NO: 23442 - protein, 7 aa, Neisseria
SADRLFL

SEQ ID NO: 23443 - protein, 10 aa, Neisseria
IEANAPPARL

SEQ ID NO: 23444 - protein, 5 aa, Neisseria
ATAES

SEQ ID NO: 23445 - protein, 5 aa, Neisseria
PENYA

SEQ ID NO: 23446 - protein, 9 aa, Neisseria
VVRKTRPIA

SEQ ID NO: 23447 - protein, 7 aa, Neisseria
PSGGARG

SEQ ID NO: 23448 - protein, 8 aa, Neisseria
KTESSCRL

SEQ ID NO: 23449 - protein, 8 aa, Neisseria
LRHRKDLH

SEQ ID NO: 23450 - protein, 5 aa, Neisseria
MDTKE

SEQ ID NO: 23451 - protein, 6 aa, Neisseria
ADKDTL

SEQ ID NO: 23452 - protein, 5 aa, Neisseria
MEGRA

SEQ ID NO: 23453 - protein, 13 aa, Neisseria
NRCRLKAVRRAPF

SEQ ID NO: 23454 - protein, 7 aa, Neisseria
NAPPARL

SEQ ID NO: 23455 - protein, 5 aa, Neisseria
ATAES

SEQ ID NO: 23456 - protein, 7 aa, Neisseria
VVRKTRP

SEQ ID NO: 23457 - protein, 5 aa, Neisseria
GGARG

SEQ ID NO: 23458 - protein, 5 aa, Neisseria
TESSC

SEQ ID NO: 23459 - protein, 8 aa, Neisseria
LRHRKDLH

SEQ ID NO: 23460 - protein, 19 aa, Neisseria
ITATGRVIAEHPSNFITPQ

SEQ ID NO: 23461 - protein, 5 aa, Neisseria
RALFE

SEQ ID NO: 23462 - protein, 12 aa, Neisseria
DQAYEMMDSLPT

SEQ ID NO: 23463 - protein, 13 aa, Neisseria
DLIMDLMDAVGHG

SEQ ID NO: 23464 - protein, 6 aa, Neisseria
PQSWFK

SEQ ID NO: 23465 - protein, 5 aa, Neisseria
RSVQQ

SEQ ID NO: 23466 - protein, 8 aa, Neisseria
TLSWLYMF

SEQ ID NO: 23467 - protein, 13 aa, Neisseria
HYAVHDFAEFLEL

SEQ ID NO: 23468 - protein, 6 aa, Neisseria
RAVAEI

SEQ ID NO: 23469 - protein, 7 aa, Neisseria
AANGMTS

SEQ ID NO: 23470 - protein, 12 aa, Neisseria
TNALGNIHNEIR

SEQ ID NO: 23471 - protein, 14 aa, Neisseria
QVAQTITSQIIGPF

SEQ ID NO: 23472 - protein, 5 aa, Neisseria
DPNRV

SEQ ID NO: 23473 - protein, 17 aa, Neisseria
EPKDIAVFADAIPKLVD

SEQ ID NO: 23474 - protein, 5 aa, Neisseria
VQIPE

SEQ ID NO: 23475 - protein, 7 aa, Neisseria
RQVPDNP

SEQ ID NO: 23476 - protein, 11 aa, Neisseria
HQEILDGALDD

SEQ ID NO: 23477 - protein, 19 aa, Neisseria
LNPMVRQAVAALNACNSYE

SEQ ID NO: 23478 - protein, 18 aa, Neisseria
IMAKKNNKTKIQKPEAAL

SEQ ID NO: 23479 - protein, 7 aa, Neisseria
ATGRVIA

SEQ ID NO: 23480 - protein, 5 aa, Neisseria
HPSNF

SEQ ID NO: 23481 - protein, 21 aa, Neisseria
TPQKMRALFEDAESGDIRAQH

SEQ ID NO: 23482 - protein, 10 aa, Neisseria
ADIEERDSDI

SEQ ID NO: 23483 - protein, 7 aa, Neisseria
MGTRKRA

SEQ ID NO: 23484 - protein, 21 aa, Neisseria
VAPPRNATPEEEKLSDQAYEM

SEQ ID NO: 23485 - protein, 5 aa, Neisseria
LPTLE

SEQ ID NO: 23486 - protein, 25 aa, Neisseria
DGLYLPRNFIHRPQSWFKWDKDNGL

SEQ ID NO: 23487 - protein, 11 aa, Neisseria
LRTRENPEGEA

SEQ ID NO: 23488 - protein, 16 aa, Neisseria
HTQKSRSVQQARNGLF

SEQ ID NO: 23489 - protein, 17 aa, Neisseria
RIGKYGAGATKEEKNTL

SEQ ID NO: 23490 - protein, 9 aa, Neisseria
MPEGMEIEL

SEQ ID NO: 23491 - protein, 7 aa, Neisseria
ANGMTSA

SEQ ID NO: 23492 - protein, 8 aa, Neisseria
DWCEKSAA

SEQ ID NO: 23493 - protein, 15 aa, Neisseria
LTSGADGKSSTNALG

SEQ ID NO: 23494 - protein, 15 aa, Neisseria
NEIRRDLLVSDAKQV

SEQ ID NO: 23495 - protein, 22 aa, Neisseria
YPHADPNRVPKFEFDTREPKDI

SEQ ID NO: 23496 - protein, 11 aa, Neisseria
IPESWVRDKLV

SEQ ID NO: 23497 - protein, 9 aa, Neisseria
DVQEGEAVL

SEQ ID NO: 23498 - protein, 10 aa, Neisseria
RQVPDNPVNR

SEQ ID NO: 23499 - protein, 18 aa, Neisseria
VPSKATGRHQEILDGALD

SEQ ID NO: 23500 - protein, 11 aa, Neisseria
ALVEPDFNSQL

SEQ ID NO: 23501 - protein, 8 aa, Neisseria
NSYEEADA

SEQ ID NO: 23502 - protein, 9 aa, Neisseria
NLDNAKLRT

SEQ ID NO: 23503 - protein, 8 aa, Neisseria
LGQDHARA

SEQ ID NO: 23504 - protein, 18 aa, Neisseria
IMAKKNNKTKIQKPEAAL

SEQ ID NO: 23505 - protein, 19 aa, Neisseria
QKMRALFEDAESGDIRAQH

SEQ ID NO: 23506 - protein, 10 aa, Neisseria
ADIEERDSDI

SEQ ID NO: 23507 - protein, 7 aa, Neisseria
MGTRKRA

SEQ ID NO: 23508 - protein, 20 aa, Neisseria
APPRNATPEEEKLSDQAYEM

SEQ ID NO: 23509 - protein, 8 aa, Neisseria
KWDKDNGL

SEQ ID NO: 23510 - protein, 11 aa, Neisseria
LRTRENPEGEA

SEQ ID NO: 23511 - protein, 10 aa, Neisseria
QKSRSVQQAR

SEQ ID NO: 23512 - protein, 9 aa, Neisseria
ATKEEKNTL

SEQ ID NO: 23513 - protein, 7 aa, Neisseria
EGMEIEL

SEQ ID NO: 23514 - protein, 8 aa, Neisseria
DWCEKSAA

SEQ ID NO: 23515 - protein, 9 aa, Neisseria
SGADGKSST

SEQ ID NO: 23516 - protein, 15 aa, Neisseria
NEIRRDLLVSDAKQV

SEQ ID NO: 23517 - protein, 17 aa, Neisseria
DPNRVPKFEFDTREPKD

SEQ ID NO: 23518 - protein, 7 aa, Neisseria
WVRDKLV

SEQ ID NO: 23519 - protein, 9 aa, Neisseria
DVQEGEAVL

SEQ ID NO: 23520 - protein, 8 aa, Neisseria
QVPDNPVN

SEQ ID NO: 23521 - protein, 18 aa, Neisseria
VPSKATGRHQEILDGALD

SEQ ID NO: 23522 - protein, 7 aa, Neisseria
SYEEADA

SEQ ID NO: 23523 - protein, 5 aa, Neisseria
DNAKL

SEQ ID NO: 23524 - protein, 5 aa, Neisseria
DHARA

SEQ ID NO: 23525 - protein, 9 aa, Neisseria
QAVRLLSTS

SEQ ID NO: 23526 - protein, 8 aa, Neisseria
APDLIEVN

SEQ ID NO: 23527 - protein, 8 aa, Neisseria
ALRAVQTA

SEQ ID NO: 23528 - protein, 6 aa, Neisseria
QTAESL

SEQ ID NO: 23529 - protein, 7 aa, Neisseria
RLNALVA

SEQ ID NO: 23530 - protein, 21 aa, Neisseria
GTIHQIAHEFYGDIARAAELV

SEQ ID NO: 23531 - protein, 14 aa, Neisseria
GLQNRLNRLTAKQV

SEQ ID NO: 23532 - protein, 8 aa, Neisseria
AHGEEMTA

SEQ ID NO: 23533 - protein, 15 aa, Neisseria
DLIEVNRAMRRRMQA

SEQ ID NO: 23534 - protein, 9 aa, Neisseria
AAESGGLTA

SEQ ID NO: 23535 - protein, 10 aa, Neisseria
QTAESLRAAA

SEQ ID NO: 23536 - protein, 6 aa, Neisseria
NQKPPL

SEQ ID NO: 23537 - protein, 7 aa, Neisseria
QAPIDGT

SEQ ID NO: 23538 - protein, 6 aa, Neisseria
IARAAE

SEQ ID NO: 23539 - protein, 13 aa, Neisseria
FIKRGTLVNSYAK

SEQ ID NO: 23540 - protein, 8 aa, Neisseria
NRLNRLTA

SEQ ID NO: 23541 - protein, 8 aa, Neisseria
AHGEEMTA

SEQ ID NO: 23542 - protein, 15 aa, Neisseria
DLIEVNRAMRRRMQA

SEQ ID NO: 23543 - protein, 6 aa, Neisseria
AAESGG

SEQ ID NO: 23544 - protein, 7 aa, Neisseria
ESLRAAA

SEQ ID NO: 23545 - protein, 6 aa, Neisseria
IARAAE

SEQ ID NO: 23546 - protein, 8 aa, Neisseria
AGWMRWLE

SEQ ID NO: 23547 - protein, 6 aa, Neisseria
RYISAV

SEQ ID NO: 23548 - protein, 22 aa, Neisseria
SKIFHAALTNFPALDGMDEVLA

SEQ ID NO: 23549 - protein, 13 aa, Neisseria
NPMKELLQQLFGL

SEQ ID NO: 23550 - protein, 5 aa, Neisseria
DVFAQ

SEQ ID NO: 23551 - protein, 12 aa, Neisseria
KYAPISVVQELQ

SEQ ID NO: 23552 - protein, 11 aa, Neisseria
WAEGVLKQPGG

SEQ ID NO: 23553 - protein, 8 aa, Neisseria
AFLTGFIE

SEQ ID NO: 23554 - protein, 6 aa, Neisseria
MSKNAQ

SEQ ID NO: 23555 - protein, 9 aa, Neisseria
EVQPKDGRI

SEQ ID NO: 23556 - protein, 5 aa, Neisseria
LPYGE

SEQ ID NO: 23557 - protein, 12 aa, Neisseria
RAVDGRPTDVPA

SEQ ID NO: 23558 - protein, 7 aa, Neisseria
TEENGHD

SEQ ID NO: 23559 - protein, 9 aa, Neisseria
LANSSRNQL

SEQ ID NO: 23560 - protein, 11 aa, Neisseria
LYKEKNGQPAP

SEQ ID NO: 23561 - protein, 9 aa, Neisseria
EFTPKGMFA

SEQ ID NO: 23562 - protein, 7 aa, Neisseria
EWTDKAA

SEQ ID NO: 23563 - protein, 6 aa, Neisseria
AAKEYR

SEQ ID NO: 23564 - protein, 9 aa, Neisseria
FSYDTKGYV

SEQ ID NO: 23565 - protein, 7 aa, Neisseria
DGMDEVL

SEQ ID NO: 23566 - protein, 16 aa, Neisseria
QILKPETEQNPMKELL

SEQ ID NO: 23567 - protein, 10 aa, Neisseria
PDAGEEELKA

SEQ ID NO: 23568 - protein, 10 aa, Neisseria
VEAKPKDVAL

SEQ ID NO: 23569 - protein, 8 aa, Neisseria
LAEKDSRI

SEQ ID NO: 23570 - protein, 11 aa, Neisseria
QTAKPDLTKYA

SEQ ID NO: 23571 - protein, 10 aa, Neisseria
AKQEADKGNE

SEQ ID NO: 23572 - protein, 7 aa, Neisseria
PAQKEWA

SEQ ID NO: 23573 - protein, 7 aa, Neisseria
VLKQPGG

SEQ ID NO: 23574 - protein, 14 aa, Neisseria
GSQTGGKAPDERVA

SEQ ID NO: 23575 - protein, 7 aa, Neisseria
TAEEAAA

SEQ ID NO: 23576 - protein, 16 aa, Neisseria
GMSGEEFVKIKESEGK

SEQ ID NO: 23577 - protein, 6 aa, Neisseria
MSKNAQ

SEQ ID NO: 23578 - protein, 8 aa, Neisseria
VQPKDGRI

SEQ ID NO: 23579 - protein, 9 aa, Neisseria
RAVDGRPTD

SEQ ID NO: 23580 - protein, 5 aa, Neisseria
EENGH

SEQ ID NO: 23581 - protein, 8 aa, Neisseria
LYKEKNGQ

SEQ ID NO: 23582 - protein, 7 aa, Neisseria
EWTDKAA

SEQ ID NO: 23583 - protein, 6 aa, Neisseria
AAKEYR

SEQ ID NO: 23584 - protein, 7 aa, Neisseria
DGMDEVL

SEQ ID NO: 23585 - protein, 14 aa, Neisseria
LKPETEQNPMKELL

SEQ ID NO: 23586 - protein, 9 aa, Neisseria
DAGEEELKA

SEQ ID NO: 23587 - protein, 10 aa, Neisseria
VEAKPKDVAL

SEQ ID NO: 23588 - protein, 8 aa, Neisseria
LAEKDSRI

SEQ ID NO: 23589 - protein, 8 aa, Neisseria
TAKPDLTK

SEQ ID NO: 23590 - protein, 10 aa, Neisseria
AKQEADKGNE

SEQ ID NO: 23591 - protein, 7 aa, Neisseria
PAQKEWA

SEQ ID NO: 23592 - protein, 11 aa, Neisseria
TGGKAPDERVA

SEQ ID NO: 23593 - protein, 7 aa, Neisseria
TAEEAAA

SEQ ID NO: 23594 - protein, 14 aa, Neisseria
SGEEFVKIKESEGK

SEQ ID NO: 23595 - protein, 5 aa, Neisseria
LAKKT

SEQ ID NO: 23596 - protein, 11 aa, Neisseria
QTAKNIGETLR

SEQ ID NO: 23597 - protein, 5 aa, Neisseria
RVQLS

SEQ ID NO: 23598 - protein, 13 aa, Neisseria
ADETLQDLEHLQE

SEQ ID NO: 23599 - protein, 25 aa, Neisseria
KLAKKTAQTAKNIGETLRAAFRGKI

SEQ ID NO: 23600 - protein, 23 aa, Neisseria
SSEPIQRVQLSGLADETLQDLEH

SEQ ID NO: 23601 - protein, 13 aa, Neisseria
YGFASHPPDGSEA

SEQ ID NO: 23602 - protein, 6 aa, Neisseria
LGGNTS

SEQ ID NO: 23603 - protein, 15 aa, Neisseria
QHGSYRIKNLKPGET

SEQ ID NO: 23604 - protein, 21 aa, Neisseria
NHEGAKIVIKQGKIIEADCDV

SEQ ID NO: 23605 - protein, 8 aa, Neisseria
RVNCKQYE

SEQ ID NO: 23606 - protein, 5 aa, Neisseria
TDAKF

SEQ ID NO: 23607 - protein, 6 aa, Neisseria
QINGNG

SEQ ID NO: 23608 - protein, 29 aa, Neisseria
AVEGGDGATFSGDVNQTGGSFNTDGDVVA

SEQ ID NO: 23609 - protein, 18 aa, Neisseria
QHPHTDSIGGKTLPAEPA

SEQ ID NO: 23610 - protein, 23 aa, Neisseria
KLAKKTAQTAKNIGETLRAAFRG

SEQ ID NO: 23611 - protein, 11 aa, Neisseria
LADETLQDLEH

SEQ ID NO: 23612 - protein, 6 aa, Neisseria
PPDGSE

SEQ ID NO: 23613 - protein, 10 aa, Neisseria
YRIKNLKPGE

SEQ ID NO: 23614 - protein, 19 aa, Neisseria
EGAKIVIKQGKIIEADCDV

SEQ ID NO: 23615 - protein, 6 aa, Neisseria
NCKQYE

SEQ ID NO: 23616 - protein, 5 aa, Neisseria
TDAKF

SEQ ID NO: 23617 - protein, 7 aa, Neisseria
FNTDGDV

SEQ ID NO: 23618 - protein, 7 aa, Neisseria
PHTDSIG

SEQ ID NO: 23619 - protein, 8 aa, Neisseria
DTLGSIPE

SEQ ID NO: 23620 - protein, 8 aa, Neisseria
PRPSEYHE

SEQ ID NO: 23621 - protein, 5 aa, Neisseria
AAAAR

SEQ ID NO: 23622 - protein, 6 aa, Neisseria
IDSFYR

SEQ ID NO: 23623 - protein, 5 aa, Neisseria
ARQAD

SEQ ID NO: 23624 - protein, 5 aa, Neisseria
IAAAR

SEQ ID NO: 23625 - protein, 15 aa, Neisseria
IETAPGLDALEKEIE

SEQ ID NO: 23626 - protein, 16 aa, Neisseria
FKNGFYDDTLGSIPEG

SEQ ID NO: 23627 - protein, 6 aa, Neisseria
VRAEEY

SEQ ID NO: 23628 - protein, 34 aa, Neisseria
AQGGQIAADSDGRPVLTPPRPSEYHEWDGKKWEI

SEQ ID NO: 23629 - protein, 7 aa, Neisseria
RFAEQKT

SEQ ID NO: 23630 - protein, 11 aa, Neisseria
LAAKADELKNS

SEQ ID NO: 23631 - protein, 26 aa, Neisseria
PQVEIDSFYRQEKEALARQADNNAPT

SEQ ID NO: 23632 - protein, 8 aa, Neisseria
KVVEKSAR

SEQ ID NO: 23633 - protein, 13 aa, Neisseria
IGKRQQLEDKLNT

SEQ ID NO: 23634 - protein, 15 aa, Neisseria
ETAPGLDALEKEIEE

SEQ ID NO: 23635 - protein, 6 aa, Neisseria
VRAEEY

SEQ ID NO: 23636 - protein, 9 aa, Neisseria
IAADSDGRP

SEQ ID NO: 23637 - protein, 16 aa, Neisseria
PRPSEYHEWDGKKWEI

SEQ ID NO: 23638 - protein, 7 aa, Neisseria
RFAEQKT

SEQ ID NO: 23639 - protein, 10 aa, Neisseria
LAAKADELKN

SEQ ID NO: 23640 - protein, 16 aa, Neisseria
YRQEKEALARQADNNA

SEQ ID NO: 23641 - protein, 8 aa, Neisseria
KVVEKSAR

SEQ ID NO: 23642 - protein, 13 aa, Neisseria
IGKRQQLEDKLNT

SEQ ID NO: 23643 - protein, 9 aa, Neisseria
DALEKEIEE

SEQ ID NO: 23644 - protein, 5 aa, Neisseria
LLANN

SEQ ID NO: 23645 - protein, 7 aa, Neisseria
QPIAIIA

SEQ ID NO: 23646 - protein, 6 aa, Neisseria
YARELE

SEQ ID NO: 23647 - protein, 7 aa, Neisseria
GCIDGFG

SEQ ID NO: 23648 - protein, 12 aa, Neisseria
HHQGYKSAFAKQ

SEQ ID NO: 23649 - protein, 12 aa, Neisseria
AVIEKMKRDKAQ

SEQ ID NO: 23650 - protein, 20 aa, Neisseria
NYARELEQARAEAKKYEVKA

SEQ ID NO: 23651 - protein, 21 aa, Neisseria
LAKKQAEVSRLKTENKKEIEN

SEQ ID NO: 23652 - protein, 17 aa, Neisseria
LTQDRKNAGGGCIDGFG

SEQ ID NO: 23653 - protein, 5 aa, Neisseria
LGYGN

SEQ ID NO: 23654 - protein, 12 aa, Neisseria
AVIEKMKRDKAQ

SEQ ID NO: 23655 - protein, 20 aa, Neisseria
NYARELEQARAEAKKYEVKA

SEQ ID NO: 23656 - protein, 21 aa, Neisseria
LAKKQAEVSRLKTENKKEIEN

SEQ ID NO: 23657 - protein, 9 aa, Neisseria
LTQDRKNAG

SEQ ID NO: 23658 - protein, 8 aa, Neisseria
SFFALVFA

SEQ ID NO: 23659 - protein, 8 aa, Neisseria
ATEVPKNP

SEQ ID NO: 23660 - protein, 13 aa, Neisseria
AFVAKLARLFRNA

SEQ ID NO: 23661 - protein, 8 aa, Neisseria
NLAGTVDD

SEQ ID NO: 23662 - protein, 13 aa, Neisseria
EDVYEHCLGCYQM

SEQ ID NO: 23663 - protein, 8 aa, Neisseria
YRDVANDE

SEQ ID NO: 23664 - protein, 6 aa, Neisseria
SNRIAS

SEQ ID NO: 23665 - protein, 9 aa, Neisseria
QNMRELMPR

SEQ ID NO: 23666 - protein, 13 aa, Neisseria
EKEVRRYAEAAAR

SEQ ID NO: 23667 - protein, 5 aa, Neisseria
INPRW

SEQ ID NO: 23668 - protein, 13 aa, Neisseria
LSDTATEVPKNPN

SEQ ID NO: 23669 - protein, 7 aa, Neisseria
FRNADRA

SEQ ID NO: 23670 - protein, 24 aa, Neisseria
ESIRTEENLAGTVDDGPLQSEKDY

SEQ ID NO: 23671 - protein, 10 aa, Neisseria
RLSRLKEKAK

SEQ ID NO: 23672 - protein, 7 aa, Neisseria
TEQEHGK

SEQ ID NO: 23673 - protein, 6 aa, Neisseria
HIGEGG

SEQ ID NO: 23674 - protein, 10 aa, Neisseria
LSQRSPEAFV

SEQ ID NO: 23675 - protein, 10 aa, Neisseria
YLYRNDRPFS

SEQ ID NO: 23676 - protein, 14 aa, Neisseria
VHGENYETTGEYRV

SEQ ID NO: 23677 - protein, 6 aa, Neisseria
QPDGSV

SEQ ID NO: 23678 - protein, 12 aa, Neisseria
AAGRGKIGEDVY

SEQ ID NO: 23679 - protein, 47 aa, Neisseria; identical to SEQ ID NO: 10703

SEQ ID NO: 23680 - protein, 10 aa, Neisseria
GYDADGLPQK

SEQ ID NO: 23681 - protein, 19 aa, Neisseria
SFDNGKKRQSFEYYLKNGN

SEQ ID NO: 23682 - protein, 7 aa, Neisseria
LKADGVT

SEQ ID NO: 23683 - protein, 19 aa, Neisseria
LDGGRIVREEKQGDRLPDF

SEQ ID NO: 23684 - protein, 26 aa, Neisseria
ENLEKEVRRYAEAAARRSGGRRDLSH

SEQ ID NO: 23685 - protein, 9 aa, Neisseria
TATEVPKNP

SEQ ID NO: 23686 - protein, 7 aa, Neisseria
FRNADRA

SEQ ID NO: 23687 - protein, 9 aa, Neisseria
ESIRTEENL

SEQ ID NO: 23688 - protein, 13 aa, Neisseria
TVDDGPLQSEKDY

SEQ ID NO: 23689 - protein, 10 aa, Neisseria
RLSRLKEKAK

SEQ ID NO: 23690 - protein, 7 aa, Neisseria
TEQEHGK

SEQ ID NO: 23691 - protein, 7 aa, Neisseria
LSQRSPE

SEQ ID NO: 23692 - protein, 7 aa, Neisseria
YRNDRPF

SEQ ID NO: 23693 - protein, 9 aa, Neisseria
ENYETTGEY

SEQ ID NO: 23694 - protein, 12 aa, Neisseria
AAGRGKIGEDVY

SEQ ID NO: 23695 - protein, 28 aa, Neisseria
KYRDVANDEQKVWDFRKESNRIASDSRN

SEQ ID NO: 23696 - protein, 11 aa, Neisseria
NMRELMPRGMK

SEQ ID NO: 23697 - protein, 7 aa, Neisseria
YDADGLP

SEQ ID NO: 23698 - protein, 8 aa, Neisseria
DNGKKRQS

SEQ ID NO: 23699 - protein, 7 aa, Neisseria
LKADGVT

SEQ ID NO: 23700 - protein, 15 aa, Neisseria
GGRIVREEKQGDRLP

SEQ ID NO: 23701 - protein, 26 aa, Neisseria
ENLEKEVRRYAEAAARRSGGRRDLSH

SEQ ID NO: 23702 - protein, 7 aa, Neisseria
CTMIPQY

SEQ ID NO: 23703 - protein, 10 aa, Neisseria
EVAETFKNDT

SEQ ID NO: 23704 - protein, 5 aa, Neisseria
HDYFA

SEQ ID NO: 23705 - protein, 9 aa, Neisseria
PRLQKLIDI

SEQ ID NO: 23706 - protein, 5 aa, Neisseria
QGYFA

SEQ ID NO: 23707 - protein, 8 aa, Neisseria
SLIATVAK

SEQ ID NO: 23708 - protein, 6 aa, Neisseria
LATLIN

SEQ ID NO: 23709 - protein, 6 aa, Neisseria
KLPAGL

SEQ ID NO: 23710 - protein, 7 aa, Neisseria
LGGLFKS

SEQ ID NO: 23711 - protein, 11 aa, Neisseria
VQSAFQDVANA

SEQ ID NO: 23712 - protein, 13 aa, Neisseria
LDKAYDALSKQSR

SEQ ID NO: 23713 - protein, 8 aa, Neisseria
GALDLLDA

SEQ ID NO: 23714 - protein, 19 aa, Neisseria
LTRAENLADLYKALGGGLK

SEQ ID NO: 23715 - protein, 10 aa, Neisseria
PQYEQPKVEV

SEQ ID NO: 23716 - protein, 16 aa, Neisseria
ETFKNDTADSGIRAVD

SEQ ID NO: 23717 - protein, 13 aa, Neisseria
GWHDYFADPRLQK

SEQ ID NO: 23718 - protein, 10 aa, Neisseria
ALERNTSLRT

SEQ ID NO: 23719 - protein, 16 aa, Neisseria
EIYRKQYMIERNNLLP

SEQ ID NO: 23720 - protein, 21 aa, Neisseria
NANDSRQGSLSGGNVSSSYKV

SEQ ID NO: 23721 - protein, 10 aa, Neisseria
GRVRSSSEAA

SEQ ID NO: 23722 - protein, 7 aa, Neisseria
TANRDAA

SEQ ID NO: 23723 - protein, 11 aa, Neisseria
YFNERYAEEAM

SEQ ID NO: 23724 - protein, 17 aa, Neisseria
RVLKTREETYKLSELRY

SEQ ID NO: 23725 - protein, 14 aa, Neisseria
RQQEALIESAKADY

SEQ ID NO: 23726 - protein, 9 aa, Neisseria
ARSREQARN

SEQ ID NO: 23727 - protein, 9 aa, Neisseria
QPIPDDLPA

SEQ ID NO: 23728 - protein, 20 aa, Neisseria
VLLDRPDIRAAEHALKQANA

SEQ ID NO: 23729 - protein, 12 aa, Neisseria
RLTGSVDTHSAE

SEQ ID NO: 23730 - protein, 6 aa, Neisseria
LFKSGT

SEQ ID NO: 23731 - protein, 15 aa, Neisseria
GTNKANLDVAKLRQQ

SEQ ID NO: 23732 - protein, 25 aa, Neisseria
TAREQLDKAYDALSKQSRASKEALR

SEQ ID NO: 23733 - protein, 8 aa, Neisseria
LRYKHGVS

SEQ ID NO: 23734 - protein, 10 aa, Neisseria
LDAERSSYSA

SEQ ID NO: 23735 - protein, 7 aa, Neisseria
LTRAENL

SEQ ID NO: 23736 - protein, 13 aa, Neisseria
LGGGLKRDTQTDK

SEQ ID NO: 23737 - protein, 7 aa, Neisseria
EQPKVEV

SEQ ID NO: 23738 - protein, 15 aa, Neisseria
ETFKNDTADSGIRAV

SEQ ID NO: 23739 - protein, 5 aa, Neisseria
PRLQK

SEQ ID NO: 23740 - protein, 8 aa, Neisseria
ALERNTSL

SEQ ID NO: 23741 - protein, 7 aa, Neisseria
YMIERNN

SEQ ID NO: 23742 - protein, 9 aa, Neisseria
NANDSRQGS

SEQ ID NO: 23743 - protein, 10 aa, Neisseria
GRVRSSSEAA

SEQ ID NO: 23744 - protein, 6 aa, Neisseria
ANRDAA

SEQ ID NO: 23745 - protein, 7 aa, Neisseria
RYAEEAM

SEQ ID NO: 23746 - protein, 17 aa, Neisseria
RVLKTREETYKLSELRY

SEQ ID NO: 23747 - protein, 14 aa, Neisseria
RQQEALIESAKADY

SEQ ID NO: 23748 - protein, 9 aa, Neisseria
ARSREQARN

SEQ ID NO: 23749 - protein, 6 aa, Neisseria
IPDDLP

SEQ ID NO: 23750 - protein, 19 aa, Neisseria
VLLDRPDIRAAEHALKQAN

SEQ ID NO: 23751 - protein, 7 aa, Neisseria
VDTHSAE

SEQ ID NO: 23752 - protein, 11 aa, Neisseria
KANLDVAKLRQ

SEQ ID NO: 23753 - protein, 25 aa, Neisseria
TAREQLDKAYDALSKQSRASKEALR

SEQ ID NO: 23754 - protein, 10 aa, Neisseria
LDAERSSYSA

SEQ ID NO: 23755 - protein, 7 aa, Neisseria
LTRAENL

SEQ ID NO: 23756 - protein, 10 aa, Neisseria
GLKRDTQTDK

SEQ ID NO: 23757 - protein, 9 aa, Neisseria
RLIKLLAAC

SEQ ID NO: 23758 - protein, 5 aa, Neisseria
LAADL

SEQ ID NO: 23759 - protein, 11 aa, Neisseria
QINVIQDYTHR

SEQ ID NO: 23760 - protein, 5 aa, Neisseria
NHAAD

SEQ ID NO: 23761 - protein, 18 aa, Neisseria
HPADAYDGPKGGNYPKPT

SEQ ID NO: 23762 - protein, 20 aa, Neisseria
QRISDNYSNLGSNFSDRADE

SEQ ID NO: 23763 - protein, 5 aa, Neisseria
HNAKL

SEQ ID NO: 23764 - protein, 13 aa, Neisseria
RWGNSMEFINGVA

SEQ ID NO: 23765 - protein, 8 aa, Neisseria
GALNPFIS

SEQ ID NO: 23766 - protein, 7 aa, Neisseria
AAMRNIA

SEQ ID NO: 23767 - protein, 26 aa, Neisseria
AVIGGLGSVAGFEKNTREAVDRWIQE

SEQ ID NO: 23768 - protein, 27 aa, Neisseria
NAAETVEALVNVLPFAKVKNLTKAAKP

SEQ ID NO: 23769 - protein, 7 aa, Neisseria
RTTRKVT

SEQ ID NO: 23770 - protein, 10 aa, Neisseria
ETEGLNRIRQ

SEQ ID NO: 23771 - protein, 11 aa, Neisseria
INVLSGNSIQH

SEQ ID NO: 23772 - protein, 9 aa, Neisseria
THEISDIVT

SEQ ID NO: 23773 - protein, 13 aa, Neisseria
EPATGKVVTAFPD

SEQ ID NO: 23774 - protein, 7 aa, Neisseria
KPLRRLI

SEQ ID NO: 23775 - protein, 16 aa, Neisseria
FITDNAQRQHYEPGGK

SEQ ID NO: 23776 - protein, 14 aa, Neisseria
GDPRGSVSDRTGQI

SEQ ID NO: 23777 - protein, 6 aa, Neisseria
YTHRMG

SEQ ID NO: 23778 - protein, 14 aa, Neisseria
RFSGHGYEEHAPFD

SEQ ID NO: 23779 - protein, 17 aa, Neisseria
HAADSASEEKGNVDEGF

SEQ ID NO: 23780 - protein, 36 aa, Neisseria
LNWEGHEHHPADAYDGPKGGNYPKPTGARDEYTYHV

SEQ ID NO: 23781 - protein, 26 aa, Neisseria
GTARSIKLNPTDTRSIRQRISDNYSN

SEQ ID NO: 23782 - protein, 28 aa, Neisseria
GSNFSDRADEANRKMFEHNAKLDRWGNS

SEQ ID NO: 23783 - protein, 8 aa, Neisseria
YAIDKAAM

SEQ ID NO: 23784 - protein, 5 aa, Neisseria
PAEGK

SEQ ID NO: 23785 - protein, 11 aa, Neisseria
GFEKNTREAVD

SEQ ID NO: 23786 - protein, 13 aa, Neisseria
WIQENPNAAETVE

SEQ ID NO: 23787 - protein, 18 aa, Neisseria
KNLTKAAKPGKAAVSGDF

SEQ ID NO: 23788 - protein, 41 aa, Neisseria
YNTRTTRKVTTETEGLNRIRQNQKNSNIHEKNYGRDNPNHI

SEQ ID NO: 23789 - protein, 8 aa, Neisseria
YGDEAGGG

SEQ ID NO: 23790 - protein, 11 aa, Neisseria
FPGKPGKTTFP

SEQ ID NO: 23791 - protein, 13 aa, Neisseria
HWSASKITHEISD

SEQ ID NO: 23792 - protein, 7 aa, Neisseria
VTSPKTQ

SEQ ID NO: 23793 - protein, 9 aa, Neisseria
YIAKGRPAR

SEQ ID NO: 23794 - protein, 10 aa, Neisseria
SYETRDGIRI

SEQ ID NO: 23795 - protein, 9 aa, Neisseria
TVYEPATGK

SEQ ID NO: 23796 - protein, 14 aa, Neisseria
FPDRTSNPKYNPVK

SEQ ID NO: 23797 - protein, 7 aa, Neisseria
KPLRRLI

SEQ ID NO: 23798 - protein, 11 aa, Neisseria
NAQRQHYEPGG

SEQ ID NO: 23799 - protein, 12 aa, Neisseria
GDPRGSVSDRTG

SEQ ID NO: 23800 - protein, 7 aa, Neisseria
GYEEHAP

SEQ ID NO: 23801 - protein, 16 aa, Neisseria
HAADSASEEKGNVDEG

SEQ ID NO: 23802 - protein, 8 aa, Neisseria
WEGHEHHP

SEQ ID NO: 23803 - protein, 13 aa, Neisseria
DAYDGPKGGNYPK

SEQ ID NO: 23804 - protein, 7 aa, Neisseria
TGARDEY

SEQ ID NO: 23805 - protein, 7 aa, Neisseria
GTARSIK

SEQ ID NO: 23806 - protein, 14 aa, Neisseria
NPTDTRSIRQRISD

SEQ ID NO: 23807 - protein, 24 aa, Neisseria
FSDRADEANRKMFEHNAKLDRWGN

SEQ ID NO: 23808 - protein, 8 aa, Neisseria
YAIDKAAM

SEQ ID NO: 23809 - protein, 5 aa, Neisseria
PAEGK

SEQ ID NO: 23810 - protein, 11 aa, Neisseria
GFEKNTREAVD

SEQ ID NO: 23811 - protein, 9 aa, Neisseria
NPNAAETVE

SEQ ID NO: 23812 - protein, 14 aa, Neisseria
KNLTKAAKPGKAAV

SEQ ID NO: 23813 - protein, 36 aa, Neisseria
RTTRKVTTETEGLNRIRQNQKNSNIHEKNYGRDNPN

SEQ ID NO: 23814 - protein, 5 aa, Neisseria
DEAGG

SEQ ID NO: 23815 - protein, 8 aa, Neisseria
KITHEISD

SEQ ID NO: 23816 - protein, 9 aa, Neisseria
YIAKGRPAR

SEQ ID NO: 23817 - protein, 8 aa, Neisseria
ETRDGIRI

SEQ ID NO: 23818 - protein, 9 aa, Neisseria
FPDRTSNPK

SEQ ID NO: 23819 - protein, 5 aa, Neisseria
ACAVP

SEQ ID NO: 23820 - protein, 10 aa, Neisseria
EAYDDGGRGH

SEQ ID NO: 23821 - protein, 10 aa, Neisseria
PVQNQAGTAD

SEQ ID NO: 23822 - protein, 8 aa, Neisseria
RAFSCENG

SEQ ID NO: 23823 - protein, 34 aa, Neisseria
HVRRLDGGRIALRLDGRRAVLSSDVAASGERYTA

SEQ ID NO: 23824 - protein, 16 aa, Neisseria
GLFGNGTEWHQKGGEA

SEQ ID NO: 23825 - protein, 14 aa, Neisseria
DAYGNSVETSCRAR

SEQ ID NO: 23826 - protein, 10 aa, Neisseria
EAYDDGGRGH

SEQ ID NO: 23827 - protein, 21 aa, Neisseria
HVRRLDGGRIALRLDGRRAVL

SEQ ID NO: 23828 - protein, 10 aa, Neisseria
VAASGERYTA

SEQ ID NO: 23829 - protein, 7 aa, Neisseria
WHQKGGE

SEQ ID NO: 23830 - protein, 8 aa, Neisseria
VETSCRAR

SEQ ID NO: 23831 - protein, 5 aa, Neisseria
LGAIS

SEQ ID NO: 23832 - protein, 12 aa, Neisseria
VQSIRTMAEVYG

SEQ ID NO: 23833 - protein, 13 aa, Neisseria
DADLFEGAMKGMV

SEQ ID NO: 23834 - protein, 8 aa, Neisseria
EIKESTSG

SEQ ID NO: 23835 - protein, 12 aa, Neisseria
DGFVKVVSPIED

SEQ ID NO: 23836 - protein, 6 aa, Neisseria
EAVKKM

SEQ ID NO: 23837 - protein, 5 aa, Neisseria
VNLTR

SEQ ID NO: 23838 - protein, 12 aa, Neisseria
ERTVESVNTAAK

SEQ ID NO: 23839 - protein, 9 aa, Neisseria
KAVPEDYVY

SEQ ID NO: 23840 - protein, 9 aa, Neisseria
SLAGIPAEL

SEQ ID NO: 23841 - protein, 6 aa, Neisseria
SEIVAG

SEQ ID NO: 23842 - protein, 7 aa, Neisseria
LVGHIGN

SEQ ID NO: 23843 - protein, 9 aa, Neisseria
RRIPNPAKD

SEQ ID NO: 23844 - protein, 16 aa, Neisseria
KALDLVKSPEQWQKSL

SEQ ID NO: 23845 - protein, 11 aa, Neisseria
AAEKDRRDNEV

SEQ ID NO: 23846 - protein, 12 aa, Neisseria
NYYQDKPDADLF

SEQ ID NO: 23847 - protein, 25 aa, Neisseria
DPHSEYMDKKGYAEIKESTSGEFGG

SEQ ID NO: 23848 - protein, 7 aa, Neisseria
IGQEDGF

SEQ ID NO: 23849 - protein, 18 aa, Neisseria
SPIEDTPAERAGVKSGDF

SEQ ID NO: 23850 - protein, 9 aa, Neisseria
DNVSTRGMT

SEQ ID NO: 23851 - protein, 14 aa, Neisseria
EAVKKMRGKPGTKI

SEQ ID NO: 23852 - protein, 10 aa, Neisseria
LSRKNADKPI

SEQ ID NO: 23853 - protein, 8 aa, Neisseria
LIEPDYGY

SEQ ID NO: 23854 - protein, 8 aa, Neisseria
QFQERTVE

SEQ ID NO: 23855 - protein, 17 aa, Neisseria
NTAAKELVKENKGKPLK

SEQ ID NO: 23856 - protein, 9 aa, Neisseria
DLRDDPGGL

SEQ ID NO: 23857 - protein, 13 aa, Neisseria
VSTKGRDGKDRMV

SEQ ID NO: 23858 - protein, 7 aa, Neisseria
AVPEDYV

SEQ ID NO: 23859 - protein, 7 aa, Neisseria
MGGDSLA

SEQ ID NO: 23860 - protein, 5 aa, Neisseria
AELKT

SEQ ID NO: 23861 - protein, 6 aa, Neisseria
SGSASA

SEQ ID NO: 23862 - protein, 7 aa, Neisseria
QDHKRAV

SEQ ID NO: 23863 - protein, 9 aa, Neisseria
TQSFGKGSV

SEQ ID NO: 23864 - protein, 5 aa, Neisseria
LSNGS

SEQ ID NO: 23865 - protein, 9 aa, Neisseria
YTPNDRSIQ

SEQ ID NO: 23866 - protein, 17 aa, Neisseria
VEVKDKERIFESREADL

SEQ ID NO: 23867 - protein, 12 aa, Neisseria
GNPLGGEDVNSE

SEQ ID NO: 23868 - protein, 52 aa, Neisseria; identical to SEQ ID NO: 10887

SEQ ID NO: 23869 - protein, 18 aa, Neisseria
AAKKPVSNKDKKDKKDKK

SEQ ID NO: 23870 - protein, 11 aa, Neisseria
AAEKDRRDNEV

SEQ ID NO: 23871 - protein, 11 aa, Neisseria
YYQDKPDADLF

SEQ ID NO: 23872 - protein, 22 aa, Neisseria
DPHSEYMDKKGYAEIKESTSGE

SEQ ID NO: 23873 - protein, 7 aa, Neisseria
IGQEDGF

SEQ ID NO: 23874 - protein, 18 aa, Neisseria
SPIEDTPAERAGVKSGDF

SEQ ID NO: 23875 - protein, 5 aa, Neisseria
DNVST

SEQ ID NO: 23876 - protein, 12 aa, Neisseria
EAVKKMRGKPGT

SEQ ID NO: 23877 - protein, 10 aa, Neisseria
LSRKNADKPI

SEQ ID NO: 23878 - protein, 8 aa, Neisseria
QFQERTVE

SEQ ID NO: 23879 - protein, 17 aa, Neisseria
NTAAKELVKENKGKPLK

SEQ ID NO: 23880 - protein, 7 aa, Neisseria
DLRDDPG

SEQ ID NO: 23881 - protein, 11 aa, Neisseria
TKGRDGKDRMV

SEQ ID NO: 23882 - protein, 5 aa, Neisseria
AELKT

SEQ ID NO: 23883 - protein, 7 aa, Neisseria
QDHKRAV

SEQ ID NO: 23884 - protein, 7 aa, Neisseria
PNDRSIQ

SEQ ID NO: 23885 - protein, 17 aa, Neisseria
VEVKDKERIFESREADL

SEQ ID NO: 23886 - protein, 8 aa, Neisseria
LGGEDVNS

SEQ ID NO: 23887 - protein, 51 aa, Neisseria; identical to SEQ ID NO: 10906

SEQ ID NO: 23888 - protein, 18 aa, Neisseria
AAKKPVSNKDKKDKKDKK

SEQ ID NO: 23889 - protein, 6 aa, Neisseria
TLSRLS

SEQ ID NO: 23890 - protein, 11 aa, Neisseria
YGGYPDTVYEG

SEQ ID NO: 23891 - protein, 11 aa, Neisseria
KQTEKMEKYFV

SEQ ID NO: 23892 - protein, 8 aa, Neisseria
GAFRQFEE

SEQ ID NO: 23893 - protein, 7 aa, Neisseria
MNPKTLS

SEQ ID NO: 23894 - protein, 8 aa, Neisseria
CGGNGQKS

SEQ ID NO: 23895 - protein, 30 aa, Neisseria; identical to SEQ ID NO: 10914

SEQ ID NO: 23896 - protein, 12 aa, Neisseria
AGNKKMNAAPGA

SEQ ID NO: 23897 - protein, 23 aa, Neisseria
LSRSGDKEGAFRQFEEEKRLFPE

SEQ ID NO: 23898 - protein, 9 aa, Neisseria
MKTGKGGKR

SEQ ID NO: 23899 - protein, 23 aa, Neisseria
VYEGLKNDDTSLGKQTEKMEKYF

SEQ ID NO: 23900 - protein, 8 aa, Neisseria
AGNKKMNA

SEQ ID NO: 23901 - protein, 20 aa, Neisseria
RSGDKEGAFRQFEEEKRLFP

SEQ ID NO: 23902 - protein, 9 aa, Neisseria
MKTGKGGKR

SEQ ID NO: 23903 - protein, 6 aa, Neisseria
RAADTY

SEQ ID NO: 23904 - protein, 17 aa, Neisseria
YLAVWQNPQNANDVLQV

SEQ ID NO: 23905 - protein, 11 aa, Neisseria
EAFAELEAFCK

SEQ ID NO: 23906 - protein, 8 aa, Neisseria
TGCRSVVS

SEQ ID NO: 23907 - protein, 11 aa, Neisseria
LAYPKALGAMR

SEQ ID NO: 23908 - protein, 5 aa, Neisseria
RFTSV

SEQ ID NO: 23909 - protein, 10 aa, Neisseria
QVALNQCIKK

SEQ ID NO: 23910 - protein, 5 aa, Neisseria
ARAAD

SEQ ID NO: 23911 - protein, 8 aa, Neisseria
QNPQNAND

SEQ ID NO: 23912 - protein, 15 aa, Neisseria
KTTKEDSTKSEAFAE

SEQ ID NO: 23913 - protein, 8 aa, Neisseria
AFCKGQDT

SEQ ID NO: 23914 - protein, 11 aa, Neisseria
IAEDEPTGCRS

SEQ ID NO: 23915 - protein, 5 aa, Neisseria
MRVEN

SEQ ID NO: 23916 - protein, 9 aa, Neisseria
CIKKYGAQG

SEQ ID NO: 23917 - protein, 5 aa, Neisseria
SSYYG

SEQ ID NO: 23918 - protein, 5 aa, Neisseria
ARAAD

SEQ ID NO: 23919 - protein, 15 aa, Neisseria
KTTKEDSTKSEAFAE

SEQ ID NO: 23920 - protein, 8 aa, Neisseria
AFCKGQDT

SEQ ID NO: 23921 - protein, 9 aa, Neisseria
IAEDEPTGC

SEQ ID NO: 23922 - protein, 5 aa, Neisseria
MRVEN

SEQ ID NO: 23923 - protein, 7 aa, Neisseria
CIKKYGA

SEQ ID NO: 23924 - protein, 5 aa, Neisseria
LLANN

SEQ ID NO: 23925 - protein, 7 aa, Neisseria
QPIAIIA

SEQ ID NO: 23926 - protein, 6 aa, Neisseria
YARELE

SEQ ID NO: 23927 - protein, 7 aa, Neisseria
GCIDGFG

SEQ ID NO: 23928 - protein, 12 aa, Neisseria
HHQGYKSAFAKQ

SEQ ID NO: 23929 - protein, 12 aa, Neisseria
AVIEKMKRDKAQ

SEQ ID NO: 23930 - protein, 20 aa, Neisseria
NYARELEQARAEAKKYEVKA

SEQ ID NO: 23931 - protein, 21 aa, Neisseria
LAKKQAEVSRLKTENKKEIEN

SEQ ID NO: 23932 - protein, 17 aa, Neisseria
LTQDRKNAGGGCIDGFG

SEQ ID NO: 23933 - protein, 5 aa, Neisseria
LGYGN

SEQ ID NO: 23934 - protein, 12 aa, Neisseria
AVIEKMKRDKAQ

SEQ ID NO: 23935 - protein, 20 aa, Neisseria
NYARELEQARAEAKKYEVKA

SEQ ID NO: 23936 - protein, 21 aa, Neisseria
LAKKQAEVSRLKTENKKEIEN

SEQ ID NO: 23937 - protein, 9 aa, Neisseria
LTQDRKNAG

SEQ ID NO: 23938 - protein, 8 aa, Neisseria
GLIQSLGS

SEQ ID NO: 23939 - protein, 5 aa, Neisseria
GVLSV

SEQ ID NO: 23940 - protein, 5 aa, Neisseria
GLFVG

SEQ ID NO: 23941 - protein, 15 aa, Neisseria
LQGYTQLSKFKSADI

SEQ ID NO: 23942 - protein, 8 aa, Neisseria
LLRELGPV

SEQ ID NO: 23943 - protein, 14 aa, Neisseria
LMKTTEQLEAMNVM

SEQ ID NO: 23944 - protein, 8 aa, Neisseria
VNPVARVV

SEQ ID NO: 23945 - protein, 11 aa, Neisseria
PRFWAGVFSMP

SEQ ID NO: 23946 - protein, 13 aa, Neisseria
LASIFNVAGIFGA

SEQ ID NO: 23947 - protein, 6 aa, Neisseria
DVINGL

SEQ ID NO: 23948 - protein, 7 aa, Neisseria
LRASTRT

SEQ ID NO: 23949 - protein, 7 aa, Neisseria
VRPRLSV

SEQ ID NO: 23950 - protein, 5 aa, Neisseria
SKFKS

SEQ ID NO: 23951 - protein, 6 aa, Neisseria
LLRELG

SEQ ID NO: 23952 - protein, 8 aa, Neisseria
SAGGAMTS

SEQ ID NO: 23953 - protein, 7 aa, Neisseria
KTTEQLE

SEQ ID NO: 23954 - protein, 5 aa, Neisseria
QMQNN

SEQ ID NO: 23955 - protein, 11 aa, Neisseria
PTSEGILRAST

SEQ ID NO: 23956 - protein, 5 aa, Neisseria
PRLSV

SEQ ID NO: 23957 - protein, 5 aa, Neisseria
SKFKS

SEQ ID NO: 23958 - protein, 6 aa, Neisseria
LLRELG

SEQ ID NO: 23959 - protein, 7 aa, Neisseria
KTTEQLE

SEQ ID NO: 23960 - protein, 8 aa, Neisseria
AALARVGG

SEQ ID NO: 23961 - protein, 13 aa, Neisseria
AHHDGHGDDDHGH

SEQ ID NO: 23962 - protein, 10 aa, Neisseria
QHSKQDKIIS

SEQ ID NO: 23963 - protein, 8 aa, Neisseria
AQAEKAAL

SEQ ID NO: 23964 - protein, 31 aa, Neisseria; identical to SEQ ID NO: 10983

SEQ ID NO: 23965 - protein, 15 aa, Neisseria
VDARTGRVISSRRDD

SEQ ID NO: 23966 - protein, 10 aa, Neisseria
DGHGDDDHGH

SEQ ID NO: 23967 - protein, 10 aa, Neisseria
QHSKQDKIIS

SEQ ID NO: 23968 - protein, 8 aa, Neisseria
AQAEKAAL

SEQ ID NO: 23969 - protein, 19 aa, Neisseria
VGGKITDIDLEHDNGRPHY

SEQ ID NO: 23970 - protein, 9 aa, Neisseria
EIVKNGQEY

SEQ ID NO: 23971 - protein, 7 aa, Neisseria
VDARTGR

SEQ ID NO: 23972 - protein, 7 aa, Neisseria
ISSRRDD

SEQ ID NO: 23973 - protein, 11 aa, Neisseria
LMNLIYPGMND

SEQ ID NO: 23974 - protein, 9 aa, Neisseria
IGSLLQSCI

SEQ ID NO: 23975 - protein, 9 aa, Neisseria
TYIAAIALI

SEQ ID NO: 23976 - protein, 9 aa, Neisseria
TILETFTGI

SEQ ID NO: 23977 - protein, 16 aa, Neisseria
VERVANGGFTDLPRQI

SEQ ID NO: 23978 - protein, 6 aa, Neisseria
LAAFQS

SEQ ID NO: 23979 - protein, 8 aa, Neisseria
GHGWNSFA

SEQ ID NO: 23980 - protein, 9 aa, Neisseria
DNLLSNLFT

SEQ ID NO: 23981 - protein, 11 aa, Neisseria
LLTGIAGLLKR

SEQ ID NO: 23982 - protein, 6 aa, Neisseria
MCHSML

SEQ ID NO: 23983 - protein, 8 aa, Neisseria
RMVNAFSP

SEQ ID NO: 23984 - protein, 9 aa, Neisseria
DSAKTLNRK

SEQ ID NO: 23985 - protein, 7 aa, Neisseria
NELRYIS

SEQ ID NO: 23986 - protein, 7 aa, Neisseria
LPEYPET

SEQ ID NO: 23987 - protein, 8 aa, Neisseria
AKQWMRAT

SEQ ID NO: 23988 - protein, 10 aa, Neisseria
YADEIRKLPV

SEQ ID NO: 23989 - protein, 17 aa, Neisseria
PLLPELLKDCKAFAAAP

SEQ ID NO: 23990 - protein, 9 aa, Neisseria
LQPSPDFYH

SEQ ID NO: 23991 - protein, 7 aa, Neisseria
AGKKLFD

SEQ ID NO: 23992 - protein, 7 aa, Neisseria
HYGQERI

SEQ ID NO: 23993 - protein, 7 aa, Neisseria
GWEDTPL

SEQ ID NO: 23994 - protein, 7 aa, Neisseria
GQRNNLG

SEQ ID NO: 23995 - protein, 9 aa, Neisseria
LNGQRKIPP

SEQ ID NO: 23996 - protein, 11 aa, Neisseria
FRSDKSNRRTI

SEQ ID NO: 23997 - protein, 22 aa, Neisseria
TAVERVANGGFTDLPRQIEWRK

SEQ ID NO: 23998 - protein, 8 aa, Neisseria
GHGWNSFA

SEQ ID NO: 23999 - protein, 10 aa, Neisseria
EQHNIHDNLL

SEQ ID NO: 24000 - protein, 7 aa, Neisseria
LLKRPLT

SEQ ID NO: 24001 - protein, 14 aa, Neisseria
PAEASDGIAFKKAA

SEQ ID NO: 24002 - protein, 16 aa, Neisseria
PATDDSAKTLNRKINE

SEQ ID NO: 24003 - protein, 11 aa, Neisseria
PEYPETQTWAE

SEQ ID NO: 24004 - protein, 13 aa, Neisseria
ATLKSLKYRPHSA

SEQ ID NO: 24005 - protein, 12 aa, Neisseria
RQGKVAEAKQWM

SEQ ID NO: 24006 - protein, 5 aa, Neisseria
ATQSY

SEQ ID NO: 24007 - protein, 8 aa, Neisseria
RYADEIRK

SEQ ID NO: 24008 - protein, 7 aa, Neisseria
LLKDCKA

SEQ ID NO: 24009 - protein, 10 aa, Neisseria
PGHPEAKPCK

SEQ ID NO: 24010 - protein, 7 aa, Neisseria
AGKKLFD

SEQ ID NO: 24011 - protein, 5 aa, Neisseria
GQERI

SEQ ID NO: 24012 - protein, 6 aa, Neisseria
GQRKIP

SEQ ID NO: 24013 - protein, 10 aa, Neisseria
RSDKSNRRTI

SEQ ID NO: 24014 - protein, 7 aa, Neisseria
TAVERVA

SEQ ID NO: 24015 - protein, 5 aa, Neisseria
IEWRK

SEQ ID NO: 24016 - protein, 5 aa, Neisseria
EQHNI

SEQ ID NO: 24017 - protein, 7 aa, Neisseria
LLKRPLT

SEQ ID NO: 24018 - protein, 5 aa, Neisseria
AEASD

SEQ ID NO: 24019 - protein, 7 aa, Neisseria
IAFKKAA

SEQ ID NO: 24020 - protein, 15 aa, Neisseria
ATDDSAKTLNRKINE

SEQ ID NO: 24021 - protein, 5 aa, Neisseria
LKYRP

SEQ ID NO: 24022 - protein, 12 aa, Neisseria
RQGKVAEAKQWM

SEQ ID NO: 24023 - protein, 8 aa, Neisseria
RYADEIRK

SEQ ID NO: 24024 - protein, 7 aa, Neisseria
LLKDCKA

SEQ ID NO: 24025 - protein, 9 aa, Neisseria
GHPEAKPCK

SEQ ID NO: 24026 - protein, 6 aa, Neisseria
NKPFRL

SEQ ID NO: 24027 - protein, 5 aa, Neisseria
HTDSP

SEQ ID NO: 24028 - protein, 8 aa, Neisseria
PAQPDGTD

SEQ ID NO: 24029 - protein, 10 aa, Neisseria
TDRQPDDAGA

SEQ ID NO: 24030 - protein, 5 aa, Neisseria
AENTL

SEQ ID NO: 24031 - protein, 13 aa, Neisseria
MAKKPNKPFRLTP

SEQ ID NO: 24032 - protein, 24 aa, Neisseria
FNPNGDKTLQTEPQHTDSPRETEF

SEQ ID NO: 24033 - protein, 130 aa, Neisseria
LPNGVVGQDAAQPEHHHASSSAPAQPDGTDESGSGLPSPAAPKKNRVKPQPADTAQTDRQPDDAGAQAENTLKETPVLPTNVPRPEPRKETPEKQAQPKETPKEKETPKENHTKPDTPKNTPPKPHKEIL

SEQ ID NO: 24034 - protein, 11 aa, Neisseria
MAKKPNKPFRL

SEQ ID NO: 24035 - protein, 21 aa, Neisseria
PNGDKTLQTEPQHTDSPRETE

SEQ ID NO: 24036 - protein, 9 aa, Neisseria
DAAQPEHHH

SEQ ID NO: 24037 - protein, 11 aa, Neisseria
AQPDGTDESGS

SEQ ID NO: 24038 - protein, 37 aa, Neisseria
AAPKKNRVKPQPADTAQTDRQPDDAGAQAENTLKETP

SEQ ID NO: 24039 - protein, 49 aa, Neisseria
VPRPEPRKETPEKQAQPKETPKEKETPKENHTKPDTPKNTPPKPHKEIL

SEQ ID NO: 24040 - protein, 9 aa, Neisseria
ANPPEDKPQ

SEQ ID NO: 24041 - protein, 15 aa, Neisseria
IKHHLKQEFDLKRQT

SEQ ID NO: 24042 - protein, 7 aa, Neisseria
PPEDKPQ

SEQ ID NO: 24043 - protein, 15 aa, Neisseria
IKHHLKQEFDLKRQT

SEQ ID NO: 24044 - protein, 12 aa, Neisseria
DIGAVLADALTA

SEQ ID NO: 24045 - protein, 10 aa, Neisseria
SRFDFIRQIE

SEQ ID NO: 24046 - protein, 11 aa, Neisseria
TSFDKLPEGGR

SEQ ID NO: 24047 - protein, 5 aa, Neisseria
IEHLK

SEQ ID NO: 24048 - protein, 8 aa, Neisseria
QEVAGSAE

SEQ ID NO: 24049 - protein, 5 aa, Neisseria
SSGGG

SEQ ID NO: 24050 - protein, 8 aa, Neisseria
LDHKDKSL

SEQ ID NO: 24051 - protein, 12 aa, Neisseria
DQSVRKNEKLKL

SEQ ID NO: 24052 - protein, 27 aa, Neisseria
GAEKTYGNGDSLNTGKLKNDKVSRFDF

SEQ ID NO: 24053 - protein, 7 aa, Neisseria
IEVDGQL

SEQ ID NO: 24054 - protein, 8 aa, Neisseria
VYKQSHSA

SEQ ID NO: 24055 - protein, 44 aa, Neisseria
QTEQVQDSEHSGKMVAKRQFRIGDIAGEHTSFDKLPEGGRATYR

SEQ ID NO: 24056 - protein, 12 aa, Neisseria
TAFGSDDASGKL

SEQ ID NO: 24057 - protein, 20 aa, Neisseria
FAAKQGHGKIEHLKSPELNV

SEQ ID NO: 24058 - protein, 13 aa, Neisseria
AASDIKPDKKRHA

SEQ ID NO: 24059 - protein, 9 aa, Neisseria
NQAEKGSYS

SEQ ID NO: 24060 - protein, 9 aa, Neisseria
GGQAQEVAG

SEQ ID NO: 24061 - protein, 8 aa, Neisseria
AEVETANG

SEQ ID NO: 24062 - protein, 8 aa, Neisseria
LDHKDKSL

SEQ ID NO: 24063 - protein, 11 aa, Neisseria
QSVRKNEKLKL

SEQ ID NO: 24064 - protein, 8 aa, Neisseria
GAEKTYGN

SEQ ID NO: 24065 - protein, 10 aa, Neisseria
GKLKNDKVSR

SEQ ID NO: 24066 - protein, 5 aa, Neisseria
IEVDG

SEQ ID NO: 24067 - protein, 9 aa, Neisseria
QVQDSEHSG

SEQ ID NO: 24068 - protein, 9 aa, Neisseria
MVAKRQFRI

SEQ ID NO: 24069 - protein, 5 aa, Neisseria
DIAGE

SEQ ID NO: 24070 - protein, 14 aa, Neisseria
TSFDKLPEGGRATY

SEQ ID NO: 24071 - protein, 7 aa, Neisseria
GSDDASG

SEQ ID NO: 24072 - protein, 16 aa, Neisseria
QGHGKIEHLKSPELNV

SEQ ID NO: 24073 - protein, 13 aa, Neisseria
AASDIKPDKKRHA

SEQ ID NO: 24074 - protein, 6 aa, Neisseria
QAEKGS

SEQ ID NO: 24075 - protein, 7 aa, Neisseria
QAQEVAG

SEQ ID NO: 24076 - protein, 5 aa, Neisseria
AEVET

SEQ ID NO: 24077 - protein, 5 aa, Neisseria
REVPD

SEQ ID NO: 24078 - protein, 5 aa, Neisseria
NRPLQ

SEQ ID NO: 24079 - protein, 6 aa, Neisseria
EDWSRL

SEQ ID NO: 24080 - protein, 11 aa, Neisseria
NLFSGFKHVFD

SEQ ID NO: 24081 - protein, 8 aa, Neisseria
KALEKLKA

SEQ ID NO: 24082 - protein, 8 aa, Neisseria
DETAKEYR

SEQ ID NO: 24083 - protein, 12 aa, Neisseria
NAAQRFPNSLYD

SEQ ID NO: 24084 - protein, 5 aa, Neisseria
VYAGS

SEQ ID NO: 24085 - protein, 5 aa, Neisseria
SSPLV

SEQ ID NO: 24086 - protein, 6 aa, Neisseria
RNAKKI

SEQ ID NO: 24087 - protein, 18 aa, Neisseria
TPAFTGFSGTVPVWKTVK

SEQ ID NO: 24088 - protein, 11 aa, Neisseria
LYNYAKYLNTN

SEQ ID NO: 24089 - protein, 9 aa, Neisseria
LHLLGGLHY

SEQ ID NO: 24090 - protein, 6 aa, Neisseria
FQTASS

SEQ ID NO: 24091 - protein, 14 aa, Neisseria
IYGSYTKIFKQQDN

SEQ ID NO: 24092 - protein, 16 aa, Neisseria
GSFQTVAKPIGKVVSR

SEQ ID NO: 24093 - protein, 8 aa, Neisseria
EDWKVFAG

SEQ ID NO: 24094 - protein, 5 aa, Neisseria
RYKNA

SEQ ID NO: 24095 - protein, 5 aa, Neisseria
AKNTG

SEQ ID NO: 24096 - protein, 12 aa, Neisseria
PYNFSNFTPVHI

SEQ ID NO: 24097 - protein, 7 aa, Neisseria
TSSLYNI

SEQ ID NO: 24098 - protein, 10 aa, Neisseria
YGLIDGFVRY

SEQ ID NO: 24099 - protein, 7 aa, Neisseria
LGKHAKL

SEQ ID NO: 24100 - protein, 14 aa, Neisseria
YNRTRGANNFYGEP

SEQ ID NO: 24101 - protein, 7 aa, Neisseria
AEADAGD

SEQ ID NO: 24102 - protein, 13 aa, Neisseria
MYQKSREVPDFSG

SEQ ID NO: 24103 - protein, 41 aa, Neisseria
SCENQKTAPFSSTPACNRPLQLPRNTYLGEDWSRLSADKYN

SEQ ID NO: 24104 - protein, 5 aa, Neisseria
FDNGW

SEQ ID NO: 24105 - protein, 11 aa, Neisseria
SYTKNESDAKV

SEQ ID NO: 24106 - protein, 6 aa, Neisseria
LSDEDA

SEQ ID NO: 24107 - protein, 46 aa, Neisseria; identical to SEQ ID NO: 11126

SEQ ID NO: 24108 - protein, 19 aa, Neisseria
EQYRSRRAAERKAGFDECM

SEQ ID NO: 24109 - protein, 19 aa, Neisseria
CQGSWGDPGVDADKSEFVD

SEQ ID NO: 24110 - protein, 28 aa, Neisseria
AAQRFPNSLYDSSFNRKATANRRYSYMP

SEQ ID NO: 24111 - protein, 9 aa, Neisseria
RHTKDDRQW

SEQ ID NO: 24112 - protein, 5 aa, Neisseria
GREHD

SEQ ID NO: 24113 - protein, 12 aa, Neisseria
YAYGDEKIRSEY

SEQ ID NO: 24114 - protein, 15 aa, Neisseria
EIYERRHRVRPNTGA

SEQ ID NO: 24115 - protein, 10 aa, Neisseria
CQGEPDGDLS

SEQ ID NO: 24116 - protein, 42 aa, Neisseria; identical to SEQ ID NO: 11135

SEQ ID NO: 24117 - protein, 10 aa, Neisseria
YYDEYSGSRT

SEQ ID NO: 24118 - protein, 19 aa, Neisseria
YELDEKGNKIQETNPDGTP

SEQ ID NO: 24119 - protein, 7 aa, Neisseria
KVADDHV

SEQ ID NO: 24120 - protein, 8 aa, Neisseria
YLNTNKTH

SEQ ID NO: 24121 - protein, 23 aa, Neisseria
RYETSQTKDMPVRYGQPASDFQT

SEQ ID NO: 24122 - protein, 11 aa, Neisseria
SSIKADQDHYT

SEQ ID NO: 24123 - protein, 9 aa, Neisseria
KMQGHKLTP

SEQ ID NO: 24124 - protein, 5 aa, Neisseria
GSYTK

SEQ ID NO: 24125 - protein, 11 aa, Neisseria
FKQQDNVDVSA

SEQ ID NO: 24126 - protein, 5 aa, Neisseria
GRLNA

SEQ ID NO: 24127 - protein, 9 aa, Neisseria
LEQKNRTVV

SEQ ID NO: 24128 - protein, 8 aa, Neisseria
GAGGKQGS

SEQ ID NO: 24129 - protein, 19 aa, Neisseria
VVSRGAEFELSGELNEDWK

SEQ ID NO: 24130 - protein, 31 aa, Neisseria
TYNKSRYKNAAEVNAERLAKNTGADPYNFSN

SEQ ID NO: 24131 - protein, 17 aa, Neisseria
VSAQSGTSSLYNIRQGG

SEQ ID NO: 24132 - protein, 7 aa, Neisseria
ELGKHAK

SEQ ID NO: 24133 - protein, 32 aa, Neisseria; identical to SEQ ID NO: 11152

SEQ ID NO: 24134 - protein, 7 aa, Neisseria
AEADAGD

SEQ ID NO: 24135 - protein, 8 aa, Neisseria
QKSREVPD

SEQ ID NO: 24136 - protein, 9 aa, Neisseria
DWSRLSADK

SEQ ID NO: 24137 - protein, 11 aa, Neisseria
SYTKNESDAKV

SEQ ID NO: 24138 - protein, 6 aa, Neisseria
LSDEDA

SEQ ID NO: 24139 - protein, 46 aa, Neisseria; identical to SEQ ID NO: 11126

SEQ ID NO: 24140 - protein, 19 aa, Neisseria
EQYRSRRAAERKAGFDECM

SEQ ID NO: 24141 - protein, 12 aa, Neisseria
PGVDADKSEFVD

SEQ ID NO: 24142 - protein, 13 aa, Neisseria
SFNRKATANRRYS

SEQ ID NO: 24143 - protein, 9 aa, Neisseria
RHTKDDRQW

SEQ ID NO: 24144 - protein, 5 aa, Neisseria
GREHD

SEQ ID NO: 24145 - protein, 10 aa, Neisseria
YGDEKIRSEY

SEQ ID NO: 24146 - protein, 13 aa, Neisseria
EIYERRHRVRPNT

SEQ ID NO: 24147 - protein, 9 aa, Neisseria
CQGEPDGDL

SEQ ID NO: 24148 - protein, 7 aa, Neisseria
RGHKEPD

SEQ ID NO: 24149 - protein, 8 aa, Neisseria
AYDEKGNR

SEQ ID NO: 24150 - protein, 24 aa, Neisseria
VYAEECRNAKKIKTEPKLDAEGKQ

SEQ ID NO: 24151 - protein, 5 aa, Neisseria
YSGSR

SEQ ID NO: 24152 - protein, 17 aa, Neisseria
YELDEKGNKIQETNPDG

SEQ ID NO: 24153 - protein, 7 aa, Neisseria
KVADDHV

SEQ ID NO: 24154 - protein, 12 aa, Neisseria
RYETSQTKDMPV

SEQ ID NO: 24155 - protein, 5 aa, Neisseria
QPASD

SEQ ID NO: 24156 - protein, 11 aa, Neisseria
SSIKADQDHYT

SEQ ID NO: 24157 - protein, 11 aa, Neisseria
FKQQDNVDVSA

SEQ ID NO: 24158 - protein, 7 aa, Neisseria
QKNRTVV

SEQ ID NO: 24159 - protein, 7 aa, Neisseria
AGGKQGS

SEQ ID NO: 24160 - protein, 19 aa, Neisseria
VVSRGAEFELSGELNEDWK

SEQ ID NO: 24161 - protein, 18 aa, Neisseria
NKSRYKNAAEVNAERLAK

SEQ ID NO: 24162 - protein, 7 aa, Neisseria
ELGKHAK

SEQ ID NO: 24163 - protein, 7 aa, Neisseria
NYNRTRG

SEQ ID NO: 24164 - protein, 8 aa, Neisseria
GEPRTVSM

SEQ ID NO: 24165 - protein, 5 aa, Neisseria
YGGSF

SEQ ID NO: 24166 - protein, 5 aa, Neisseria
SYTID

SEQ ID NO: 24167 - protein, 6 aa, Neisseria
MSTATG

SEQ ID NO: 24168 - protein, 17 aa, Neisseria
TLEEAMKNTTGVNVVRD

SEQ ID NO: 24169 - protein, 13 aa, Neisseria
VYDHIEVVRGATG

SEQ ID NO: 24170 - protein, 5 aa, Neisseria
MNQNH

SEQ ID NO: 24171 - protein, 7 aa, Neisseria
VSDGNTV

SEQ ID NO: 24172 - protein, 26 aa, Neisseria
VNVRGSHALSGKTEKTRSYTIDRMST

SEQ ID NO: 24173 - protein, 9 aa, Neisseria
IAGKDTPQS

SEQ ID NO: 24174 - protein, 22 aa, Neisseria
TRSRLDDKAVHTLEEAMKNTTG

SEQ ID NO: 24175 - protein, 16 aa, Neisseria
VVRDSGLQTRFLSRGF

SEQ ID NO: 24176 - protein, 7 aa, Neisseria
QIGEDGI

SEQ ID NO: 24177 - protein, 16 aa, Neisseria
GRSGYTAKIDVSPSTD

SEQ ID NO: 24178 - protein, 18 aa, Neisseria
EVVRGATGLTQSNSEPGG

SEQ ID NO: 24179 - protein, 5 aa, Neisseria
LIRKR

SEQ ID NO: 24180 - protein, 18 aa, Neisseria
LSGKTEKTRSYTIDRMST

SEQ ID NO: 24181 - protein, 8 aa, Neisseria
IAGKDTPQ

SEQ ID NO: 24182 - protein, 19 aa, Neisseria
TRSRLDDKAVHTLEEAMKN

SEQ ID NO: 24183 - protein, 7 aa, Neisseria
VVRDSGL

SEQ ID NO: 24184 - protein, 7 aa, Neisseria
QIGEDGI

SEQ ID NO: 24185 - protein, 7 aa, Neisseria
SNSEPGG

SEQ ID NO: 24186 - protein, 5 aa, Neisseria
LIRKR

SEQ ID NO: 24187 - protein, 8 aa, Neisseria
LSGYEQLK

SEQ ID NO: 24188 - protein, 10 aa, Neisseria
LSSGPAEQTA

SEQ ID NO: 24189 - protein, 8 aa, Neisseria
SAADKPQD

SEQ ID NO: 24190 - protein, 5 aa, Neisseria
SEPEN

SEQ ID NO: 24191 - protein, 17 aa, Neisseria
LEASEKLQQAETAKTAP

SEQ ID NO: 24192 - protein, 6 aa, Neisseria
DTVAVE

SEQ ID NO: 24193 - protein, 7 aa, Neisseria
PKRTAET

SEQ ID NO: 24194 - protein, 5 aa, Neisseria
KAERT

SEQ ID NO: 24195 - protein, 12 aa, Neisseria
TKTAEKVADKPK

SEQ ID NO: 24196 - protein, 14 aa, Neisseria
SAVKEAKKADKAES

SEQ ID NO: 24197 - protein, 17 aa, Neisseria
ETAQKTDKADKTKTAEK

SEQ ID NO: 24198 - protein, 8 aa, Neisseria
STITEIMT

SEQ ID NO: 24199 - protein, 11 aa, Neisseria
YKNARDAERDL

SEQ ID NO: 24200 - protein, 26 aa, Neisseria
MSENKQNEVLSGYEQLKRRNRRRLVT

SEQ ID NO: 24201 - protein, 21 aa, Neisseria
SSGPAEQTAGETSGVENKAAG

SEQ ID NO: 24202 - protein, 28 aa, Neisseria
SAADKPQDLAGEDKPSAADSEISEPENV

SEQ ID NO: 24203 - protein, 156 aa, Neisseria
NDRLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAA

SEQ ID NO: 24204 - protein, 20 aa, Neisseria
GYAEKERALSLQRKMKAAGI

SEQ ID NO: 24205 - protein, 31 aa, Neisseria; identical to SEQ ID NO: 11317

SEQ ID NO: 24206 - protein, 9 aa, Neisseria
MSENKQNEV

SEQ ID NO: 24207 - protein, 12 aa, Neisseria
EQLKRRNRRRLV

SEQ ID NO: 24208 - protein, 19 aa, Neisseria
GPAEQTAGETSGVENKAAG

SEQ ID NO: 24209 - protein, 28 aa, Neisseria
SAADKPQDLAGEDKPSAADSEISEPENV

SEQ ID NO: 24210 - protein, 46 aa, Neisseria
DRLEDSNIKGLEASEKLQQAETAKTAPKQAKQRAAEKVPATADSTD

SEQ ID NO: 24211 - protein, 108 aa, Neisseria; identical to SEQ ID NO: 11323

SEQ ID NO: 24212 - protein, 19 aa, Neisseria
YAEKERALSLQRKMKAAGI

SEQ ID NO: 24213 - protein, 31 aa, Neisseria; identical to SEQ ID NO: 11317

SEQ ID NO: 24214 - protein, 8 aa, Neisseria
VSKSAKGW

SEQ ID NO: 24215 - protein, 10 aa, Neisseria
YADLRGKTKV

SEQ ID NO: 24216 - protein, 13 aa, Neisseria
CASRDVSKSAKGW

SEQ ID NO: 24217 - protein, 47 aa, Neisseria
NVGKQLTDSVGLEFDPYYRHKTICKPREIVLDGDKTKMGRSKSNEYG

SEQ ID NO: 24218 - protein, 6 aa, Neisseria
SQLKSK

SEQ ID NO: 24219 - protein, 10 aa, Neisseria
YADLRGKTKV

SEQ ID NO: 24220 - protein, 11 aa, Neisseria
CASRDVSKSAK

SEQ ID NO: 24221 - protein, 25 aa, Neisseria
TICKPREIVLDGDKTKMGRSKSNEY

SEQ ID NO: 24222 - protein, 8 aa, Neisseria
GAVGAIGG

SEQ ID NO: 24223 - protein, 9 aa, Neisseria
AERTAESQH

SEQ ID NO: 24224 - protein, 12 aa, Neisseria
SAKQLENLFRTL

SEQ ID NO: 24225 - protein, 16 aa, Neisseria
LQEMRDFSNDKLQKSW

SEQ ID NO: 24226 - protein, 13 aa, Neisseria
QAALRDIIKHTVQ

SEQ ID NO: 24227 - protein, 6 aa, Neisseria
GVAANS

SEQ ID NO: 24228 - protein, 5 aa, Neisseria
DEPEW

SEQ ID NO: 24229 - protein, 15 aa, Neisseria
QAVRLIRHFVEFWDR

SEQ ID NO: 24230 - protein, 6 aa, Neisseria
QPDFAK

SEQ ID NO: 24231 - protein, 6 aa, Neisseria
RDPEFL

SEQ ID NO: 24232 - protein, 8 aa, Neisseria
LEEYISPF

SEQ ID NO: 24233 - protein, 15 aa, Neisseria
MSKNQPAQPTRRTLF

SEQ ID NO: 24234 - protein, 24 aa, Neisseria
GYLGGKKRGETAERTAESQHSPQA

SEQ ID NO: 24235 - protein, 9 aa, Neisseria
AQSAKQLEN

SEQ ID NO: 24236 - protein, 19 aa, Neisseria
TQGGEYQDGDDKLPPAGSG

SEQ ID NO: 24237 - protein, 7 aa, Neisseria
FNPDGLT

SEQ ID NO: 24238 - protein, 16 aa, Neisseria
SLFDGRFGLKDKKPIH

SEQ ID NO: 24239 - protein, 21 aa, Neisseria
QEMRDFSNDKLQKSWCDGDLS

SEQ ID NO: 24240 - protein, 5 aa, Neisseria
TPETC

SEQ ID NO: 24241 - protein, 14 aa, Neisseria
IDGWQPKSEPGAMA

SEQ ID NO: 24242 - protein, 20 aa, Neisseria
LGFRDGTGNPKVSDPKTADE

SEQ ID NO: 24243 - protein, 15 aa, Neisseria
SLDEPEWAKNGSYQA

SEQ ID NO: 24244 - protein, 68 aa, Neisseria
FWDRTPLQEQTDIFGRRKYSGAPMDGKKEADQPDFAKDPEGNTTPKDSHIRLANPRDPEFLKKHRLFR

SEQ ID NO: 24245 - protein, 14 aa, Neisseria
AYSYSRGLASSGQL

SEQ ID NO: 24246 - protein, 9 aa, Neisseria
LNGEPLEEY

SEQ ID NO: 24247 - protein, 8 aa, Neisseria
PGVEKGGF

SEQ ID NO: 24248 - protein, 6 aa, Neisseria
MSKNQP

SEQ ID NO: 24249 - protein, 8 aa, Neisseria
QPTRRTLF

SEQ ID NO: 24250 - protein, 17 aa, Neisseria
GGKKRGETAERTAESQH

SEQ ID NO: 24251 - protein, 9 aa, Neisseria
AQSAKQLEN

SEQ ID NO: 24252 - protein, 12 aa, Neisseria
GEYQDGDDKLPP

SEQ ID NO: 24253 - protein, 10 aa, Neisseria
FGLKDKKPIH

SEQ ID NO: 24254 - protein, 20 aa, Neisseria
QEMRDFSNDKLQKSWCDGDL

SEQ ID NO: 24255 - protein, 11 aa, Neisseria
WQPKSEPGAMA

SEQ ID NO: 24256 - protein, 16 aa, Neisseria
RDGTGNPKVSDPKTAD

SEQ ID NO: 24257 - protein, 9 aa, Neisseria
SLDEPEWAK

SEQ ID NO: 24258 - protein, 16 aa, Neisseria
TPLQEQTDIFGRRKYS

SEQ ID NO: 24259 - protein, 28 aa, Neisseria
PMDGKKEADQPDFAKDPEGNTTPKDSHI

SEQ ID NO: 24260 - protein, 16 aa, Neisseria
ANPRDPEFLKKHRLFR

SEQ ID NO: 24261 - protein, 6 aa, Neisseria
EPLEEY

SEQ ID NO: 24262 - protein, 6 aa, Neisseria
GVEKGG

SEQ ID NO: 24263 - protein, 388 aa, Neisseria
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIETKNKALLEKTDTNFKQVNEILAKYRTKDGFETYDKLGEADRKALQASINALAEDLAQLRGILGLK

SEQ ID NO: 24264 - protein, 321 aa, Neisseria
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 24265 - protein, 186 aa, Neisseria
  VARIANT (1)...(186): Xaa is any amino acid
MTANFAQTLVEIQDSLXRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 24266 - protein, 167 aa, Neisseria
MNNLTVFTRFDTDLATLADELQYVWEHTAVTDHQGKLVEIPVCYGGEYGPDLAEVAAFHQTVISEIVRRHTAQTYTVFMMGFQPGFPYLGGLPEALHTPRRAVPRTSVPAGSVGIGGSQTGVYPFASPGGWQIIGRTELPLFRADLNPPTLLAAGDQVRFVAERIEP

SEQ ID NO: 24267 - protein, 703 aa, Neisseria
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGTVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYDSRNKEVTTLPGFARVDAMLGWNHKNVNVTFAAANLFNQKYWRSDSMPGNPRGYTARVNYRF

SEQ ID NO: 24268 - protein, 147 aa, Neisseria; identical to SEQ ID NO: 12005

SEQ ID NO: 24269 - protein, 467 aa, Neisseria
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTGLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 24270 - protein, 435 aa, Neisseria
MFFSALKSFLSRYITVWRNVWAVRDQLEPPKRTAEEQAFLPAHLELTDTPVSAAPKWAARFIMAFALLALLWSWFGKIDIVAAASGKTVSGGRSKTIQPLETVVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVVAPDDDKMDVEVLVLNKDIGFVEQGQDAVVKIESFPYTRYGYLTGKVKSVSHDAVSHEQLGLVYTAVVSLDKHTLNIDGK

SEQ ID NO: 24271 - protein, 7 aa, Neisseria
SAISSFC

SEQ ID NO: 24272 - protein, 6 aa, Neisseria
KIIHTY

SEQ ID NO: 24273 - protein, 7 aa, Neisseria
VIGIING

SEQ ID NO: 24274 - protein, 6 aa, Neisseria
RFLNRG

SEQ ID NO: 24275 - protein, 6 aa, Neisseria
FGLCYP

SEQ ID NO: 24276 - protein, 8 aa, Neisseria
GNFKKIAT

SEQ ID NO: 24277 - protein, 7 aa, Neisseria
QGLDRKY

SEQ ID NO: 24278 - protein, 8 aa, Neisseria
VKNKQKFL

SEQ ID NO: 24279 - protein, 7 aa, Neisseria
FLNRGMK

SEQ ID NO: 24280 - protein, 8 aa, Neisseria
LNEEGGWM

SEQ ID NO: 24281 - protein, 8 aa, Neisseria
LSRDYKHI

SEQ ID NO: 24282 - protein, 7 aa, Neisseria
NFKKIAT

SEQ ID NO: 24283 - protein, 6 aa, Neisseria
QGLDRK

SEQ ID NO: 24284 - protein, 8 aa, Neisseria
VKNKQKFL

SEQ ID NO: 24285 - protein, 5 aa, Neisseria
NEEGG

SEQ ID NO: 24286 - protein, 5 aa, Neisseria
RDYKH

SEQ ID NO: 24287 - protein, 13 aa, Neisseria
KIEVLEFFGYFCV

SEQ ID NO: 24288 - protein, 10 aa, Neisseria
GLARMAAAVK

SEQ ID NO: 24289 - protein, 12 aa, Neisseria
KKLMRAYDSPAA

SEQ ID NO: 24290 - protein, 11 aa, Neisseria
SKMQQLTEQYR

SEQ ID NO: 24291 - protein, 13 aa, Neisseria
FDGGVHTIKELVA

SEQ ID NO: 24292 - protein, 8 aa, Neisseria
TEGEDYLV

SEQ ID NO: 24293 - protein, 13 aa, Neisseria
KPIPQKQSGKIEV

SEQ ID NO: 24294 - protein, 8 aa, Neisseria
LPSDAYLR

SEQ ID NO: 24295 - protein, 8 aa, Neisseria
LSGLKYQA

SEQ ID NO: 24296 - protein, 14 aa, Neisseria
YEQKIRLENRSVAE

SEQ ID NO: 24297 - protein, 21 aa, Neisseria
WALSQKGFDGKKLMRAYDSPA

SEQ ID NO: 24298 - protein, 17 aa, Neisseria
SKMQQLTEQYRIDSTPT

SEQ ID NO: 24299 - protein, 7 aa, Neisseria
VGGKYRV

SEQ ID NO: 24300 - protein, 8 aa, Neisseria
FNNGFDGG

SEQ ID NO: 24301 - protein, 18 aa, Neisseria
LVAKVREERKRQTPAVQK

SEQ ID NO: 24302 - protein, 5 aa, Neisseria
TEGED

SEQ ID NO: 24303 - protein, 13 aa, Neisseria
KPIPQKQSGKIEV

SEQ ID NO: 24304 - protein, 14 aa, Neisseria
YEQKIRLENRSVAE

SEQ ID NO: 24305 - protein, 13 aa, Neisseria
KGFDGKKLMRAYD

SEQ ID NO: 24306 - protein, 6 aa, Neisseria
SKMQQL

SEQ ID NO: 24307 - protein, 5 aa, Neisseria
YRIDS

SEQ ID NO: 24308 - protein, 18 aa, Neisseria
LVAKVREERKRQTPAVQK

SEQ ID NO: 24309 - protein, 119 aa, Neisseria
MNIKHLITAALIASAAFAAQAAPQKPVSAAQTAQHSAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 24310 - protein, 490 aa, Neisseria
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIVAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 24311 - protein, 186 aa, Neisseria
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENPDKR

SEQ ID NO: 24312 - protein, 704 aa, Neisseria
MDLLSVFHKYRLKYAVAVLTILLLAAIGLHASVYRIFTPENIRSRLQQSIAHTHRKISFDADIQRRLLPRPTVILKNLTITEPGGDRTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSDGIGTPKISPFHFEASTSLDGHGITISTTGSPSVRFNAGGADAAGLGLRADTSFRNLHLTAQIPTLALRNNSIKIETVNGAFTAGGEYAQWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 24313 - protein, 298 aa, Neisseria
MFGAVLRIDADCLQIIVACKLFQIVAYGFAALVEGEFHEFGEMLEIVRLADTVFHRNHADDGRIHFRRGVERFGRHVNQHFHIEEILQHHAQAAVVVAFRRGNHTIDHFFLQHKVHIDDIVRHLRQLEQKRRGNVVGQVADDFLFACDAVEIKLQYIAFVNHQFIRKRQRFQTAYDVAVDFDNVQAVQLFRQRFGNRRQTRTDFNHDIIRLRAHGVDNIADNPRVLQKILPETLAGFVFFHRVSFSVETPPFRAVESDSIWEGRNSFQIRTAHRAVLYVSSCVLKHKCVYSIRLMSAL

SEQ ID NO: 24314 - protein, 238 aa, Neisseria
MKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 24315 - protein, 6 aa, Neisseria
EAAAEV

SEQ ID NO: 24316 - protein, 10 aa, Neisseria
GNQTCSRYSN

SEQ ID NO: 24317 - protein, 5 aa, Neisseria
KQAVT

SEQ ID NO: 24318 - protein, 11 aa, Neisseria
TQAYNEMTKSV

SEQ ID NO: 24319 - protein, 7 aa, Neisseria
FARTGKL

SEQ ID NO: 24320 - protein, 9 aa, Neisseria
GSFDLFASV

SEQ ID NO: 24321 - protein, 6 aa, Neisseria
PSEALD

SEQ ID NO: 24322 - protein, 8 aa, Neisseria
TAPDVWTV

SEQ ID NO: 24323 - protein, 11 aa, Neisseria
FLRFWQATRGI

SEQ ID NO: 24324 - protein, 25 aa, Neisseria
MARRSKTFEEAAAEVEERFGHRGIK

SEQ ID NO: 24325 - protein, 8 aa, Neisseria
EGTAKPCV

SEQ ID NO: 24326 - protein, 14 aa, Neisseria
NCPKHGNQTCSRYS

SEQ ID NO: 24327 - protein, 15 aa, Neisseria
GSSWGCPSCGNEQAA

SEQ ID NO: 24328 - protein, 7 aa, Neisseria
TLRKNHI

SEQ ID NO: 24329 - protein, 8 aa, Neisseria
MTKQERIT

SEQ ID NO: 24330 - protein, 8 aa, Neisseria
DVQGDTTI

SEQ ID NO: 24331 - protein, 16 aa, Neisseria
HTHTHNHSDADGKALS

SEQ ID NO: 24332 - protein, 12 aa, Neisseria
LTPRPLLSDRQA

SEQ ID NO: 24333 - protein, 8 aa, Neisseria
ARTGKLTG

SEQ ID NO: 24334 - protein, 6 aa, Neisseria
MPDTSM

SEQ ID NO: 24335 - protein, 7 aa, Neisseria
PVIEKGD

SEQ ID NO: 24336 - protein, 11 aa, Neisseria
PRMRPADEDIV

SEQ ID NO: 24337 - protein, 7 aa, Neisseria
LSDKRLV

SEQ ID NO: 24338 - protein, 15 aa, Neisseria
YQTGRPSEALDLPEG

SEQ ID NO: 24339 - protein, 16 aa, Neisseria
LESKNGLCPPHRQEGV

SEQ ID NO: 24340 - protein, 17 aa, Neisseria
SASKTSCTRPTAARKSA

SEQ ID NO: 24341 - protein, 18 aa, Neisseria
ATRGIPKTRSWRNPNNAC

SEQ ID NO: 24342 - protein, 25 aa, Neisseria
MARRSKTFEEAAAEVEERFGHRGIK

SEQ ID NO: 24343 - protein, 7 aa, Neisseria
CGNEQAA

SEQ ID NO: 24344 - protein, 7 aa, Neisseria
TLRKNHI

SEQ ID NO: 24345 - protein, 7 aa, Neisseria
TKQERIT

SEQ ID NO: 24346 - protein, 11 aa, Neisseria
NHSDADGKALS

SEQ ID NO: 24347 - protein, 7 aa, Neisseria
LLSDRQA

SEQ ID NO: 24348 - protein, 5 aa, Neisseria
RTGKL

SEQ ID NO: 24349 - protein, 6 aa, Neisseria
VIEKGD

SEQ ID NO: 24350 - protein, 11 aa, Neisseria
PRMRPADEDIV

SEQ ID NO: 24351 - protein, 7 aa, Neisseria
LSDKRLV

SEQ ID NO: 24352 - protein, 11 aa, Neisseria
GRPSEALDLPE

SEQ ID NO: 24353 - protein, 7 aa, Neisseria
LESKNGL

SEQ ID NO: 24354 - protein, 6 aa, Neisseria
HRQEGV

SEQ ID NO: 24355 - protein, 17 aa, Neisseria
SASKTSCTRPTAARKSA

SEQ ID NO: 24356 - protein, 11 aa, Neisseria
RGIPKTRSWRN

SEQ ID NO: 24357 - protein, 7 aa, Neisseria
VVAFARF

SEQ ID NO: 24358 - protein, 12 aa, Neisseria
VGKHFRKFCRFR

SEQ ID NO: 24359 - protein, 24 aa, Neisseria
VGLLRLARLFHIGDDFVDRFLGFF

SEQ ID NO: 24360 - protein, 12 aa, Neisseria
QCEEFPEAVVEA

SEQ ID NO: 24361 - protein, 9 aa, Neisseria
HQTLGGDAG

SEQ ID NO: 24362 - protein, 7 aa, Neisseria
VQFHHFG

SEQ ID NO: 24363 - protein, 20 aa, Neisseria
GKPSGGNGLGGLVNHLRLVA

SEQ ID NO: 24364 - protein, 10 aa, Neisseria
IRVLRRADGG

SEQ ID NO: 24365 - protein, 9 aa, Neisseria
DSTDVVAQM

SEQ ID NO: 24366 - protein, 7 aa, Neisseria
LRRVGGQ

SEQ ID NO: 24367 - protein, 7 aa, Neisseria
VDFRRQK

SEQ ID NO: 24368 - protein, 15 aa, Neisseria
KHFRKFCRFRRRGES

SEQ ID NO: 24369 - protein, 5 aa, Neisseria
FKQRA

SEQ ID NO: 24370 - protein, 7 aa, Neisseria
GDDFVDR

SEQ ID NO: 24371 - protein, 8 aa, Neisseria
FPKRNGVA

SEQ ID NO: 24372 - protein, 5 aa, Neisseria
QTNQE

SEQ ID NO: 24373 - protein, 8 aa, Neisseria
FGQCEEFP

SEQ ID NO: 24374 - protein, 13 aa, Neisseria
EHENVGSHEDRVA

SEQ ID NO: 24375 - protein, 9 aa, Neisseria
LGGDAGQNP

SEQ ID NO: 24376 - protein, 12 aa, Neisseria
VESAGKPSGGNG

SEQ ID NO: 24377 - protein, 16 aa, Neisseria
AFDDTVVIGEEEEGFG

SEQ ID NO: 24378 - protein, 13 aa, Neisseria
VLRRADGGADSTD

SEQ ID NO: 24379 - protein, 8 aa, Neisseria
AQMRDAGG

SEQ ID NO: 24380 - protein, 11 aa, Neisseria
MPSEREKDAPI

SEQ ID NO: 24381 - protein, 12 aa, Neisseria
PDLPPTSSRQQT

SEQ ID NO: 24382 - protein, 5 aa, Neisseria
LRRVG

SEQ ID NO: 24383 - protein, 7 aa, Neisseria
VDFRRQK

SEQ ID NO: 24384 - protein, 15 aa, Neisseria
KHFRKFCRFRRRGES

SEQ ID NO: 24385 - protein, 5 aa, Neisseria
PKRNG

SEQ ID NO: 24386 - protein, 6 aa, Neisseria
QCEEFP

SEQ ID NO: 24387 - protein, 13 aa, Neisseria
EHENVGSHEDRVA

SEQ ID NO: 24388 - protein, 7 aa, Neisseria
LGGDAGQ

SEQ ID NO: 24389 - protein, 7 aa, Neisseria
SAGKPSG

SEQ ID NO: 24390 - protein, 11 aa, Neisseria
VVIGEEEEGFG

SEQ ID NO: 24391 - protein, 13 aa, Neisseria
VLRRADGGADSTD

SEQ ID NO: 24392 - protein, 7 aa, Neisseria
AQMRDAG

SEQ ID NO: 24393 - protein, 11 aa, Neisseria
MPSEREKDAPI

SEQ ID NO: 24394 - protein, 8 aa, Neisseria
PPTSSRQQ

SEQ ID NO: 24395 - protein, 7 aa, Neisseria
GLFTVLG

SEQ ID NO: 24396 - protein, 10 aa, Neisseria
VSLTEIFSKS

SEQ ID NO: 24397 - protein, 8 aa, Neisseria
EAFAEIYD

SEQ ID NO: 24398 - protein, 12 aa, Neisseria
AFLAGMGGIALI

SEQ ID NO: 24399 - protein, 11 aa, Neisseria
RLVPNPHETLD

SEQ ID NO: 24400 - protein, 7 aa, Neisseria
VGMMAAF

SEQ ID NO: 24401 - protein, 14 aa, Neisseria
NFPEGLATFFATLE

SEQ ID NO: 24402 - protein, 8 aa, Neisseria
HNIPEGIS

SEQ ID NO: 24403 - protein, 13 aa, Neisseria
CLLSGLAEPLGAA

SEQ ID NO: 24404 - protein, 12 aa, Neisseria
FGSVFGVIAGVM

SEQ ID NO: 24405 - protein, 6 aa, Neisseria
YSDGHE

SEQ ID NO: 24406 - protein, 6 aa, Neisseria
MPDFSM

SEQ ID NO: 24407 - protein, 8 aa, Neisseria
SKTPNPRV

SEQ ID NO: 24408 - protein, 8 aa, Neisseria
FSKSSEAF

SEQ ID NO: 24409 - protein, 7 aa, Neisseria
IYDKDHA

SEQ ID NO: 24410 - protein, 25 aa, Neisseria
LVPNPHETLDAQDPSFQESKRRHIA

SEQ ID NO: 24411 - protein, 5 aa, Neisseria
NFPEG

SEQ ID NO: 24412 - protein, 8 aa, Neisseria
ATRSRKKT

SEQ ID NO: 24413 - protein, 8 aa, Neisseria
SGLAEPLG

SEQ ID NO: 24414 - protein, 15 aa, Neisseria
ELLPAAKRYSDGHET

SEQ ID NO: 24415 - protein, 8 aa, Neisseria
FSKSSEAF

SEQ ID NO: 24416 - protein, 7 aa, Neisseria
IYDKDHA

SEQ ID NO: 24417 - protein, 21 aa, Neisseria
PHETLDAQDPSFQESKRRHIA

SEQ ID NO: 24418 - protein, 7 aa, Neisseria
TRSRKKT

SEQ ID NO: 24419 - protein, 14 aa, Neisseria
ELLPAAKRYSDGHE

SEQ ID NO: 24420 - protein, 359 aa, Neisseria
LHFQRIIKCSEGIWAVGARPTVGFFGKSFKITCKHVVLRRRTVQAVDFTTCLFAVGHFVDVPAYVFACDAHTGGVAVKRVHGSDVVQNSGGTFCQTQGRRNTVFGVMFQIAEEPRSALRAAPYHNAVCGGLFEDGLGFLRRGNVAVDPDRDVQTAFGFGNQVVSRFAFVHLRARASVDGKGGNAAIFGDFGDDGQVLMVVVPTQTGFEGNGYARRFDHRLQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 24421 - protein, 580 aa, Neisseria
MKFFPAPCLLVILAVIPLKTLAADENDAELIRSMQRQQHIDAELLTDANVRFEQPLEKNNYVLSEDETPCTRVNYISLDDKTARKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLVHKTDLTDATGTETESGSRSYSVHYSVPVKKWLFSFNHNGHRYHEATEGYSVNYDYNGKQYQSSLAAERMLWRNRFHKTSVGMKLWTRQTYKYIDDAEIEVQRRRSAGWEAELRHRAYLNRWQLDGKLSYKRGTGMRQSMPAPEENGGGTIPGTSRMKIITAGLDAAAPFMLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 24422 - protein, 435 aa, Neisseria
  VARIANT (1)...(435): Xaa is any amino acid
MMQHNRFFAVGAGGDDGDRRTADFFNPFQICFGIGRCVVAFHAESGFAPTGHGFVNRLAGFYRIRAARQDVGFAAVGQFVADADIDGFNAVHYIEFGNTHTGNAVDLDGAFQGGGIKPAAAACASGYRTEFVSAFCQTCSDFVEQFGRERARTDARGIGFDDAQNIIQHLRAYARACRSRAGEAVGRSNEGVSAVVDVQQRTLRAFKQQFFAVFVFFVQHAGHVGNHRRNARRDFFDNRHHVFRFHRLGIVQMLQLDVVISKDGIQFFTQFFRMQQIGGANGAACHFVFVGRADAAAGRADFAFAARCFSGLVERDVIRQDQRAGRRDFQTAFDVFHACRVQLVDFAQQGFGGDDNARTDEAVQTFMQDAARNQAQNGFFAADNQGMTRIVAALEAHHASGFFRQPVNDFTFTLVAPLCADYYNIFSHSHITXRY

SEQ ID NO: 24423 - protein, 207 aa, Neisseria
MKKPTDTLPVNLQRRRLLCAAGALLLSPLAQAGAQREETLADDVASVMRSSVGSINPPRLVFDNPKEGERWLSAMSARLARFVPDEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 24424 - protein, 166 aa, Neisseria
MRKSRLSQYKQNKLIELFVAGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIVYTDCYRSYDVLDVREFSHFSFAETSFSYQSQHTFCRTTKPY

SEQ ID NO: 24425 - protein, 6 aa, Neisseria
GNNADE

SEQ ID NO: 24426 - protein, 18 aa, Neisseria
TYQDGNGKTAVRQKYPAG

SEQ ID NO: 24427 - protein, 20 aa, Neisseria
QDGSYSKNMNYNQYRPERHA

SEQ ID NO: 24428 - protein, 23 aa, Neisseria
NQTGNNADEEHRQHWQKPKFQNR

SEQ ID NO: 24429 - protein, 14 aa, Neisseria
YQDGNGKTAVRQKY

SEQ ID NO: 24430 - protein, 7 aa, Neisseria
YRPERHA

SEQ ID NO: 24431 - protein, 12 aa, Neisseria
NNADEEHRQHWQ

SEQ ID NO: 24432 - protein, 6 aa, Neisseria
PKFQNR

SEQ ID NO: 24433 - protein, 6 aa, Neisseria
SAERQI

SEQ ID NO: 24434 - protein, 7 aa, Neisseria
KAVKMLE

SEQ ID NO: 24435 - protein, 6 aa, Neisseria
DHWGKP

SEQ ID NO: 24436 - protein, 6 aa, Neisseria
AYKDGR

SEQ ID NO: 24437 - protein, 10 aa, Neisseria
AGDSAERQIY

SEQ ID NO: 24438 - protein, 21 aa, Neisseria
DPYFEQNRTKAVKMLEQRGYQ

SEQ ID NO: 24439 - protein, 10 aa, Neisseria
HDVDADDHWG

SEQ ID NO: 24440 - protein, 10 aa, Neisseria
EAYKDGREYD

SEQ ID NO: 24441 - protein, 12 aa, Neisseria
PDLKIIKEQLDR

SEQ ID NO: 24442 - protein, 8 aa, Neisseria
DSAERQIY

SEQ ID NO: 24443 - protein, 17 aa, Neisseria
YFEQNRTKAVKMLEQRG

SEQ ID NO: 24444 - protein, 10 aa, Neisseria
HDVDADDHWG

SEQ ID NO: 24445 - protein, 10 aa, Neisseria
EAYKDGREYD

SEQ ID NO: 24446 - protein, 9 aa, Neisseria
KIIKEQLDR

SEQ ID NO: 24447 - protein, 8 aa, Neisseria
LEFWVGLF

SEQ ID NO: 24448 - protein, 9 aa, Neisseria
VYADFGDIG

SEQ ID NO: 24449 - protein, 5 aa, Neisseria
VSAQI

SEQ ID NO: 24450 - protein, 7 aa, Neisseria
GDTENLA

SEQ ID NO: 24451 - protein, 10 aa, Neisseria
NLIGKFMTSF

SEQ ID NO: 24452 - protein, 5 aa, Neisseria
MKKNI

SEQ ID NO: 24453 - protein, 7 aa, Neisseria
GGSDKTY

SEQ ID NO: 24454 - protein, 13 aa, Neisseria
GDIGGLKVNAPVK

SEQ ID NO: 24455 - protein, 24 aa, Neisseria
LDPKSYQARVRLDLDGKYQFSSDV

SEQ ID NO: 24456 - protein, 6 aa, Neisseria
TSGLLG

SEQ ID NO: 24457 - protein, 8 aa, Neisseria
QQGGDTEN

SEQ ID NO: 24458 - protein, 16 aa, Neisseria
FAEKNADGGNAEKAAE

SEQ ID NO: 24459 - protein, 5 aa, Neisseria
MKKNI

SEQ ID NO: 24460 - protein, 5 aa, Neisseria
GSDKT

SEQ ID NO: 24461 - protein, 16 aa, Neisseria
LDPKSYQARVRLDLDG

SEQ ID NO: 24462 - protein, 7 aa, Neisseria
QGGDTEN

SEQ ID NO: 24463 - protein, 16 aa, Neisseria
FAEKNADGGNAEKAAE

SEQ ID NO: 24464 - protein, 8 aa, Neisseria
PADAVNQI

SEQ ID NO: 24465 - protein, 5 aa, Neisseria
VLSIL

SEQ ID NO: 24466 - protein, 23 aa, Neisseria
FDFQRMTALAVGNPWRTASDAQK

SEQ ID NO: 24467 - protein, 6 aa, Neisseria
KEFQTL

SEQ ID NO: 24468 - protein, 12 aa, Neisseria
YRNQFGEIIKAK

SEQ ID NO: 24469 - protein, 5 aa, Neisseria
MKKSS

SEQ ID NO: 24470 - protein, 9 aa, Neisseria
NQIRQNATQ

SEQ ID NO: 24471 - protein, 15 aa, Neisseria
LKSGDANTARQKAEA

SEQ ID NO: 24472 - protein, 18 aa, Neisseria
NPWRTASDAQKQALAKEF

SEQ ID NO: 24473 - protein, 25 aa, Neisseria
LKLKNANVNVKDNPIVNKGGKEIIV

SEQ ID NO: 24474 - protein, 12 aa, Neisseria
AEVGVPGQKPVN

SEQ ID NO: 24475 - protein, 10 aa, Neisseria
TYQSGGKYRT

SEQ ID NO: 24476 - protein, 5 aa, Neisseria
YRNQF

SEQ ID NO: 24477 - protein, 11 aa, Neisseria
IKAKGVDGLIA

SEQ ID NO: 24478 - protein, 8 aa, Neisseria
LKAKNGSK

SEQ ID NO: 24479 - protein, 5 aa, Neisseria
MKKSS

SEQ ID NO: 24480 - protein, 5 aa, Neisseria
IRQNA

SEQ ID NO: 24481 - protein, 14 aa, Neisseria
KSGDANTARQKAEA

SEQ ID NO: 24482 - protein, 14 aa, Neisseria
TASDAQKQALAKEF

SEQ ID NO: 24483 - protein, 5 aa, Neisseria
LKLKN

SEQ ID NO: 24484 - protein, 10 aa, Neisseria
NVNVKDNPIV

SEQ ID NO: 24485 - protein, 8 aa, Neisseria
KGGKEIIV

SEQ ID NO: 24486 - protein, 8 aa, Neisseria
VPGQKPVN

SEQ ID NO: 24487 - protein, 7 aa, Neisseria
IKAKGVD

SEQ ID NO: 24488 - protein, 8 aa, Neisseria
LKAKNGSK

SEQ ID NO: 24489 - protein, 13 aa, Neisseria
ETRPADPYEGYNR

SEQ ID NO: 24490 - protein, 9 aa, Neisseria
RGYRKVAPK

SEQ ID NO: 24491 - protein, 14 aa, Neisseria
GVSNFFNNLCDVVS

SEQ ID NO: 24492 - protein, 10 aa, Neisseria
LGGLIDIAGA

SEQ ID NO: 24493 - protein, 14 aa, Neisseria
VRDALGTGITSVYS

SEQ ID NO: 24494 - protein, 10 aa, Neisseria
DLTDSLDEAA

SEQ ID NO: 24495 - protein, 5 aa, Neisseria
LVESA

SEQ ID NO: 24496 - protein, 5 aa, Neisseria
SETQA

SEQ ID NO: 24497 - protein, 13 aa, Neisseria
AETRPADPYEGYN

SEQ ID NO: 24498 - protein, 8 aa, Neisseria
FNDQADRY

SEQ ID NO: 24499 - protein, 15 aa, Neisseria
AARGYRKVAPKPVRA

SEQ ID NO: 24500 - protein, 5 aa, Neisseria
GSNIL

SEQ ID NO: 24501 - protein, 11 aa, Neisseria
LDIKRASEDLV

SEQ ID NO: 24502 - protein, 12 aa, Neisseria
GGIPDNKNTLGD

SEQ ID NO: 24503 - protein, 8 aa, Neisseria
SWGWKNSN

SEQ ID NO: 24504 - protein, 7 aa, Neisseria
STVRDAL

SEQ ID NO: 24505 - protein, 6 aa, Neisseria
YSPKNI

SEQ ID NO: 24506 - protein, 7 aa, Neisseria
TPVGRWG

SEQ ID NO: 24507 - protein, 30 aa, Neisseria; identical to SEQ ID NO: 12376

SEQ ID NO: 24508 - protein, 32 aa, Neisseria; identical to SEQ ID NO: 12377

SEQ ID NO: 24509 - protein, 30 aa, Neisseria
AVQEDSVSETQAEAAGEAETQPGTQPGTQP

SEQ ID NO: 24510 - protein, 13 aa, Neisseria
AETRPADPYEGYN

SEQ ID NO: 24511 - protein, 5 aa, Neisseria
NDQAD

SEQ ID NO: 24512 - protein, 12 aa, Neisseria
RGYRKVAPKPVR

SEQ ID NO: 24513 - protein, 11 aa, Neisseria
LDIKRASEDLV

SEQ ID NO: 24514 - protein, 9 aa, Neisseria
GIPDNKNTL

SEQ ID NO: 24515 - protein, 6 aa, Neisseria
TVRDAL

SEQ ID NO: 24516 - protein, 19 aa, Neisseria
STREGLLDLTDSLDEAAID

SEQ ID NO: 24517 - protein, 7 aa, Neisseria
VRARQTG

SEQ ID NO: 24518 - protein, 24 aa, Neisseria
TPAEGTEDNIDIDELVESAETGAA

SEQ ID NO: 24519 - protein, 22 aa, Neisseria
AVQEDSVSETQAEAAGEAETQP

SEQ ID NO: 24520 - protein, 10 aa, Neisseria
LGILTACAAM

SEQ ID NO: 24521 - protein, 9 aa, Neisseria
AFADRIGDL

SEQ ID NO: 24522 - protein, 6 aa, Neisseria
FQKTFE

SEQ ID NO: 24523 - protein, 7 aa, Neisseria
QKVRQAC

SEQ ID NO: 24524 - protein, 21 aa, Neisseria
FADRIGDLEARLAQLEHRVAV

SEQ ID NO: 24525 - protein, 8 aa, Neisseria
ESGSNTVK

SEQ ID NO: 24526 - protein, 6 aa, Neisseria
LFGSNS

SEQ ID NO: 24527 - protein, 30 aa, Neisseria; identical to SEQ ID NO: 12395

SEQ ID NO: 24528 - protein, 13 aa, Neisseria
FCEDEAIRCRKFD

SEQ ID NO: 24529 - protein, 21 aa, Neisseria
FADRIGDLEARLAQLEHRVAV

SEQ ID NO: 24530 - protein, 26 aa, Neisseria
KTFEASDRNEGVARQKVRQACNRETS

SEQ ID NO: 24531 - protein, 13 aa, Neisseria
FCEDEAIRCRKFD

SEQ ID NO: 24532 - protein, 12 aa, Neisseria
VAVSALSACRQA

SEQ ID NO: 24533 - protein, 6 aa, Neisseria
ISDRSV

SEQ ID NO: 24534 - protein, 34 aa, Neisseria; identical to SEQ ID NO: 8203

SEQ ID NO: 24535 - protein, 5 aa, Neisseria
QAEKF

SEQ ID NO: 24536 - protein, 24 aa, Neisseria
SACRQAEEGPPPLPRQISDRSVGH

SEQ ID NO: 24537 - protein, 10 aa, Neisseria
NLTEHNGPKA

SEQ ID NO: 24538 - protein, 8 aa, Neisseria
NGKPDQPV

SEQ ID NO: 24539 - protein, 11 aa, Neisseria
YTKLPEEPKGI

SEQ ID NO: 24540 - protein, 17 aa, Neisseria
TDWTNPNADTEWMDAKK

SEQ ID NO: 24541 - protein, 37 aa, Neisseria; identical to SEQ ID NO: 8210

SEQ ID NO: 24542 - protein, 10 aa, Neisseria
RQAEEGPPPL

SEQ ID NO: 24543 - protein, 7 aa, Neisseria
QISDRSV

SEQ ID NO: 24544 - protein, 6 aa, Neisseria
EHNGPK

SEQ ID NO: 24545 - protein, 5 aa, Neisseria
GKPDQ

SEQ ID NO: 24546 - protein, 9 aa, Neisseria
KLPEEPKGI

SEQ ID NO: 24547 - protein, 11 aa, Neisseria
NADTEWMDAKK

SEQ ID NO: 24548 - protein, 6 aa, Neisseria
GAEDAL

SEQ ID NO: 24549 - protein, 16 aa, Neisseria
GNKEQAEKFAKDKGGK

SEQ ID NO: 24550 - protein, 5 aa, Neisseria
DDMPD

SEQ ID NO: 24551 - protein, 10 aa, Neisseria
PLAVLTALLL

SEQ ID NO: 24552 - protein, 18 aa, Neisseria
VLKIYNWSEYVDPETVAD

SEQ ID NO: 24553 - protein, 13 aa, Neisseria
IKAGAYQKIDKSL

SEQ ID NO: 24554 - protein, 8 aa, Neisseria
RLMDGVDP

SEQ ID NO: 24555 - protein, 6 aa, Neisseria
RVKKAL

SEQ ID NO: 24556 - protein, 5 aa, Neisseria
DSAAE

SEQ ID NO: 24557 - protein, 12 aa, Neisseria
NSSNTEDIREAT

SEQ ID NO: 24558 - protein, 16 aa, Neisseria
AKNVANAHKYINDFLD

SEQ ID NO: 24559 - protein, 9 aa, Neisseria
KPARELMED

SEQ ID NO: 24560 - protein, 20 aa, Neisseria
CGGSDKPPAEKPAPAENRNV

SEQ ID NO: 24561 - protein, 21 aa, Neisseria
SEYVDPETVADFEKKNGIKVT

SEQ ID NO: 24562 - protein, 19 aa, Neisseria
YDSDETLESKVLTGKSGYD

SEQ ID NO: 24563 - protein, 34 aa, Neisseria; identical to SEQ ID NO: 12431

SEQ ID NO: 24564 - protein, 18 aa, Neisseria
NTERVKKALGTDKLPDNQ

SEQ ID NO: 24565 - protein, 13 aa, Neisseria
FDPEYTSKLKQCG

SEQ ID NO: 24566 - protein, 36 aa, Neisseria; identical to SEQ ID NO: 12434

SEQ ID NO: 24567 - protein, 7 aa, Neisseria
DLARGDT

SEQ ID NO: 24568 - protein, 26 aa, Neisseria
NIAKRRAEEAGGKEKIRVMMPKEGVG

SEQ ID NO: 24569 - protein, 11 aa, Neisseria
VIPKDAKNVAN

SEQ ID NO: 24570 - protein, 12 aa, Neisseria
FLDPEVSAKNGN

SEQ ID NO: 24571 - protein, 31 aa, Neisseria; identical to SEQ ID NO: 12439

SEQ ID NO: 24572 - protein, 9 aa, Neisseria
QWQDVKAGK

SEQ ID NO: 24573 - protein, 19 aa, Neisseria
GGSDKPPAEKPAPAENRNV

SEQ ID NO: 24574 - protein, 15 aa, Neisseria
VDPETVADFEKKNGI

SEQ ID NO: 24575 - protein, 13 aa, Neisseria
YDSDETLESKVLT

SEQ ID NO: 24576 - protein, 7 aa, Neisseria
QKIDKSL

SEQ ID NO: 24577 - protein, 13 aa, Neisseria
EMMRLMDGVDPGH

SEQ ID NO: 24578 - protein, 18 aa, Neisseria
NTERVKKALGTDKLPDNQ

SEQ ID NO: 24579 - protein, 8 aa, Neisseria
EYTSKLKQ

SEQ ID NO: 24580 - protein, 28 aa, Neisseria
NPNSSNTEDIREATALLKKNRPNIKRFT

SEQ ID NO: 24581 - protein, 7 aa, Neisseria
DLARGDT

SEQ ID NO: 24582 - protein, 24 aa, Neisseria
NIAKRRAEEAGGKEKIRVMMPKEG

SEQ ID NO: 24583 - protein, 8 aa, Neisseria
KDAKNVAN

SEQ ID NO: 24584 - protein, 10 aa, Neisseria
FLDPEVSAKN

SEQ ID NO: 24585 - protein, 18 aa, Neisseria
PSSKPARELMEDEFKNDN

SEQ ID NO: 24586 - protein, 8 aa, Neisseria
PTEEDLKN

SEQ ID NO: 24587 - protein, 7 aa, Neisseria
QDVKAGK

SEQ ID NO: 24588 - protein, 6 aa, Neisseria
IAAAIL

SEQ ID NO: 24589 - protein, 8 aa, Neisseria
KSIQTFPQ

SEQ ID NO: 24590 - protein, 12 aa, Neisseria
INGPDRPVGIPD

SEQ ID NO: 24591 - protein, 7 aa, Neisseria
DFAKSLQ

SEQ ID NO: 24592 - protein, 12 aa, Neisseria
QDVCAQAFQTPV

SEQ ID NO: 24593 - protein, 5 aa, Neisseria
ERYFT

SEQ ID NO: 24594 - protein, 10 aa, Neisseria
LAGTVTGYYE

SEQ ID NO: 24595 - protein, 10 aa, Neisseria
GIPDDFISVP

SEQ ID NO: 24596 - protein, 11 aa, Neisseria
RSGKALVRIRQ

SEQ ID NO: 24597 - protein, 10 aa, Neisseria
SGTIDNTGGT

SEQ ID NO: 24598 - protein, 18 aa, Neisseria
QGIKAYMQQNPQRLAEVL

SEQ ID NO: 24599 - protein, 14 aa, Neisseria
ALGTPLMGEYAGAV

SEQ ID NO: 24600 - protein, 6 aa, Neisseria
RKALNR

SEQ ID NO: 24601 - protein, 8 aa, Neisseria
CQSKSIQT

SEQ ID NO: 24602 - protein, 5 aa, Neisseria
PQPDT

SEQ ID NO: 24603 - protein, 17 aa, Neisseria
VINGPDRPVGIPDPAGT

SEQ ID NO: 24604 - protein, 5 aa, Neisseria
VGGGG

SEQ ID NO: 24605 - protein, 7 aa, Neisseria
DFAKSLQ

SEQ ID NO: 24606 - protein, 12 aa, Neisseria
GCANLKNRQGWQ

SEQ ID NO: 24607 - protein, 5 aa, Neisseria
YFTPW

SEQ ID NO: 24608 - protein, 12 aa, Neisseria
PVLKGDDRRTAQ

SEQ ID NO: 24609 - protein, 6 aa, Neisseria
IPDDFI

SEQ ID NO: 24610 - protein, 29 aa, Neisseria
AGLRSGKALVRIRQTGKNSGTIDNTGGTH

SEQ ID NO: 24611 - protein, 31 aa, Neisseria; identical to SEQ ID NO: 12479

SEQ ID NO: 24612 - protein, 6 aa, Neisseria
AEDPVE

SEQ ID NO: 24613 - protein, 15 aa, Neisseria
QGSGRLKTPSGKYIR

SEQ ID NO: 24614 - protein, 9 aa, Neisseria
GYADKNEHP

SEQ ID NO: 24615 - protein, 12 aa, Neisseria
YMADKGYLKLGQ

SEQ ID NO: 24616 - protein, 8 aa, Neisseria
QNPQRLAE

SEQ ID NO: 24617 - protein, 5 aa, Neisseria
GQNPS

SEQ ID NO: 24618 - protein, 10 aa, Neisseria
LTGSSNDGPV

SEQ ID NO: 24619 - protein, 7 aa, Neisseria
GAVDRHY

SEQ ID NO: 24620 - protein, 8 aa, Neisseria
PVTRKALN

SEQ ID NO: 24621 - protein, 11 aa, Neisseria
DTGSAIKGAVR

SEQ ID NO: 24622 - protein, 16 aa, Neisseria
GYGDEAGELAGKQKTT

SEQ ID NO: 24623 - protein, 11 aa, Neisseria
LPNGMKPEYRP

SEQ ID NO: 24624 - protein, 8 aa, Neisseria
NGPDRPVG

SEQ ID NO: 24625 - protein, 8 aa, Neisseria
NLKNRQGW

SEQ ID NO: 24626 - protein, 11 aa, Neisseria
VLKGDDRRTAQ

SEQ ID NO: 24627 - protein, 24 aa, Neisseria
LRSGKALVRIRQTGKNSGTIDNTG

SEQ ID NO: 24628 - protein, 9 aa, Neisseria
TAIKGRFEG

SEQ ID NO: 24629 - protein, 6 aa, Neisseria
ALDGKA

SEQ ID NO: 24630 - protein, 5 aa, Neisseria
AEDPV

SEQ ID NO: 24631 - protein, 7 aa, Neisseria
GRLKTPS

SEQ ID NO: 24632 - protein, 7 aa, Neisseria
YADKNEH

SEQ ID NO: 24633 - protein, 7 aa, Neisseria
NPQRLAE

SEQ ID NO: 24634 - protein, 9 aa, Neisseria
LTGSSNDGP

SEQ ID NO: 24635 - protein, 7 aa, Neisseria
VTRKALN

SEQ ID NO: 24636 - protein, 6 aa, Neisseria
DTGSAI

SEQ ID NO: 24637 - protein, 12 aa, Neisseria
DEAGELAGKQKT

SEQ ID NO: 24638 - protein, 8 aa, Neisseria
GMKPEYRP

SEQ ID NO: 24639 - protein, 6 aa, Neisseria
IAAAIL

SEQ ID NO: 24640 - protein, 8 aa, Neisseria
KSIQTFPQ

SEQ ID NO: 24641 - protein, 12 aa, Neisseria
INGPDRPVGIPD

SEQ ID NO: 24642 - protein, 7 aa, Neisseria
DFAKSLQ

SEQ ID NO: 24643 - protein, 12 aa, Neisseria
QDVCAQAFQTPV

SEQ ID NO: 24644 - protein, 5 aa, Neisseria
ERYFT

SEQ ID NO: 24645 - protein, 10 aa, Neisseria
LAGTVTGYYE

SEQ ID NO: 24646 - protein, 10 aa, Neisseria
GIPDDFISVP

SEQ ID NO: 24647 - protein, 11 aa, Neisseria
RSGKALVRIRQ

SEQ ID NO: 24648 - protein, 10 aa, Neisseria
SGTIDNTGGT

SEQ ID NO: 24649 - protein, 18 aa, Neisseria
QGIKAYMQQNPQRLAEVL

SEQ ID NO: 24650 - protein, 14 aa, Neisseria
ALGTPLMGEYAGAV

SEQ ID NO: 24651 - protein, 6 aa, Neisseria
RKALNR

SEQ ID NO: 24652 - protein, 8 aa, Neisseria
CQSKSIQT

SEQ ID NO: 24653 - protein, 5 aa, Neisseria
PQPDT

SEQ ID NO: 24654 - protein, 17 aa, Neisseria
VINGPDRPVGIPDPAGT

SEQ ID NO: 24655 - protein, 5 aa, Neisseria
VGGGG

SEQ ID NO: 24656 - protein, 7 aa, Neisseria
DFAKSLQ

SEQ ID NO: 24657 - protein, 12 aa, Neisseria
GCANLKNRQGWQ

SEQ ID NO: 24658 - protein, 5 aa, Neisseria
YFTPW

SEQ ID NO: 24659 - protein, 12 aa, Neisseria
PVLKGDDRRTAQ

SEQ ID NO: 24660 - protein, 6 aa, Neisseria
IPDDFI

SEQ ID NO: 24661 - protein, 29 aa, Neisseria
AGLRSGKALVRIRQTGKNSGTIDNTGGTH

SEQ ID NO: 24662 - protein, 31 aa, Neisseria; identical to SEQ ID NO: 12479

SEQ ID NO: 24663 - protein, 6 aa, Neisseria
AEDPVE

SEQ ID NO: 24664 - protein, 15 aa, Neisseria
QGSGRLKTPSGKYIR

SEQ ID NO: 24665 - protein, 9 aa, Neisseria
GYADKNEHP

SEQ ID NO: 24666 - protein, 12 aa, Neisseria
YMADKGYLKLGQ

SEQ ID NO: 24667 - protein, 8 aa, Neisseria
QNPQRLAE

SEQ ID NO: 24668 - protein, 5 aa, Neisseria
GQNPS

SEQ ID NO: 24669 - protein, 10 aa, Neisseria
LTGSSNDGPV

SEQ ID NO: 24670 - protein, 7 aa, Neisseria
GAVDRHY

SEQ ID NO: 24671 - protein, 8 aa, Neisseria
PVTRKALN

SEQ ID NO: 24672 - protein, 11 aa, Neisseria
DTGSAIKGAVR

SEQ ID NO: 24673 - protein, 16 aa, Neisseria
GYGDEAGELAGKQKTT

SEQ ID NO: 24674 - protein, 11 aa, Neisseria
LPNGMKPEYRP

SEQ ID NO: 24675 - protein, 8 aa, Neisseria
NGPDRPVG

SEQ ID NO: 24676 - protein, 8 aa, Neisseria
NLKNRQGW

SEQ ID NO: 24677 - protein, 11 aa, Neisseria
VLKGDDRRTAQ

SEQ ID NO: 24678 - protein, 24 aa, Neisseria
LRSGKALVRIRQTGKNSGTIDNTG

SEQ ID NO: 24679 - protein, 9 aa, Neisseria
TAIKGRFEG

SEQ ID NO: 24680 - protein, 6 aa, Neisseria
ALDGKA

SEQ ID NO: 24681 - protein, 5 aa, Neisseria
AEDPV

SEQ ID NO: 24682 - protein, 7 aa, Neisseria
GRLKTPS

SEQ ID NO: 24683 - protein, 7 aa, Neisseria
YADKNEH

SEQ ID NO: 24684 - protein, 7 aa, Neisseria
NPQRLAE

SEQ ID NO: 24685 - protein, 9 aa, Neisseria
LTGSSNDGP

SEQ ID NO: 24686 - protein, 7 aa, Neisseria
VTRKALN

SEQ ID NO: 24687 - protein, 6 aa, Neisseria
DTGSAI

SEQ ID NO: 24688 - protein, 12 aa, Neisseria
DEAGELAGKQKT

SEQ ID NO: 24689 - protein, 8 aa, Neisseria
GMKPEYRP

SEQ ID NO: 24690 - protein, 10 aa, Neisseria
GEFPELEPIA

SEQ ID NO: 24691 - protein, 6 aa, Neisseria
IKQMPD

SEQ ID NO: 24692 - protein, 6 aa, Neisseria
KNIVNV

SEQ ID NO: 24693 - protein, 6 aa, Neisseria
LDNPAN

SEQ ID NO: 24694 - protein, 16 aa, Neisseria
TVTATFDGFDTSDRSK

SEQ ID NO: 24695 - protein, 7 aa, Neisseria
QAFSDST

SEQ ID NO: 24696 - protein, 5 aa, Neisseria
LGYGE

SEQ ID NO: 24697 - protein, 8 aa, Neisseria
EPIAKDRL

SEQ ID NO: 24698 - protein, 10 aa, Neisseria
VTEKGKENMI

SEQ ID NO: 24699 - protein, 14 aa, Neisseria
YQYRSNRPVKDGSY

SEQ ID NO: 24700 - protein, 10 aa, Neisseria
TFWSKNKAGW

SEQ ID NO: 24701 - protein, 28 aa, Neisseria
QMPDASYCEQTRMFGKNIVNVGHESADT

SEQ ID NO: 24702 - protein, 8 aa, Neisseria
KPVGQNLE

SEQ ID NO: 24703 - protein, 6 aa, Neisseria
PLDNPA

SEQ ID NO: 24704 - protein, 5 aa, Neisseria
ERFKV

SEQ ID NO: 24705 - protein, 9 aa, Neisseria
FRGEPLPNA

SEQ ID NO: 24706 - protein, 18 aa, Neisseria
TFDGFDTSDRSKTHKTEA

SEQ ID NO: 24707 - protein, 13 aa, Neisseria
AFSDSTDDKGEVD

SEQ ID NO: 24708 - protein, 21 aa, Neisseria
NVEHKADFPDQSVCQKQANYS

SEQ ID NO: 24709 - protein, 8 aa, Neisseria
EPIAKDRL

SEQ ID NO: 24710 - protein, 10 aa, Neisseria
VTEKGKENMI

SEQ ID NO: 24711 - protein, 10 aa, Neisseria
RSNRPVKDGS

SEQ ID NO: 24712 - protein, 7 aa, Neisseria
SKNKAGW

SEQ ID NO: 24713 - protein, 7 aa, Neisseria
EQTRMFG

SEQ ID NO: 24714 - protein, 5 aa, Neisseria
HESAD

SEQ ID NO: 24715 - protein, 5 aa, Neisseria
ERFKV

SEQ ID NO: 24716 - protein, 16 aa, Neisseria
DGFDTSDRSKTHKTEA

SEQ ID NO: 24717 - protein, 13 aa, Neisseria
AFSDSTDDKGEVD

SEQ ID NO: 24718 - protein, 10 aa, Neisseria
NVEHKADFPD

SEQ ID NO: 24719 - protein, 5 aa, Neisseria
SVCQK

SEQ ID NO: 24720 - protein, 22 aa, Neisseria
IVAVLSGCQSIYVPTLTEIPVN

SEQ ID NO: 24721 - protein, 6 aa, Neisseria
INTVKT

SEQ ID NO: 24722 - protein, 11 aa, Neisseria
HWTDVAKISDE

SEQ ID NO: 24723 - protein, 17 aa, Neisseria
GKMTKVQAAQYLNNFRK

SEQ ID NO: 24724 - protein, 9 aa, Neisseria
DSMYEIYLR

SEQ ID NO: 24725 - protein, 10 aa, Neisseria
QNALRGWQQR

SEQ ID NO: 24726 - protein, 11 aa, Neisseria
VKTEAPAKGFR

SEQ ID NO: 24727 - protein, 9 aa, Neisseria
AKISDEATR

SEQ ID NO: 24728 - protein, 5 aa, Neisseria
GKMTK

SEQ ID NO: 24729 - protein, 17 aa, Neisseria
NNFRKRLVGRNAVDDSM

SEQ ID NO: 24730 - protein, 15 aa, Neisseria
AIDSQRGAINTEQSK

SEQ ID NO: 24731 - protein, 20 aa, Neisseria
ALRGWQQRWKNMDVKPNNPA

SEQ ID NO: 24732 - protein, 11 aa, Neisseria
VKTEAPAKGFR

SEQ ID NO: 24733 - protein, 9 aa, Neisseria
AKISDEATR

SEQ ID NO: 24734 - protein, 7 aa, Neisseria
FRKRLVG

SEQ ID NO: 24735 - protein, 7 aa, Neisseria
NAVDDSM

SEQ ID NO: 24736 - protein, 15 aa, Neisseria
AIDSQRGAINTEQSK

SEQ ID NO: 24737 - protein, 10 aa, Neisseria
WKNMDVKPNN

SEQ ID NO: 24738 - protein, 5 aa, Neisseria
LSACT

SEQ ID NO: 24739 - protein, 8 aa, Neisseria
RANEAQAP

SEQ ID NO: 24740 - protein, 7 aa, Neisseria
VRRFVDD

SEQ ID NO: 24741 - protein, 8 aa, Neisseria
EWQDFFDK

SEQ ID NO: 24742 - protein, 5 aa, Neisseria
VKIMH

SEQ ID NO: 24743 - protein, 5 aa, Neisseria
DDVAQ

SEQ ID NO: 24744 - protein, 9 aa, Neisseria
GSFRVADAL

SEQ ID NO: 24745 - protein, 10 aa, Neisseria
KELVELLKLA

SEQ ID NO: 24746 - protein, 5 aa, Neisseria
AMGMP

SEQ ID NO: 24747 - protein, 22 aa, Neisseria
HRDIWGNVGDVAASIANYMKQH

SEQ ID NO: 24748 - protein, 9 aa, Neisseria
RTVADLKAY

SEQ ID NO: 24749 - protein, 9 aa, Neisseria
YLGLNNFYT

SEQ ID NO: 24750 - protein, 7 aa, Neisseria
MKNRKIL

SEQ ID NO: 24751 - protein, 27 aa, Neisseria
MEARPPRANEAQAPRADEMKKESRPAF

SEQ ID NO: 24752 - protein, 6 aa, Neisseria
VSDSGF

SEQ ID NO: 24753 - protein, 21 aa, Neisseria
ANVRRFVDDEVGKGDFSRAEW

SEQ ID NO: 24754 - protein, 9 aa, Neisseria
MHRPSTSRP

SEQ ID NO: 24755 - protein, 24 aa, Neisseria
RTGNSGKAKFRGARRFYAENRALI

SEQ ID NO: 24756 - protein, 8 aa, Neisseria
DVAQKYGV

SEQ ID NO: 24757 - protein, 11 aa, Neisseria
IETNYGKNTGS

SEQ ID NO: 24758 - protein, 9 aa, Neisseria
DYPRRAGFF

SEQ ID NO: 24759 - protein, 9 aa, Neisseria
KLAKEEGGD

SEQ ID NO: 24760 - protein, 20 aa, Neisseria
MPSSYRKWAVDYDGDGHRDI

SEQ ID NO: 24761 - protein, 8 aa, Neisseria
HGWRTGGK

SEQ ID NO: 24762 - protein, 5 aa, Neisseria
APGAD

SEQ ID NO: 24763 - protein, 7 aa, Neisseria
IGEKTAL

SEQ ID NO: 24764 - protein, 12 aa, Neisseria
PGEELADDEKAV

SEQ ID NO: 24765 - protein, 5 aa, Neisseria
ETAPG

SEQ ID NO: 24766 - protein, 13 aa, Neisseria
VRDIANSLGGPGL

SEQ ID NO: 24767 - protein, 7 aa, Neisseria
MKNRKIL

SEQ ID NO: 24768 - protein, 27 aa, Neisseria
MEARPPRANEAQAPRADEMKKESRPAF

SEQ ID NO: 24769 - protein, 21 aa, Neisseria
ANVRRFVDDEVGKGDFSRAEW

SEQ ID NO: 24770 - protein, 22 aa, Neisseria
GNSGKAKFRGARRFYAENRALI

SEQ ID NO: 24771 - protein, 7 aa, Neisseria
NYGKNTG

SEQ ID NO: 24772 - protein, 8 aa, Neisseria
YPRRAGFF

SEQ ID NO: 24773 - protein, 9 aa, Neisseria
KLAKEEGGD

SEQ ID NO: 24774 - protein, 9 aa, Neisseria
YDGDGHRDI

SEQ ID NO: 24775 - protein, 7 aa, Neisseria
IGEKTAL

SEQ ID NO: 24776 - protein, 12 aa, Neisseria
PGEELADDEKAV

SEQ ID NO: 24777 - protein, 5 aa, Neisseria
VRDIA

SEQ ID NO: 24778 - protein, 8 aa, Neisseria
LMACAAFL

SEQ ID NO: 24779 - protein, 12 aa, Neisseria
LGACYAILSLYA

SEQ ID NO: 24780 - protein, 9 aa, Neisseria
PALFGGWAG

SEQ ID NO: 24781 - protein, 18 aa, Neisseria
IDKRRAVRGKRRIPEHRL

SEQ ID NO: 24782 - protein, 12 aa, Neisseria
RIFRHKTAKKRF

SEQ ID NO: 24783 - protein, 18 aa, Neisseria
IDKRRAVRGKRRIPEHRL

SEQ ID NO: 24784 - protein, 12 aa, Neisseria
RIFRHKTAKKRF

SEQ ID NO: 24785 - protein, 7 aa, Neisseria
KCGQTAQ

SEQ ID NO: 24786 - protein, 9 aa, Neisseria
HQAAIEQLK

SEQ ID NO: 24787 - protein, 5 aa, Neisseria
FDELE

SEQ ID NO: 24788 - protein, 16 aa, Neisseria
FTGKEESMLLSEKDGA

SEQ ID NO: 24789 - protein, 5 aa, Neisseria
NTGIG

SEQ ID NO: 24790 - protein, 40 aa, Neisseria; identical to SEQ ID NO: 12612

SEQ ID NO: 24791 - protein, 14 aa, Neisseria
LDARNALPSNQTYQ

SEQ ID NO: 24792 - protein, 25 aa, Neisseria
EQLKRRFEAEFDELEKEIKCNGKPT

SEQ ID NO: 24793 - protein, 15 aa, Neisseria
TGKEESMLLSEKDGA

SEQ ID NO: 24794 - protein, 39 aa, Neisseria; identical to SEQ ID NO: 12618

SEQ ID NO: 24795 - protein, 7 aa, Neisseria
LDARNAL

SEQ ID NO: 24796 - protein, 23 aa, Neisseria
EQLKRRFEAEFDELEKEIKCNGK

SEQ ID NO: 24797 - protein, 5 aa, Neisseria
HTRSF

SEQ ID NO: 24798 - protein, 7 aa, Neisseria
LGSTLGQ

SEQ ID NO: 24799 - protein, 10 aa, Neisseria
AESAEELSRQ

SEQ ID NO: 24800 - protein, 11 aa, Neisseria
GAPYRILPDGI

SEQ ID NO: 24801 - protein, 7 aa, Neisseria
ADSGGQV

SEQ ID NO: 24802 - protein, 35 aa, Neisseria
LPQNNENLWQPSEHTRSFTAEGRLAVKAEGKGSYA

SEQ ID NO: 24803 - protein, 5 aa, Neisseria
TPLGS

SEQ ID NO: 24804 - protein, 9 aa, Neisseria
LCQDRDGAL

SEQ ID NO: 24805 - protein, 8 aa, Neisseria
VDGKGNVY

SEQ ID NO: 24806 - protein, 8 aa, Neisseria
ESAEELSR

SEQ ID NO: 24807 - protein, 10 aa, Neisseria
ADGRPVAGAP

SEQ ID NO: 24808 - protein, 7 aa, Neisseria
ILPDGIL

SEQ ID NO: 24809 - protein, 9 aa, Neisseria
GRTADSGGQ

SEQ ID NO: 24810 - protein, 13 aa, Neisseria
GMPSETETQEQCA

SEQ ID NO: 24811 - protein, 16 aa, Neisseria
FTAEGRLAVKAEGKGS

SEQ ID NO: 24812 - protein, 8 aa, Neisseria
CQDRDGAL

SEQ ID NO: 24813 - protein, 5 aa, Neisseria
VDGKG

SEQ ID NO: 24814 - protein, 8 aa, Neisseria
ESAEELSR

SEQ ID NO: 24815 - protein, 6 aa, Neisseria
DGRPVA

SEQ ID NO: 24816 - protein, 8 aa, Neisseria
RTADSGGQ

SEQ ID NO: 24817 - protein, 10 aa, Neisseria
SETETQEQCA

SEQ ID NO: 24818 - protein, 6 aa, Neisseria
LLSACS

SEQ ID NO: 24819 - protein, 11 aa, Neisseria
SYDVARDFYKE

SEQ ID NO: 24820 - protein, 8 aa, Neisseria
KGWQQALP

SEQ ID NO: 24821 - protein, 15 aa, Neisseria
NPKQIRDWNDLAKDG

SEQ ID NO: 24822 - protein, 7 aa, Neisseria
KLVASIL

SEQ ID NO: 24823 - protein, 26 aa, Neisseria
SPAADSNHPSGQNAPANTESDGKNIT

SEQ ID NO: 24824 - protein, 14 aa, Neisseria
SYDVARDFYKEYNP

SEQ ID NO: 24825 - protein, 9 aa, Neisseria
YQSEHPGTS

SEQ ID NO: 24826 - protein, 9 aa, Neisseria
QSHGGSSKQ

SEQ ID NO: 24827 - protein, 15 aa, Neisseria
NQSSDIDLLEKKGLV

SEQ ID NO: 24828 - protein, 9 aa, Neisseria
LPDHAAPYT

SEQ ID NO: 24829 - protein, 19 aa, Neisseria
RKNNPKQIRDWNDLAKDGV

SEQ ID NO: 24830 - protein, 9 aa, Neisseria
NPKTSGNGR

SEQ ID NO: 24831 - protein, 13 aa, Neisseria
LKTTNGNEQEAQK

SEQ ID NO: 24832 - protein, 24 aa, Neisseria
LKNTPVFENGGRAPPRPPSHNATS

SEQ ID NO: 24833 - protein, 13 aa, Neisseria
SLLKTKPTTSAKN

SEQ ID NO: 24834 - protein, 9 aa, Neisseria
PAADSNHPS

SEQ ID NO: 24835 - protein, 9 aa, Neisseria
ANTESDGKN

SEQ ID NO: 24836 - protein, 8 aa, Neisseria
DVARDFYK

SEQ ID NO: 24837 - protein, 7 aa, Neisseria
YQSEHPG

SEQ ID NO: 24838 - protein, 7 aa, Neisseria
HGGSSKQ

SEQ ID NO: 24839 - protein, 14 aa, Neisseria
QSSDIDLLEKKGLV

SEQ ID NO: 24840 - protein, 19 aa, Neisseria
RKNNPKQIRDWNDLAKDGV

SEQ ID NO: 24841 - protein, 7 aa, Neisseria
PKTSGNG

SEQ ID NO: 24842 - protein, 11 aa, Neisseria
TTNGNEQEAQK

SEQ ID NO: 24843 - protein, 7 aa, Neisseria
NGGRAPP

SEQ ID NO: 24844 - protein, 11 aa, Neisseria
LKTKPTTSAKN

SEQ ID NO: 24845 - protein, 6 aa, Neisseria
VPDGVK

SEQ ID NO: 24846 - protein, 15 aa, Neisseria
WTLLAMFIGVIAAII

SEQ ID NO: 24847 - protein, 11 aa, Neisseria
GAAMSDALSAF

SEQ ID NO: 24848 - protein, 17 aa, Neisseria
HPIMQSIAGSYGSNPAK

SEQ ID NO: 24849 - protein, 5 aa, Neisseria
YLALV

SEQ ID NO: 24850 - protein, 12 aa, Neisseria
PLIVNLIAENLG

SEQ ID NO: 24851 - protein, 6 aa, Neisseria
GVIAFF

SEQ ID NO: 24852 - protein, 9 aa, Neisseria
RLREMGKMS

SEQ ID NO: 24853 - protein, 6 aa, Neisseria
AVIFGI

SEQ ID NO: 24854 - protein, 18 aa, Neisseria
LGLIKWFSGVLAESVGGL

SEQ ID NO: 24855 - protein, 13 aa, Neisseria
TAHITAMFGAFFA

SEQ ID NO: 24856 - protein, 8 aa, Neisseria
YTTMGEWW

SEQ ID NO: 24857 - protein, 8 aa, Neisseria
VPDGVKPQ

SEQ ID NO: 24858 - protein, 9 aa, Neisseria
TADKPGAAM

SEQ ID NO: 24859 - protein, 7 aa, Neisseria
GRKTLGI

SEQ ID NO: 24860 - protein, 10 aa, Neisseria
TPSNTARGGG

SEQ ID NO: 24861 - protein, 17 aa, Neisseria
GSYGSNPAKGTEGKMGK

SEQ ID NO: 24862 - protein, 6 aa, Neisseria
HSNPIS

SEQ ID NO: 24863 - protein, 6 aa, Neisseria
NLGSSF

SEQ ID NO: 24864 - protein, 10 aa, Neisseria
YPPEIKETPN

SEQ ID NO: 24865 - protein, 17 aa, Neisseria
FAKDRLREMGKMSADEI

SEQ ID NO: 24866 - protein, 9 aa, Neisseria
DVLKEKSAW

SEQ ID NO: 24867 - protein, 9 aa, Neisseria
TADKPGAAM

SEQ ID NO: 24868 - protein, 5 aa, Neisseria
NTARG

SEQ ID NO: 24869 - protein, 12 aa, Neisseria
NPAKGTEGKMGK

SEQ ID NO: 24870 - protein, 8 aa, Neisseria
PEIKETPN

SEQ ID NO: 24871 - protein, 17 aa, Neisseria
FAKDRLREMGKMSADEI

SEQ ID NO: 24872 - protein, 9 aa, Neisseria
DVLKEKSAW

SEQ ID NO: 24873 - protein, 15 aa, Neisseria
KAPKTVANFVRYARK

SEQ ID NO: 24874 - protein, 5 aa, Neisseria
RVIGG

SEQ ID NO: 24875 - protein, 10 aa, Neisseria
EDLAQKASDK

SEQ ID NO: 24876 - protein, 12 aa, Neisseria
NESGNGLKNTVG

SEQ ID NO: 24877 - protein, 10 aa, Neisseria
IAMARTADPD

SEQ ID NO: 24878 - protein, 5 aa, Neisseria
SQFFI

SEQ ID NO: 24879 - protein, 26 aa, Neisseria
TVFGRVESGMNTVSKIARVKTATRGF

SEQ ID NO: 24880 - protein, 5 aa, Neisseria
MKPKF

SEQ ID NO: 24881 - protein, 5 aa, Neisseria
TDMGN

SEQ ID NO: 24882 - protein, 10 aa, Neisseria
VLDESKAPKT

SEQ ID NO: 24883 - protein, 12 aa, Neisseria
RYARKGFYDNTI

SEQ ID NO: 24884 - protein, 29 aa, Neisseria
GGGLTEDLAQKASDKAVANESGNGLKNTV

SEQ ID NO: 24885 - protein, 9 aa, Neisseria
RTADPDSAT

SEQ ID NO: 24886 - protein, 12 aa, Neisseria
VDNDSLNYKNGQ

SEQ ID NO: 24887 - protein, 10 aa, Neisseria
GRVESGMNTV

SEQ ID NO: 24888 - protein, 12 aa, Neisseria
KIARVKTATRGF

SEQ ID NO: 24889 - protein, 5 aa, Neisseria
VKIRR

SEQ ID NO: 24890 - protein, 5 aa, Neisseria
MKPKF

SEQ ID NO: 24891 - protein, 5 aa, Neisseria
TDMGN

SEQ ID NO: 24892 - protein, 10 aa, Neisseria
VLDESKAPKT

SEQ ID NO: 24893 - protein, 23 aa, Neisseria
GLTEDLAQKASDKAVANESGNGL

SEQ ID NO: 24894 - protein, 9 aa, Neisseria
RTADPDSAT

SEQ ID NO: 24895 - protein, 7 aa, Neisseria
VDNDSLN

SEQ ID NO: 24896 - protein, 7 aa, Neisseria
GRVESGM

SEQ ID NO: 24897 - protein, 9 aa, Neisseria
KIARVKTAT

SEQ ID NO: 24898 - protein, 5 aa, Neisseria
VKIRR

SEQ ID NO: 24899 - protein, 22 aa, Neisseria
NIPALFPKHPFDPFENINNSKR

SEQ ID NO: 24900 - protein, 6 aa, Neisseria
GFAQGL

SEQ ID NO: 24901 - protein, 15 aa, Neisseria
EKPIRQYFKECLNTG

SEQ ID NO: 24902 - protein, 5 aa, Neisseria
SDDTC

SEQ ID NO: 24903 - protein, 8 aa, Neisseria
VGNYIEWL

SEQ ID NO: 24904 - protein, 10 aa, Neisseria
DVDPFHYIEV

SEQ ID NO: 24905 - protein, 19 aa, Neisseria
ENPIDDLKSLDGHQIIKVN

SEQ ID NO: 24906 - protein, 5 aa, Neisseria
GFFTK

SEQ ID NO: 24907 - protein, 10 aa, Neisseria
WLRVIDGHSN

SEQ ID NO: 24908 - protein, 8 aa, Neisseria
AGIYATWH

SEQ ID NO: 24909 - protein, 5 aa, Neisseria
WVQYQ

SEQ ID NO: 24910 - protein, 6 aa, Neisseria
ATERFT

SEQ ID NO: 24911 - protein, 6 aa, Neisseria
KGITAS

SEQ ID NO: 24912 - protein, 7 aa, Neisseria
GYNALLA

SEQ ID NO: 24913 - protein, 8 aa, Neisseria
LYKNIAIE

SEQ ID NO: 24914 - protein, 5 aa, Neisseria
FAAVN

SEQ ID NO: 24915 - protein, 6 aa, Neisseria
FNRQTG

SEQ ID NO: 24916 - protein, 26 aa, Neisseria
KKLRDRNSEYWKEETYHIKSNNRVYP

SEQ ID NO: 24917 - protein, 28 aa, Neisseria
PKHPFDPFENINNSKRISFYDKEYTEDY

SEQ ID NO: 24918 - protein, 14 aa, Neisseria
GVAKRNGETEKPIR

SEQ ID NO: 24919 - protein, 17 aa, Neisseria
CLNTGKYSDDTCKSQQS

SEQ ID NO: 24920 - protein, 5 aa, Neisseria
VRSDI

SEQ ID NO: 24921 - protein, 12 aa, Neisseria
TKIKNSHINSEI

SEQ ID NO: 24922 - protein, 16 aa, Neisseria
LSSSQEHLYSDVDPFH

SEQ ID NO: 24923 - protein, 7 aa, Neisseria
EVTDNSH

SEQ ID NO: 24924 - protein, 49 aa, Neisseria
DEFRLENSLWEPRWDSDVGELKTTNADIRFNTKSESLLVKEDYAGGARF

SEQ ID NO: 24925 - protein, 10 aa, Neisseria
GLKDKVPETP

SEQ ID NO: 24926 - protein, 9 aa, Neisseria
FEKNITGTS

SEQ ID NO: 24927 - protein, 18 aa, Neisseria
IFENPIDDLKSLDGHQII

SEQ ID NO: 24928 - protein, 19 aa, Neisseria
VNGTADKHAFRLSGKHQKG

SEQ ID NO: 24929 - protein, 8 aa, Neisseria
LQQRPEGF

SEQ ID NO: 24930 - protein, 9 aa, Neisseria
KVQERDDIS

SEQ ID NO: 24931 - protein, 19 aa, Neisseria
RLNDKNSDIFDRTLPRKGL

SEQ ID NO: 24932 - protein, 23 aa, Neisseria
IDGHSNQWVQGKTAPVESNRKGV

SEQ ID NO: 24933 - protein, 7 aa, Neisseria
QNESNQL

SEQ ID NO: 24934 - protein, 27 aa, Neisseria
SGQAEQRSTFRNPDTDNLTTGNVKGFG

SEQ ID NO: 24935 - protein, 12 aa, Neisseria
LQDKQTGAYADS

SEQ ID NO: 24936 - protein, 21 aa, Neisseria
QRFRHRINTEDATERFTSKGI

SEQ ID NO: 24937 - protein, 9 aa, Neisseria
HFTKKGNRV

SEQ ID NO: 24938 - protein, 11 aa, Neisseria
VNGKFSDSENA

SEQ ID NO: 24939 - protein, 8 aa, Neisseria
LGSRQLQS

SEQ ID NO: 24940 - protein, 22 aa, Neisseria
KPFGVEMDGERRMINNKTAIES

SEQ ID NO: 24941 - protein, 5 aa, Neisseria
VKIKS

SEQ ID NO: 24942 - protein, 15 aa, Neisseria
TFNRQTGKHHQAKQG

SEQ ID NO: 24943 - protein, 17 aa, Neisseria
KKLRDRNSEYWKEETYH

SEQ ID NO: 24944 - protein, 5 aa, Neisseria
HPFDP

SEQ ID NO: 24945 - protein, 15 aa, Neisseria
NNSKRISFYDKEYTE

SEQ ID NO: 24946 - protein, 12 aa, Neisseria
VAKRNGETEKPI

SEQ ID NO: 24947 - protein, 11 aa, Neisseria
KYSDDTCKSQQ

SEQ ID NO: 24948 - protein, 5 aa, Neisseria
TKIKN

SEQ ID NO: 24949 - protein, 6 aa, Neisseria
LYSDVD

SEQ ID NO: 24950 - protein, 6 aa, Neisseria
DEFRLE

SEQ ID NO: 24951 - protein, 34 aa, Neisseria
PRWDSDVGELKTTNADIRFNTKSESLLVKEDYAG

SEQ ID NO: 24952 - protein, 7 aa, Neisseria
LKDKVPE

SEQ ID NO: 24953 - protein, 5 aa, Neisseria
KNITG

SEQ ID NO: 24954 - protein, 10 aa, Neisseria
NPIDDLKSLD

SEQ ID NO: 24955 - protein, 8 aa, Neisseria
GTADKHAF

SEQ ID NO: 24956 - protein, 7 aa, Neisseria
LSGKHQK

SEQ ID NO: 24957 - protein, 7 aa, Neisseria
QQRPEGF

SEQ ID NO: 24958 - protein, 7 aa, Neisseria
VQERDDI

SEQ ID NO: 24959 - protein, 10 aa, Neisseria
LNDKNSDIFD

SEQ ID NO: 24960 - protein, 12 aa, Neisseria
KTAPVESNRKGV

SEQ ID NO: 24961 - protein, 5 aa, Neisseria
NESNQ

SEQ ID NO: 24962 - protein, 17 aa, Neisseria
QAEQRSTFRNPDTDNLT

SEQ ID NO: 24963 - protein, 6 aa, Neisseria
LQDKQT

SEQ ID NO: 24964 - protein, 18 aa, Neisseria
QRFRHRINTEDATERFTS

SEQ ID NO: 24965 - protein, 8 aa, Neisseria
HFTKKGNR

SEQ ID NO: 24966 - protein, 8 aa, Neisseria
KFSDSENA

SEQ ID NO: 24967 - protein, 5 aa, Neisseria
RQLQS

SEQ ID NO: 24968 - protein, 13 aa, Neisseria
FGVEMDGERRMIN

SEQ ID NO: 24969 - protein, 5 aa, Neisseria
VKIKS

SEQ ID NO: 24970 - protein, 12 aa, Neisseria
RQTGKHHQAKQG

SEQ ID NO: 24971 - protein, 6 aa, Neisseria
VSDKWA

SEQ ID NO: 24972 - protein, 5 aa, Neisseria
APRVV

SEQ ID NO: 24973 - protein, 7 aa, Neisseria
LEHSLRD

SEQ ID NO: 24974 - protein, 12 aa, Neisseria
LIASLADLYAKL

SEQ ID NO: 24975 - protein, 19 aa, Neisseria
ALLAKLAGRPAEAVARYRE

SEQ ID NO: 24976 - protein, 14 aa, Neisseria
PVLENVGRFRKKAE

SEQ ID NO: 24977 - protein, 16 aa, Neisseria
KRLGESATVFGGWQFV

SEQ ID NO: 24978 - protein, 13 aa, Neisseria
AGWAQEWRQLGGL

SEQ ID NO: 24979 - protein, 6 aa, Neisseria
YARRNY

SEQ ID NO: 24980 - protein, 8 aa, Neisseria
AILDDKAL

SEQ ID NO: 24981 - protein, 26 aa, Neisseria
RSVSDKWAESDWKVDNDAPRVVDGDF

SEQ ID NO: 24982 - protein, 17 aa, Neisseria
KMLEHSLRDVLNGNQAD

SEQ ID NO: 24983 - protein, 7 aa, Neisseria
KLPDYDA

SEQ ID NO: 24984 - protein, 5 aa, Neisseria
RARAL

SEQ ID NO: 24985 - protein, 26 aa, Neisseria
LAGRPAEAVARYRELHGENAADERIL

SEQ ID NO: 24986 - protein, 25 aa, Neisseria
AAAEFDDFRLKSAERHFAEAEKLDL

SEQ ID NO: 24987 - protein, 14 aa, Neisseria
NVGRFRKKAEGLTG

SEQ ID NO: 24988 - protein, 5 aa, Neisseria
FSGGI

SEQ ID NO: 24989 - protein, 10 aa, Neisseria
AVNRNANNAA

SEQ ID NO: 24990 - protein, 10 aa, Neisseria
QYCRQNGGRQ

SEQ ID NO: 24991 - protein, 7 aa, Neisseria
SRAERAA

SEQ ID NO: 24992 - protein, 8 aa, Neisseria
IEAEKLTA

SEQ ID NO: 24993 - protein, 9 aa, Neisseria
RSNIGGTSY

SEQ ID NO: 24994 - protein, 13 aa, Neisseria
FSKKSAYDDGFGR

SEQ ID NO: 24995 - protein, 10 aa, Neisseria
GWQYKNARQT

SEQ ID NO: 24996 - protein, 21 aa, Neisseria
SGSDGFDAKTKRVNNRRLPPY

SEQ ID NO: 24997 - protein, 9 aa, Neisseria
HTYRPNPGW

SEQ ID NO: 24998 - protein, 24 aa, Neisseria
EHYRQRYREQDRAEYNNGRQDGFY

SEQ ID NO: 24999 - protein, 7 aa, Neisseria
SAKRLGE

SEQ ID NO: 25000 - protein, 8 aa, Neisseria
FVPKRETV

SEQ ID NO: 25001 - protein, 11 aa, Neisseria
AAYRRNGVYAG

SEQ ID NO: 25002 - protein, 18 aa, Neisseria
GGLNSRVSASYARRNYKG

SEQ ID NO: 25003 - protein, 10 aa, Neisseria
TEAQRNREWN

SEQ ID NO: 25004 - protein, 9 aa, Neisseria
SHDKLSYKG

SEQ ID NO: 25005 - protein, 17 aa, Neisseria
FGRTESNVPYAKRRNSE

SEQ ID NO: 25006 - protein, 5 aa, Neisseria
ADWRF

SEQ ID NO: 25007 - protein, 8 aa, Neisseria
AILDDKAL

SEQ ID NO: 25008 - protein, 23 aa, Neisseria
RSVSDKWAESDWKVDNDAPRVVD

SEQ ID NO: 25009 - protein, 12 aa, Neisseria
KMLEHSLRDVLN

SEQ ID NO: 25010 - protein, 5 aa, Neisseria
RARAL

SEQ ID NO: 25011 - protein, 17 aa, Neisseria
LAGRPAEAVARYRELHG

SEQ ID NO: 25012 - protein, 8 aa, Neisseria
NAADERIL

SEQ ID NO: 25013 - protein, 25 aa, Neisseria
AAAEFDDFRLKSAERHFAEAEKLDL

SEQ ID NO: 25014 - protein, 11 aa, Neisseria
NVGRFRKKAEG

SEQ ID NO: 25015 - protein, 6 aa, Neisseria
VNRNAN

SEQ ID NO: 25016 - protein, 8 aa, Neisseria
CRQNGGRQ

SEQ ID NO: 25017 - protein, 7 aa, Neisseria
SRAERAA

SEQ ID NO: 25018 - protein, 8 aa, Neisseria
IEAEKLTA

SEQ ID NO: 25019 - protein, 10 aa, Neisseria
KKSAYDDGFG

SEQ ID NO: 25020 - protein, 6 aa, Neisseria
KNARQT

SEQ ID NO: 25021 - protein, 16 aa, Neisseria
DGFDAKTKRVNNRRLP

SEQ ID NO: 25022 - protein, 20 aa, Neisseria
HYRQRYREQDRAEYNNGRQD

SEQ ID NO: 25023 - protein, 7 aa, Neisseria
SAKRLGE

SEQ ID NO: 25024 - protein, 7 aa, Neisseria
VPKRETV

SEQ ID NO: 25025 - protein, 6 aa, Neisseria
AYRRNG

SEQ ID NO: 25026 - protein, 7 aa, Neisseria
YARRNYK

SEQ ID NO: 25027 - protein, 8 aa, Neisseria
EAQRNREW

SEQ ID NO: 25028 - protein, 7 aa, Neisseria
SHDKLSY

SEQ ID NO: 25029 - protein, 6 aa, Neisseria
FGRTES

SEQ ID NO: 25030 - protein, 8 aa, Neisseria
YAKRRNSE

SEQ ID NO: 25031 - protein, 6 aa, Neisseria
VRTLTA

SEQ ID NO: 25032 - protein, 6 aa, Neisseria
GCVSAV

SEQ ID NO: 25033 - protein, 6 aa, Neisseria
QFVGQI

SEQ ID NO: 25034 - protein, 23 aa, Neisseria
AEGVYNYITVASLPRTAGDIAGD

SEQ ID NO: 25035 - protein, 9 aa, Neisseria
MKPKPHTVR

SEQ ID NO: 25036 - protein, 21 aa, Neisseria
VGAKSAVDRRTTGAQTDDNVM

SEQ ID NO: 25037 - protein, 19 aa, Neisseria
RIETTARSYLRQNNQTKGY

SEQ ID NO: 25038 - protein, 8 aa, Neisseria
ATEGEKQF

SEQ ID NO: 25039 - protein, 7 aa, Neisseria
ARSEQAA

SEQ ID NO: 25040 - protein, 20 aa, Neisseria
LPRTAGDIAGDTWNTSKVRA

SEQ ID NO: 25041 - protein, 9 aa, Neisseria
SPATQARVK

SEQ ID NO: 25042 - protein, 9 aa, Neisseria
TPEEQAQIT

SEQ ID NO: 25043 - protein, 7 aa, Neisseria
MKPKPHT

SEQ ID NO: 25044 - protein, 17 aa, Neisseria
SAVDRRTTGAQTDDNVM

SEQ ID NO: 25045 - protein, 6 aa, Neisseria
RIETTA

SEQ ID NO: 25046 - protein, 7 aa, Neisseria
NNQTKGY

SEQ ID NO: 25047 - protein, 8 aa, Neisseria
ATEGEKQF

SEQ ID NO: 25048 - protein, 7 aa, Neisseria
ARSEQAA

SEQ ID NO: 25049 - protein, 5 aa, Neisseria
PRTAG

SEQ ID NO: 25050 - protein, 6 aa, Neisseria
TQARVK

SEQ ID NO: 25051 - protein, 8 aa, Neisseria
TPEEQAQI

SEQ ID NO: 25052 - protein, 12 aa, Neisseria
LPALPAILPLSA

SEQ ID NO: 25053 - protein, 7 aa, Neisseria
KQPDRLD

SEQ ID NO: 25054 - protein, 13 aa, Neisseria
DIMTDKGKWKLET

SEQ ID NO: 25055 - protein, 10 aa, Neisseria
LNSENNRAEL

SEQ ID NO: 25056 - protein, 10 aa, Neisseria
TEIQENGSNT

SEQ ID NO: 25057 - protein, 10 aa, Neisseria
GNTDIYGSGS

SEQ ID NO: 25058 - protein, 19 aa, Neisseria
HEERKLDGNGKTRNKRMSD

SEQ ID NO: 25059 - protein, 9 aa, Neisseria
FLKDDKNPA

SEQ ID NO: 25060 - protein, 15 aa, Neisseria
TVYEKSRNKASSGKS

SEQ ID NO: 25061 - protein, 18 aa, Neisseria
YRINGSKTLSSNTKYKAG

SEQ ID NO: 25062 - protein, 10 aa, Neisseria
ANDRISLTGG

SEQ ID NO: 25063 - protein, 19 aa, Neisseria
GKQPDRLDGKKESARNTST

SEQ ID NO: 25064 - protein, 11 aa, Neisseria
VSGQSSSELKF

SEQ ID NO: 25065 - protein, 11 aa, Neisseria
DIMTDKGKWKL

SEQ ID NO: 25066 - protein, 7 aa, Neisseria
ENNRAEL

SEQ ID NO: 25067 - protein, 8 aa, Neisseria
EIQENGSN

SEQ ID NO: 25068 - protein, 19 aa, Neisseria
HEERKLDGNGKTRNKRMSD

SEQ ID NO: 25069 - protein, 8 aa, Neisseria
FLKDDKNP

SEQ ID NO: 25070 - protein, 12 aa, Neisseria
TVYEKSRNKASS

SEQ ID NO: 25071 - protein, 5 aa, Neisseria
KTLSS

SEQ ID NO: 25072 - protein, 5 aa, Neisseria
TKYKA

SEQ ID NO: 25073 - protein, 6 aa, Neisseria
ANDRIS

SEQ ID NO: 25074 - protein, 15 aa, Neisseria
KQPDRLDGKKESARN

SEQ ID NO: 25075 - protein, 7 aa, Neisseria
SSSELKF

SEQ ID NO: 25076 - protein, 5 aa, Neisseria
ATVCA

SEQ ID NO: 25077 - protein, 5 aa, Neisseria
DQDIL

SEQ ID NO: 25078 - protein, 5 aa, Neisseria
KIYRG

SEQ ID NO: 25079 - protein, 6 aa, Neisseria
CMSCHG

SEQ ID NO: 25080 - protein, 11 aa, Neisseria
SEIQAYPRLGG

SEQ ID NO: 25081 - protein, 7 aa, Neisseria
EQMNAYK

SEQ ID NO: 25082 - protein, 8 aa, Neisseria
EDIANRMS

SEQ ID NO: 25083 - protein, 13 aa, Neisseria
ASPKADVEKGKQV

SEQ ID NO: 25084 - protein, 8 aa, Neisseria
AADGNSGI

SEQ ID NO: 25085 - protein, 15 aa, Neisseria
IGIRDGKRTHGSAAV

SEQ ID NO: 25086 - protein, 6 aa, Neisseria
LSDQDI

SEQ ID NO: 25087 - protein, 18 aa, Neisseria
KQQPKSGEANPKENPELG

SEQ ID NO: 25088 - protein, 12 aa, Neisseria
IYRGGLSDKKVP

SEQ ID NO: 25089 - protein, 17 aa, Neisseria
HGPSGAGMPGGGSEIQA

SEQ ID NO: 25090 - protein, 8 aa, Neisseria
PRLGGQHQ

SEQ ID NO: 25091 - protein, 27 aa, Neisseria
NAYKSGQRKNTIMEDIANRMSEEDLKA

SEQ ID NO: 25092 - protein, 13 aa, Neisseria
ASPKADVEKGKQV

SEQ ID NO: 25093 - protein, 6 aa, Neisseria
AADGNS

SEQ ID NO: 25094 - protein, 10 aa, Neisseria
GIRDGKRTHG

SEQ ID NO: 25095 - protein, 5 aa, Neisseria
SDQDI

SEQ ID NO: 25096 - protein, 17 aa, Neisseria
QQPKSGEANPKENPELG

SEQ ID NO: 25097 - protein, 8 aa, Neisseria
GLSDKKVP

SEQ ID NO: 25098 - protein, 24 aa, Neisseria
KSGQRKNTIMEDIANRMSEEDLKA

SEQ ID NO: 25099 - protein, 8 aa, Neisseria
GVHKSAHG

SEQ ID NO: 25100 - protein, 12 aa, Neisseria
ATVKKTHKHTKA

SEQ ID NO: 25101 - protein, 5 aa, Neisseria
MNKNI

SEQ ID NO: 25102 - protein, 80 aa, Neisseria; identical to SEQ ID NO: 10274

SEQ ID NO: 25103 - protein, 7 aa, Neisseria
AANKPAS

SEQ ID NO: 25104 - protein, 7 aa, Neisseria
GVHKSAH

SEQ ID NO: 25105 - protein, 10 aa, Neisseria
GASKSAEGSC

SEQ ID NO: 25106 - protein, 15 aa, Neisseria
AGSKAGEGKCGEGKC

SEQ ID NO: 25107 - protein, 32 aa, Neisseria; identical to SEQ ID NO: 10279

SEQ ID NO: 25108 - protein, 8 aa, Neisseria
TILSVLAA

SEQ ID NO: 25109 - protein, 18 aa, Neisseria
DAKPPKEVGKVFRKQQRY

SEQ ID NO: 25110 - protein, 6 aa, Neisseria
VGERVN

SEQ ID NO: 25111 - protein, 10 aa, Neisseria
WRQIEPIPGK

SEQ ID NO: 25112 - protein, 10 aa, Neisseria
HLDGLEEVLA

SEQ ID NO: 25113 - protein, 10 aa, Neisseria
AQKASKAVRR

SEQ ID NO: 25114 - protein, 7 aa, Neisseria
EHLPEAA

SEQ ID NO: 25115 - protein, 9 aa, Neisseria
GALQRLAKL

SEQ ID NO: 25116 - protein, 11 aa, Neisseria
KYPEILDGFFE

SEQ ID NO: 25117 - protein, 15 aa, Neisseria
MEIMNLVSLHRLDDA

SEQ ID NO: 25118 - protein, 8 aa, Neisseria
VIDGYAEK

SEQ ID NO: 25119 - protein, 6 aa, Neisseria
VRQWLK

SEQ ID NO: 25120 - protein, 15 aa, Neisseria
ALRQIGRVRKLPEQQ

SEQ ID NO: 25121 - protein, 6 aa, Neisseria
DNLSKI

SEQ ID NO: 25122 - protein, 5 aa, Neisseria
MFALS

SEQ ID NO: 25123 - protein, 12 aa, Neisseria
EALRGLDKIIEK

SEQ ID NO: 25124 - protein, 8 aa, Neisseria
SDLERAFR

SEQ ID NO: 25125 - protein, 5 aa, Neisseria
NLGYS

SEQ ID NO: 25126 - protein, 5 aa, Neisseria
DSKRL

SEQ ID NO: 25127 - protein, 5 aa, Neisseria
HLGEV

SEQ ID NO: 25128 - protein, 6 aa, Neisseria
DVWTQA

SEQ ID NO: 25129 - protein, 5 aa, Neisseria
WRETL

SEQ ID NO: 25130 - protein, 32 aa, Neisseria
AADAKPPKEVGKVFRKQQRYSEEEIKNERARL

SEQ ID NO: 25131 - protein, 7 aa, Neisseria
AVGERVN

SEQ ID NO: 25132 - protein, 8 aa, Neisseria
TALQKGQA

SEQ ID NO: 25133 - protein, 14 aa, Neisseria
ERTKSPEVAERALE

SEQ ID NO: 25134 - protein, 48 aa, Neisseria; identical to SEQ ID NO: 13040

SEQ ID NO: 25135 - protein, 20 aa, Neisseria
VQQDGLAQKASKAVRRAALR

SEQ ID NO: 25136 - protein, 9 aa, Neisseria
QGREKEKAI

SEQ ID NO: 25137 - protein, 11 aa, Neisseria
RLAKLDTEILP

SEQ ID NO: 25138 - protein, 21 aa, Neisseria
LTARKYPEILDGFFEQTDTQN

SEQ ID NO: 25139 - protein, 8 aa, Neisseria
HRLDDAYA

SEQ ID NO: 25140 - protein, 8 aa, Neisseria
LERNPNAD

SEQ ID NO: 25141 - protein, 8 aa, Neisseria
ANRKEGAS

SEQ ID NO: 25142 - protein, 18 aa, Neisseria
GYAEKAYGRGTGEQRGRA

SEQ ID NO: 25143 - protein, 19 aa, Neisseria
ADRRDYTKVRQWLKKVSAP

SEQ ID NO: 25144 - protein, 6 aa, Neisseria
LFDKGV

SEQ ID NO: 25145 - protein, 10 aa, Neisseria
VELDGGRAAL

SEQ ID NO: 25146 - protein, 17 aa, Neisseria
QIGRVRKLPEQQGRYFT

SEQ ID NO: 25147 - protein, 29 aa, Neisseria
KLPDKREALRGLDKIIEKPPAGSNTELQA

SEQ ID NO: 25148 - protein, 22 aa, Neisseria
RLGKRKKMISDLERAFRLAPDN

SEQ ID NO: 25149 - protein, 11 aa, Neisseria
LSDSKRLDEGF

SEQ ID NO: 25150 - protein, 12 aa, Neisseria
INPDDTAVNDSI

SEQ ID NO: 25151 - protein, 8 aa, Neisseria
LKGDAESA

SEQ ID NO: 25152 - protein, 12 aa, Neisseria
RYSFENDPEPEV

SEQ ID NO: 25153 - protein, 6 aa, Neisseria
GERDQA

SEQ ID NO: 25154 - protein, 29 aa, Neisseria
HLTGDKKIWRETLKRHGIALPQPSRKPRK

SEQ ID NO: 25155 - protein, 32 aa, Neisseria; identical to SEQ ID NO: 25130

SEQ ID NO: 25156 - protein, 7 aa, Neisseria
AVGERVN

SEQ ID NO: 25157 - protein, 8 aa, Neisseria
TALQKGQA

SEQ ID NO: 25158 - protein, 14 aa, Neisseria
ERTKSPEVAERALE

SEQ ID NO: 25159 - protein, 11 aa, Neisseria
IPGKAQKRAGW

SEQ ID NO: 25160 - protein, 9 aa, Neisseria
VLRERGNQH

SEQ ID NO: 25161 - protein, 17 aa, Neisseria
DGLEEVLAQADEGQNRR

SEQ ID NO: 25162 - protein, 16 aa, Neisseria
GLAQKASKAVRRAALR

SEQ ID NO: 25163 - protein, 9 aa, Neisseria
QGREKEKAI

SEQ ID NO: 25164 - protein, 9 aa, Neisseria
RLAKLDTEI

SEQ ID NO: 25165 - protein, 9 aa, Neisseria
LTARKYPEI

SEQ ID NO: 25166 - protein, 8 aa, Neisseria
FEQTDTQN

SEQ ID NO: 25167 - protein, 8 aa, Neisseria
HRLDDAYA

SEQ ID NO: 25168 - protein, 6 aa, Neisseria
LERNPN

SEQ ID NO: 25169 - protein, 8 aa, Neisseria
ANRKEGAS

SEQ ID NO: 25170 - protein, 7 aa, Neisseria
YAEKAYG

SEQ ID NO: 25171 - protein, 9 aa, Neisseria
GTGEQRGRA

SEQ ID NO: 25172 - protein, 8 aa, Neisseria
ADRRDYTK

SEQ ID NO: 25173 - protein, 10 aa, Neisseria
VELDGGRAAL

SEQ ID NO: 25174 - protein, 13 aa, Neisseria
QIGRVRKLPEQQG

SEQ ID NO: 25175 - protein, 21 aa, Neisseria
KLPDKREALRGLDKIIEKPPA

SEQ ID NO: 25176 - protein, 7 aa, Neisseria
SNTELQA

SEQ ID NO: 25177 - protein, 22 aa, Neisseria
RLGKRKKMISDLERAFRLAPDN

SEQ ID NO: 25178 - protein, 8 aa, Neisseria
SDSKRLDE

SEQ ID NO: 25179 - protein, 7 aa, Neisseria
NPDDTAV

SEQ ID NO: 25180 - protein, 5 aa, Neisseria
GDAES

SEQ ID NO: 25181 - protein, 9 aa, Neisseria
FENDPEPEV

SEQ ID NO: 25182 - protein, 6 aa, Neisseria
GERDQA

SEQ ID NO: 25183 - protein, 15 aa, Neisseria
TGDKKIWRETLKRHG

SEQ ID NO: 25184 - protein, 8 aa, Neisseria
QPSRKPRK

SEQ ID NO: 25185 - protein, 12 aa, Neisseria
SVATLLNNFYGQ

SEQ ID NO: 25186 - protein, 6 aa, Neisseria
VLKKLD

SEQ ID NO: 25187 - protein, 7 aa, Neisseria
FEDMRRI

SEQ ID NO: 25188 - protein, 6 aa, Neisseria
EQLAQL

SEQ ID NO: 25189 - protein, 7 aa, Neisseria
SVLRGID

SEQ ID NO: 25190 - protein, 20 aa, Neisseria
QSWKERRDFNIVKQDLDFSC

SEQ ID NO: 25191 - protein, 33 aa, Neisseria; identical to SEQ ID NO: 13099

SEQ ID NO: 25192 - protein, 8 aa, Neisseria
LGFEAKGY

SEQ ID NO: 25193 - protein, 10 aa, Neisseria
LKYRKDDHFS

SEQ ID NO: 25194 - protein, 7 aa, Neisseria
RGIDGNT

SEQ ID NO: 25195 - protein, 9 aa, Neisseria
WQTREGNLA

SEQ ID NO: 25196 - protein, 9 aa, Neisseria
VPKKAETIS

SEQ ID NO: 25197 - protein, 8 aa, Neisseria
HHPKRQTE

SEQ ID NO: 25198 - protein, 6 aa, Neisseria
RQARAE

SEQ ID NO: 25199 - protein, 17 aa, Neisseria
SWKERRDFNIVKQDLDF

SEQ ID NO: 25200 - protein, 27 aa, Neisseria
LTEEEVLKKLDKEQMRASFEDMRRIMP

SEQ ID NO: 25201 - protein, 7 aa, Neisseria
LGFEAKG

SEQ ID NO: 25202 - protein, 9 aa, Neisseria
KYRKDDHFS

SEQ ID NO: 25203 - protein, 8 aa, Neisseria
WQTREGNL

SEQ ID NO: 25204 - protein, 9 aa, Neisseria
VPKKAETIS

SEQ ID NO: 25205 - protein, 7 aa, Neisseria
HPKRQTE

SEQ ID NO: 25206 - protein, 6 aa, Neisseria
RQARAE

SEQ ID NO: 25207 - protein, 13 aa, Neisseria
NTSTNVGGFYGLT

SEQ ID NO: 25208 - protein, 21 aa, Neisseria
QSGSQHFTDHLKSADIFDAAQ

SEQ ID NO: 25209 - protein, 6 aa, Neisseria
GDFSTT

SEQ ID NO: 25210 - protein, 8 aa, Neisseria
YKVDEYHA

SEQ ID NO: 25211 - protein, 7 aa, Neisseria
FNTSTNV

SEQ ID NO: 25212 - protein, 14 aa, Neisseria
VEFDQAKRDGKIDI

SEQ ID NO: 25213 - protein, 5 aa, Neisseria
DHLKS

SEQ ID NO: 25214 - protein, 9 aa, Neisseria
QYPDIRFVS

SEQ ID NO: 25215 - protein, 11 aa, Neisseria
KFNFNGKKLVS

SEQ ID NO: 25216 - protein, 14 aa, Neisseria
MHGKTAPVKLKAEK

SEQ ID NO: 25217 - protein, 9 aa, Neisseria
NCYQSPMLK

SEQ ID NO: 25218 - protein, 6 aa, Neisseria
EVCGGD

SEQ ID NO: 25219 - protein, 10 aa, Neisseria
STTIDRTKWG

SEQ ID NO: 25220 - protein, 5 aa, Neisseria
KSVRI

SEQ ID NO: 25221 - protein, 8 aa, Neisseria
IQIEAAKQ

SEQ ID NO: 25222 - protein, 8 aa, Neisseria
YKVDEYHA

SEQ ID NO: 25223 - protein, 14 aa, Neisseria
VEFDQAKRDGKIDI

SEQ ID NO: 25224 - protein, 5 aa, Neisseria
DHLKS

SEQ ID NO: 25225 - protein, 8 aa, Neisseria
FNGKKLVS

SEQ ID NO: 25226 - protein, 11 aa, Neisseria
KTAPVKLKAEK

SEQ ID NO: 25227 - protein, 8 aa, Neisseria
TTIDRTKW

SEQ ID NO: 25228 - protein, 5 aa, Neisseria
KSVRI

SEQ ID NO: 25229 - protein, 8 aa, Neisseria
IQIEAAKQ

SEQ ID NO: 25230 - protein, 8 aa, Neisseria
SFFALVFA

SEQ ID NO: 25231 - protein, 13 aa, Neisseria
AFVAKLARLFRNA

SEQ ID NO: 25232 - protein, 10 aa, Neisseria
EESLAGAVDD

SEQ ID NO: 25233 - protein, 13 aa, Neisseria
EDVYEHCLGCYQM

SEQ ID NO: 25234 - protein, 8 aa, Neisseria
YRDVANDE

SEQ ID NO: 25235 - protein, 6 aa, Neisseria
SNRIAS

SEQ ID NO: 25236 - protein, 9 aa, Neisseria
QNMRELMPR

SEQ ID NO: 25237 - protein, 13 aa, Neisseria
EKEVSRYAEAAAR

SEQ ID NO: 25238 - protein, 5 aa, Neisseria
INPRW

SEQ ID NO: 25239 - protein, 10 aa, Neisseria
LSDTATENPN

SEQ ID NO: 25240 - protein, 7 aa, Neisseria
FRNADRA

SEQ ID NO: 25241 - protein, 11 aa, Neisseria
VKESMRTEESL

SEQ ID NO: 25242 - protein, 13 aa, Neisseria
AVDDGPLQSEKDY

SEQ ID NO: 25243 - protein, 10 aa, Neisseria
RLSRLKEKAK

SEQ ID NO: 25244 - protein, 7 aa, Neisseria
TEQEHGE

SEQ ID NO: 25245 - protein, 6 aa, Neisseria
YIGEGG

SEQ ID NO: 25246 - protein, 10 aa, Neisseria
LSQRSPEAFV

SEQ ID NO: 25247 - protein, 10 aa, Neisseria
YLYRNDRPFS

SEQ ID NO: 25248 - protein, 14 aa, Neisseria
VHGENYETTGEYRV

SEQ ID NO: 25249 - protein, 20 aa, Neisseria
QPDGSVFDASGRGKIGEDVY

SEQ ID NO: 25250 - protein, 31 aa, Neisseria
KYRDVANDEQKVWDFREESNRIASDSRDSVF

SEQ ID NO: 25251 - protein, 14 aa, Neisseria
NMRELMPRGMKANS

SEQ ID NO: 25252 - protein, 8 aa, Neisseria
YDADGLPQ

SEQ ID NO: 25253 - protein, 19 aa, Neisseria
SFDNGKKRQSFEYYLKNGN

SEQ ID NO: 25254 - protein, 7 aa, Neisseria
LKADGVT

SEQ ID NO: 25255 - protein, 19 aa, Neisseria
LDGGRIVREEKQGDRLPDF

SEQ ID NO: 25256 - protein, 29 aa, Neisseria
LNLEDLEKEVSRYAEAAARRSGGRRDLSH

SEQ ID NO: 25257 - protein, 6 aa, Neisseria
TATENP

SEQ ID NO: 25258 - protein, 7 aa, Neisseria
FRNADRA

SEQ ID NO: 25259 - protein, 11 aa, Neisseria
VKESMRTEESL

SEQ ID NO: 25260 - protein, 13 aa, Neisseria
AVDDGPLQSEKDY

SEQ ID NO: 25261 - protein, 10 aa, Neisseria
RLSRLKEKAK

SEQ ID NO: 25262 - protein, 7 aa, Neisseria
TEQEHGE

SEQ ID NO: 25263 - protein, 7 aa, Neisseria
LSQRSPE

SEQ ID NO: 25264 - protein, 7 aa, Neisseria
YRNDRPF

SEQ ID NO: 25265 - protein, 9 aa, Neisseria
ENYETTGEY

SEQ ID NO: 25266 - protein, 12 aa, Neisseria
ASGRGKIGEDVY

SEQ ID NO: 25267 - protein, 30 aa, Neisseria
KYRDVANDEQKVWDFREESNRIASDSRDSV

SEQ ID NO: 25268 - protein, 11 aa, Neisseria
NMRELMPRGMK

SEQ ID NO: 25269 - protein, 7 aa, Neisseria
YDADGLP

SEQ ID NO: 25270 - protein, 8 aa, Neisseria
DNGKKRQS

SEQ ID NO: 25271 - protein, 7 aa, Neisseria
LKADGVT

SEQ ID NO: 25272 - protein, 15 aa, Neisseria
GGRIVREEKQGDRLP

SEQ ID NO: 25273 - protein, 29 aa, Neisseria
LNLEDLEKEVSRYAEAAARRSGGRRDLSH

SEQ ID NO: 25274 - protein, 12 aa, Neisseria
GGSVRSVSEPIQ

SEQ ID NO: 25275 - protein, 10 aa, Neisseria
PEDYTRIVAD

SEQ ID NO: 25276 - protein, 6 aa, Neisseria
YDQSGD

SEQ ID NO: 25277 - protein, 12 aa, Neisseria
RRLQSVSRTAEM

SEQ ID NO: 25278 - protein, 6 aa, Neisseria
ISDTLQ

SEQ ID NO: 25279 - protein, 7 aa, Neisseria
YYSLNRF

SEQ ID NO: 25280 - protein, 7 aa, Neisseria
SQEARRV

SEQ ID NO: 25281 - protein, 5 aa, Neisseria
TLPIV

SEQ ID NO: 25282 - protein, 8 aa, Neisseria
QNDLPNFD

SEQ ID NO: 25283 - protein, 12 aa, Neisseria
NTANSLSAAVQS

SEQ ID NO: 25284 - protein, 5 aa, Neisseria
DKLSQ

SEQ ID NO: 25285 - protein, 5 aa, Neisseria
KKPIE

SEQ ID NO: 25286 - protein, 9 aa, Neisseria
DLSSVGRNP

SEQ ID NO: 25287 - protein, 5 aa, Neisseria
FGTHC

SEQ ID NO: 25288 - protein, 23 aa, Neisseria
VAAEETDNPTAGGSVRSVSEPIQ

SEQ ID NO: 25289 - protein, 5 aa, Neisseria
SLGST

SEQ ID NO: 25290 - protein, 47 aa, Neisseria; identical to SEQ ID NO: 13217

SEQ ID NO: 25291 - protein, 11 aa, Neisseria
VVVERNRTTLN

SEQ ID NO: 25292 - protein, 32 aa, Neisseria; identical to SEQ ID NO: 13219

SEQ ID NO: 25293 - protein, 54 aa, Neisseria
LEQQTGEAHNVRMETEHGGRRLQSVSRTAEMLGEGHYKLTETQFNTCSAGDAGW

SEQ ID NO: 25294 - protein, 12 aa, Neisseria
ASVEADREKGIG

SEQ ID NO: 25295 - protein, 11 aa, Neisseria
FPLDGNRKSGL

SEQ ID NO: 25296 - protein, 7 aa, Neisseria
SAGSDGV

SEQ ID NO: 25297 - protein, 26 aa, Neisseria
GVIGERGAVFDGQVRYLRPDYAGQSD

SEQ ID NO: 25298 - protein, 15 aa, Neisseria
LPHDKKSGRNNRYQA

SEQ ID NO: 25299 - protein, 11 aa, Neisseria
WQHRHDISDTL

SEQ ID NO: 25300 - protein, 31 aa, Neisseria; identical to SEQ ID NO: 13227

SEQ ID NO: 25301 - protein, 11 aa, Neisseria
DYGGRAAGGSL

SEQ ID NO: 25302 - protein, 11 aa, Neisseria
ANQSGYKDKPY

SEQ ID NO: 25303 - protein, 13 aa, Neisseria
RLSADWRKNTGRA

SEQ ID NO: 25304 - protein, 12 aa, Neisseria
RFSHDSRQDGSR

SEQ ID NO: 25305 - protein, 12 aa, Neisseria
PDIKWDFSNSWG

SEQ ID NO: 25306 - protein, 13 aa, Neisseria
NRFGSQEARRVSR

SEQ ID NO: 25307 - protein, 16 aa, Neisseria
DSGMTFERNTRMFGGG

SEQ ID NO: 25308 - protein, 6 aa, Neisseria
QTLEPR

SEQ ID NO: 25309 - protein, 18 aa, Neisseria
AKSQNDLPNFDSSESSFG

SEQ ID NO: 25310 - protein, 17 aa, Neisseria
FRENLYYGNDRINTANS

SEQ ID NO: 25311 - protein, 46 aa, Neisseria
VQSRILDGATGEERFRAGIGQKFYFKNDAVMLDGSVGKKPRSRSDW

SEQ ID NO: 25312 - protein, 25 aa, Neisseria
SSGIGSRFILDSSIHYNQNDKRAEN

SEQ ID NO: 25313 - protein, 32 aa, Neisseria; identical to SEQ ID NO: 13240

SEQ ID NO: 25314 - protein, 5 aa, Neisseria
DKLSQ

SEQ ID NO: 25315 - protein, 10 aa, Neisseria
YGFEAKKPIE

SEQ ID NO: 25316 - protein, 10 aa, Neisseria
AEYKSSCGCW

SEQ ID NO: 25317 - protein, 9 aa, Neisseria
VTGENTYKN

SEQ ID NO: 25318 - protein, 18 aa, Neisseria
QLKDLSSVGRNPADRMDV

SEQ ID NO: 25319 - protein, 10 aa, Neisseria
VAAEETDNPT

SEQ ID NO: 25320 - protein, 11 aa, Neisseria
GSVRSVSEPIQ

SEQ ID NO: 25321 - protein, 13 aa, Neisseria
NESGSPERTEAAV

SEQ ID NO: 25322 - protein, 12 aa, Neisseria
GSGEASIPEDYT

SEQ ID NO: 25323 - protein, 9 aa, Neisseria
VADRMEGQS

SEQ ID NO: 25324 - protein, 7 aa, Neisseria
VQVRAEG

SEQ ID NO: 25325 - protein, 10 aa, Neisseria
VVVERNRTTL

SEQ ID NO: 25326 - protein, 18 aa, Neisseria
ADYDQSGDTVTAGDRFAL

SEQ ID NO: 25327 - protein, 7 aa, Neisseria
TLIRGET

SEQ ID NO: 25328 - protein, 31 aa, Neisseria
QQTGEAHNVRMETEHGGRRLQSVSRTAEMLG

SEQ ID NO: 25329 - protein, 7 aa, Neisseria
GHYKLTE

SEQ ID NO: 25330 - protein, 12 aa, Neisseria
ASVEADREKGIG

SEQ ID NO: 25331 - protein, 9 aa, Neisseria
PLDGNRKSG

SEQ ID NO: 25332 - protein, 6 aa, Neisseria
AGSDGV

SEQ ID NO: 25333 - protein, 7 aa, Neisseria
IGERGAV

SEQ ID NO: 25334 - protein, 5 aa, Neisseria
VRYLR

SEQ ID NO: 25335 - protein, 13 aa, Neisseria
HDKKSGRNNRYQA

SEQ ID NO: 25336 - protein, 9 aa, Neisseria
WQHRHDISD

SEQ ID NO: 25337 - protein, 8 aa, Neisseria
SGYKDKPY

SEQ ID NO: 25338 - protein, 12 aa, Neisseria
LSADWRKNTGRA

SEQ ID NO: 25339 - protein, 11 aa, Neisseria
FSHDSRQDGSR

SEQ ID NO: 25340 - protein, 10 aa, Neisseria
GSQEARRVSR

SEQ ID NO: 25341 - protein, 8 aa, Neisseria
MTFERNTR

SEQ ID NO: 25342 - protein, 5 aa, Neisseria
KSQND

SEQ ID NO: 25343 - protein, 5 aa, Neisseria
DSSES

SEQ ID NO: 25344 - protein, 5 aa, Neisseria
DRINT

SEQ ID NO: 25345 - protein, 9 aa, Neisseria
ATGEERFRA

SEQ ID NO: 25346 - protein, 11 aa, Neisseria
SVGKKPRSRSD

SEQ ID NO: 25347 - protein, 8 aa, Neisseria
QNDKRAEN

SEQ ID NO: 25348 - protein, 5 aa, Neisseria
YRPAQ

SEQ ID NO: 25349 - protein, 15 aa, Neisseria
YKYGRNEKIYLKSDG

SEQ ID NO: 25350 - protein, 8 aa, Neisseria
FEAKKPIE

SEQ ID NO: 25351 - protein, 5 aa, Neisseria
AEYKS

SEQ ID NO: 25352 - protein, 18 aa, Neisseria
QLKDLSSVGRNPADRMDV

SEQ ID NO: 25353 - protein, 8 aa, Neisseria
AALARVGG

SEQ ID NO: 25354 - protein, 13 aa, Neisseria
AHHDGHGDDDHGH

SEQ ID NO: 25355 - protein, 10 aa, Neisseria
QHSKQDKIIS

SEQ ID NO: 25356 - protein, 8 aa, Neisseria
AQAEKAAL

SEQ ID NO: 25357 - protein, 31 aa, Neisseria; identical to SEQ ID NO: 10983

SEQ ID NO: 25358 - protein, 15 aa, Neisseria
VDARTGRVISSRRDD

SEQ ID NO: 25359 - protein, 10 aa, Neisseria
DGHGDDDHGH

SEQ ID NO: 25360 - protein, 10 aa, Neisseria
QHSKQDKIIS

SEQ ID NO: 25361 - protein, 8 aa, Neisseria
AQAEKAAL

SEQ ID NO: 25362 - protein, 19 aa, Neisseria
VGGKITDIDLEHDNGRPHY

SEQ ID NO: 25363 - protein, 9 aa, Neisseria
EIVKNGQEY

SEQ ID NO: 25364 - protein, 7 aa, Neisseria
VDARTGR

SEQ ID NO: 25365 - protein, 7 aa, Neisseria
ISSRRDD

SEQ ID NO: 25366 - protein, 13 aa, Neisseria
SSERMSEVEYFSH

SEQ ID NO: 25367 - protein, 8 aa, Neisseria
RKLEEILG

SEQ ID NO: 25368 - protein, 12 aa, Neisseria
RGNKFYESMYRL

SEQ ID NO: 25369 - protein, 6 aa, Neisseria
LDDSIR

SEQ ID NO: 25370 - protein, 8 aa, Neisseria
FVRVYEKG

SEQ ID NO: 25371 - protein, 11 aa, Neisseria
ICRKFKNMPVP

SEQ ID NO: 25372 - protein, 9 aa, Neisseria
NAVGKLVNF

SEQ ID NO: 25373 - protein, 8 aa, Neisseria
EIVESLKA

SEQ ID NO: 25374 - protein, 7 aa, Neisseria
GFPKGLE

SEQ ID NO: 25375 - protein, 9 aa, Neisseria
LEMLRDGLK

SEQ ID NO: 25376 - protein, 7 aa, Neisseria
NSDKFDR

SEQ ID NO: 25377 - protein, 21 aa, Neisseria
LTNRGGAKLKTNSKSSERMSE

SEQ ID NO: 25378 - protein, 21 aa, Neisseria
ISDGKGKLLEIPQRRGKQDGV

SEQ ID NO: 25379 - protein, 7 aa, Neisseria
TLLKVSG

SEQ ID NO: 25380 - protein, 5 aa, Neisseria
RKLEE

SEQ ID NO: 25381 - protein, 14 aa, Neisseria
ITRKCKSRGNKFYE

SEQ ID NO: 25382 - protein, 12 aa, Neisseria
MYRLGSDDVDYG

SEQ ID NO: 25383 - protein, 9 aa, Neisseria
HFGGQRNTV

SEQ ID NO: 25384 - protein, 6 aa, Neisseria
LKGTGC

SEQ ID NO: 25385 - protein, 13 aa, Neisseria
QFLDDSIRTRITR

SEQ ID NO: 25386 - protein, 32 aa, Neisseria; identical to SEQ ID NO: 13398

SEQ ID NO: 25387 - protein, 10 aa, Neisseria
AWRNEDGSGK

SEQ ID NO: 25388 - protein, 10 aa, Neisseria
YVGRKKNSRF

SEQ ID NO: 25389 - protein, 17 aa, Neisseria
RVYEKGRQLGDKESKWV

SEQ ID NO: 25390 - protein, 7 aa, Neisseria
NYGDIEI

SEQ ID NO: 25391 - protein, 5 aa, Neisseria
INQGS

SEQ ID NO: 25392 - protein, 21 aa, Neisseria
ICRKFKNMPVPERFDQRKKTL

SEQ ID NO: 25393 - protein, 27 aa, Neisseria
GFDNSEIVESLKADSGFPKGLEPEKYA

SEQ ID NO: 25394 - protein, 7 aa, Neisseria
MLRDGLK

SEQ ID NO: 25395 - protein, 14 aa, Neisseria
HEQPDIDLEIELDE

SEQ ID NO: 25396 - protein, 30 aa, Neisseria; identical to SEQ ID NO: 13408

SEQ ID NO: 25397 - protein, 6 aa, Neisseria
VDYDYF

SEQ ID NO: 25398 - protein, 21 aa, Neisseria
LTNRGGAKLKTNSKSSERMSE

SEQ ID NO: 25399 - protein, 20 aa, Neisseria
SDGKGKLLEIPQRRGKQDGV

SEQ ID NO: 25400 - protein, 5 aa, Neisseria
RKLEE

SEQ ID NO: 25401 - protein, 13 aa, Neisseria
ITRKCKSRGNKFY

SEQ ID NO: 25402 - protein, 9 aa, Neisseria
LGSDDVDYG

SEQ ID NO: 25403 - protein, 5 aa, Neisseria
LKGTG

SEQ ID NO: 25404 - protein, 13 aa, Neisseria
QFLDDSIRTRITR

SEQ ID NO: 25405 - protein, 9 aa, Neisseria
ALLDHDNGF

SEQ ID NO: 25406 - protein, 10 aa, Neisseria
SNQRPKSETI

SEQ ID NO: 25407 - protein, 8 aa, Neisseria
WRNEDGSG

SEQ ID NO: 25408 - protein, 8 aa, Neisseria
GRKKNSRF

SEQ ID NO: 25409 - protein, 17 aa, Neisseria
RVYEKGRQLGDKESKWV

SEQ ID NO: 25410 - protein, 5 aa, Neisseria
RKFKN

SEQ ID NO: 25411 - protein, 13 aa, Neisseria
PVPERFDQRKKTL

SEQ ID NO: 25412 - protein, 17 aa, Neisseria
GFDNSEIVESLKADSGF

SEQ ID NO: 25413 - protein, 9 aa, Neisseria
KGLEPEKYA

SEQ ID NO: 25414 - protein, 7 aa, Neisseria
MLRDGLK

SEQ ID NO: 25415 - protein, 13 aa, Neisseria
EQPDIDLEIELDE

SEQ ID NO: 25416 - protein, 13 aa, Neisseria
KNSDKFDREKRLF

SEQ ID NO: 25417 - protein, 14 aa, Neisseria
DYDVEKERKYQEYL

SEQ ID NO: 25418 - protein, 14 aa, Neisseria
ERLIARLAREPDSA

SEQ ID NO: 25419 - protein, 12 aa, Neisseria
DTLLRLEKVLDF

SEQ ID NO: 25420 - protein, 9 aa, Neisseria
DSIERITAY

SEQ ID NO: 25421 - protein, 6 aa, Neisseria
DLLKYM

SEQ ID NO: 25422 - protein, 9 aa, Neisseria
ALLKEFREQ

SEQ ID NO: 25423 - protein, 14 aa, Neisseria
FEDIIEQIVGDIED

SEQ ID NO: 25424 - protein, 10 aa, Neisseria
ATEIEDINAF

SEQ ID NO: 25425 - protein, 5 aa, Neisseria
IQELG

SEQ ID NO: 25426 - protein, 10 aa, Neisseria
MDGAQPKTNF

SEQ ID NO: 25427 - protein, 10 aa, Neisseria
LAREPDSAED

SEQ ID NO: 25428 - protein, 12 aa, Neisseria
QAHEQEVFDADT

SEQ ID NO: 25429 - protein, 8 aa, Neisseria
LRLEKVLD

SEQ ID NO: 25430 - protein, 26 aa, Neisseria
SDLEVRDAMITRSRMNVLKENDSIER

SEQ ID NO: 25431 - protein, 9 aa, Neisseria
VIGEDKDEV

SEQ ID NO: 25432 - protein, 7 aa, Neisseria
FNPEQFH

SEQ ID NO: 25433 - protein, 5 aa, Neisseria
PEGKS

SEQ ID NO: 25434 - protein, 9 aa, Neisseria
KEFREQRNH

SEQ ID NO: 25435 - protein, 9 aa, Neisseria
IDEYGGTSG

SEQ ID NO: 25436 - protein, 17 aa, Neisseria
IVGDIEDEFDEDESADN

SEQ ID NO: 25437 - protein, 6 aa, Neisseria
SAERWR

SEQ ID NO: 25438 - protein, 5 aa, Neisseria
TEIED

SEQ ID NO: 25439 - protein, 11 aa, Neisseria
GTEYSSEEADT

SEQ ID NO: 25440 - protein, 11 aa, Neisseria
GHLPVRGEKVL

SEQ ID NO: 25441 - protein, 9 aa, Neisseria
ARADNRRLH

SEQ ID NO: 25442 - protein, 7 aa, Neisseria
MDGAQPK

SEQ ID NO: 25443 - protein, 10 aa, Neisseria
LAREPDSAED

SEQ ID NO: 25444 - protein, 9 aa, Neisseria
QAHEQEVFD

SEQ ID NO: 25445 - protein, 8 aa, Neisseria
LRLEKVLD

SEQ ID NO: 25446 - protein, 26 aa, Neisseria
SDLEVRDAMITRSRMNVLKENDSIER

SEQ ID NO: 25447 - protein, 9 aa, Neisseria
VIGEDKDEV

SEQ ID NO: 25448 - protein, 5 aa, Neisseria
PEGKS

SEQ ID NO: 25449 - protein, 8 aa, Neisseria
KEFREQRN

SEQ ID NO: 25450 - protein, 17 aa, Neisseria
IVGDIEDEFDEDESADN

SEQ ID NO: 25451 - protein, 6 aa, Neisseria
SAERWR

SEQ ID NO: 25452 - protein, 5 aa, Neisseria
TEIED

SEQ ID NO: 25453 - protein, 8 aa, Neisseria
YSSEEADT

SEQ ID NO: 25454 - protein, 7 aa, Neisseria
VRGEKVL

SEQ ID NO: 25455 - protein, 9 aa, Neisseria
ARADNRRLH

SEQ ID NO: 25456 - protein, 11 aa, Neisseria
ANPDKVYRVAS

SEQ ID NO: 25457 - protein, 7 aa, Neisseria
APFESLD

SEQ ID NO: 25458 - protein, 5 aa, Neisseria
NAMAK

SEQ ID NO: 25459 - protein, 17 aa, Neisseria
KISSSEDLKNMNKVGVV

SEQ ID NO: 25460 - protein, 6 aa, Neisseria
KIARFE

SEQ ID NO: 25461 - protein, 10 aa, Neisseria
LENGGLDSVV

SEQ ID NO: 25462 - protein, 8 aa, Neisseria
ANYVKNNP

SEQ ID NO: 25463 - protein, 8 aa, Neisseria
GMDFVTLP

SEQ ID NO: 25464 - protein, 17 aa, Neisseria
VKMLNDALKKVRESGEY

SEQ ID NO: 25465 - protein, 10 aa, Neisseria
CGGQGKDAAA

SEQ ID NO: 25466 - protein, 8 aa, Neisseria
ANPDKVYR

SEQ ID NO: 25467 - protein, 13 aa, Neisseria
ESLDSKGNVEGFD

SEQ ID NO: 25468 - protein, 10 aa, Neisseria
IEFKHQPWDS

SEQ ID NO: 25469 - protein, 8 aa, Neisseria
LNNGDADV

SEQ ID NO: 25470 - protein, 16 aa, Neisseria
ITDDRKQSMDFSDPYF

SEQ ID NO: 25471 - protein, 18 aa, Neisseria
VPKGKKISSSEDLKNMNK

SEQ ID NO: 25472 - protein, 11 aa, Neisseria
LLGNDNPKIAR

SEQ ID NO: 25473 - protein, 16 aa, Neisseria
KELENGGLDSVVSDSA

SEQ ID NO: 25474 - protein, 10 aa, Neisseria
KNNPTKGMDF

SEQ ID NO: 25475 - protein, 5 aa, Neisseria
PDFTT

SEQ ID NO: 25476 - protein, 9 aa, Neisseria
VRKGDEATV

SEQ ID NO: 25477 - protein, 19 aa, Neisseria
MLNDALKKVRESGEYDKIY

SEQ ID NO: 25478 - protein, 10 aa, Neisseria
FAKEDGQAAK

SEQ ID NO: 25479 - protein, 8 aa, Neisseria
GQGKDAAA

SEQ ID NO: 25480 - protein, 8 aa, Neisseria
ANPDKVYR

SEQ ID NO: 25481 - protein, 13 aa, Neisseria
ESLDSKGNVEGFD

SEQ ID NO: 25482 - protein, 7 aa, Neisseria
NNGDADV

SEQ ID NO: 25483 - protein, 12 aa, Neisseria
ITDDRKQSMDFS

SEQ ID NO: 25484 - protein, 16 aa, Neisseria
PKGKKISSSEDLKNMN

SEQ ID NO: 25485 - protein, 7 aa, Neisseria
DNPKIAR

SEQ ID NO: 25486 - protein, 8 aa, Neisseria
KELENGGL

SEQ ID NO: 25487 - protein, 7 aa, Neisseria
NPTKGMD

SEQ ID NO: 25488 - protein, 9 aa, Neisseria
VRKGDEATV

SEQ ID NO: 25489 - protein, 19 aa, Neisseria
MLNDALKKVRESGEYDKIY

SEQ ID NO: 25490 - protein, 10 aa, Neisseria
FAKEDGQAAK

SEQ ID NO: 25491 - protein, 16 aa, Neisseria
VRQKMVNGVNILANAV

SEQ ID NO: 25492 - protein, 11 aa, Neisseria
AQMVKEVASKT

SEQ ID NO: 25493 - protein, 7 aa, Neisseria
VAEGMKY

SEQ ID NO: 25494 - protein, 35 aa, Neisseria
DLKRGIDKAVAALVEELKNIAKPCDTSKEIAQVGS

SEQ ID NO: 25495 - protein, 11 aa, Neisseria
AIIAEAMEKVG

SEQ ID NO: 25496 - protein, 9 aa, Neisseria
NELDVVEGM

SEQ ID NO: 25497 - protein, 8 aa, Neisseria
EKQIAGLD

SEQ ID NO: 25498 - protein, 17 aa, Neisseria
ISNIRDLLPVLEQVAKA

SEQ ID NO: 25499 - protein, 11 aa, Neisseria
NNIRGILKTVA

SEQ ID NO: 25500 - protein, 11 aa, Neisseria
TLDDLGQAKRI

SEQ ID NO: 25501 - protein, 10 aa, Neisseria
TIIDGFGDAA

SEQ ID NO: 25502 - protein, 10 aa, Neisseria
ERVAKLAGGV

SEQ ID NO: 25503 - protein, 6 aa, Neisseria
LENLHT

SEQ ID NO: 25504 - protein, 15 aa, Neisseria
LRAVESPLRQIVANA

SEQ ID NO: 25505 - protein, 8 aa, Neisseria
EYGDMIEM

SEQ ID NO: 25506 - protein, 5 aa, Neisseria
TRSAL

SEQ ID NO: 25507 - protein, 8 aa, Neisseria
MAAKDVQF

SEQ ID NO: 25508 - protein, 9 aa, Neisseria
NEVRQKMVN

SEQ ID NO: 25509 - protein, 11 aa, Neisseria
TLGPKGRNVVV

SEQ ID NO: 25510 - protein, 28 aa, Neisseria
AFGGPHITKDGVTVAKEIELKDKFENMG

SEQ ID NO: 25511 - protein, 18 aa, Neisseria
MVKEVASKTNDVAGDGTT

SEQ ID NO: 25512 - protein, 13 aa, Neisseria
NPTDLKRGIDKAV

SEQ ID NO: 25513 - protein, 17 aa, Neisseria
EELKNIAKPCDTSKEIA

SEQ ID NO: 25514 - protein, 9 aa, Neisseria
ISANSDEQV

SEQ ID NO: 25515 - protein, 26 aa, Neisseria
EAMEKVGKEGVITVEDGKSLENELDV

SEQ ID NO: 25516 - protein, 7 aa, Neisseria
MQFDRGY

SEQ ID NO: 25517 - protein, 7 aa, Neisseria
DAEKQIA

SEQ ID NO: 25518 - protein, 10 aa, Neisseria
FDKKISNIRD

SEQ ID NO: 25519 - protein, 7 aa, Neisseria
QVAKASR

SEQ ID NO: 25520 - protein, 7 aa, Neisseria
EDVEGEA

SEQ ID NO: 25521 - protein, 6 aa, Neisseria
NIRGIL

SEQ ID NO: 25522 - protein, 12 aa, Neisseria
APGFGDRRKAML

SEQ ID NO: 25523 - protein, 31 aa, Neisseria
ISEEVGLSLEKATLDDLGQAKRIEIGKENTT

SEQ ID NO: 25524 - protein, 41 aa, Neisseria; identical to SEQ ID NO: 13537

SEQ ID NO: 25525 - protein, 17 aa, Neisseria
TEVEMKEKKDRVEDALH

SEQ ID NO: 25526 - protein, 7 aa, Neisseria
AAVEEGV

SEQ ID NO: 25527 - protein, 6 aa, Neisseria
RARAAL

SEQ ID NO: 25528 - protein, 12 aa, Neisseria
LHTGNADQDAGV

SEQ ID NO: 25529 - protein, 7 aa, Neisseria
AVESPLR

SEQ ID NO: 25530 - protein, 8 aa, Neisseria
NAGGEPSV

SEQ ID NO: 25531 - protein, 10 aa, Neisseria
VLEGKGNYGY

SEQ ID NO: 25532 - protein, 11 aa, Neisseria
AGSGEYGDMIE

SEQ ID NO: 25533 - protein, 10 aa, Neisseria
DPAKVTRSAL

SEQ ID NO: 25534 - protein, 14 aa, Neisseria
EIPEDKPAMPDMGG

SEQ ID NO: 25535 - protein, 8 aa, Neisseria
MAAKDVQF

SEQ ID NO: 25536 - protein, 7 aa, Neisseria
NEVRQKM

SEQ ID NO: 25537 - protein, 8 aa, Neisseria
PKGRNVVV

SEQ ID NO: 25538 - protein, 21 aa, Neisseria
HITKDGVTVAKEIELKDKFEN

SEQ ID NO: 25539 - protein, 18 aa, Neisseria
MVKEVASKTNDVAGDGTT

SEQ ID NO: 25540 - protein, 11 aa, Neisseria
TDLKRGIDKAV

SEQ ID NO: 25541 - protein, 17 aa, Neisseria
EELKNIAKPCDTSKEIA

SEQ ID NO: 25542 - protein, 7 aa, Neisseria
ANSDEQV

SEQ ID NO: 25543 - protein, 26 aa, Neisseria
EAMEKVGKEGVITVEDGKSLENELDV

SEQ ID NO: 25544 - protein, 7 aa, Neisseria
DAEKQIA

SEQ ID NO: 25545 - protein, 10 aa, Neisseria
FDKKISNIRD

SEQ ID NO: 25546 - protein, 7 aa, Neisseria
QVAKASR

SEQ ID NO: 25547 - protein, 7 aa, Neisseria
EDVEGEA

SEQ ID NO: 25548 - protein, 10 aa, Neisseria
GFGDRRKAML

SEQ ID NO: 25549 - protein, 31 aa, Neisseria; identical to SEQ ID NO: 25523

SEQ ID NO: 25550 - protein, 32 aa, Neisseria; identical to SEQ ID NO: 13563

SEQ ID NO: 25551 - protein, 17 aa, Neisseria
TEVEMKEKKDRVEDALH

SEQ ID NO: 25552 - protein, 7 aa, Neisseria
AAVEEGV

SEQ ID NO: 25553 - protein, 6 aa, Neisseria
RARAAL

SEQ ID NO: 25554 - protein, 7 aa, Neisseria
GNADQDA

SEQ ID NO: 25555 - protein, 6 aa, Neisseria
AVESPL

SEQ ID NO: 25556 - protein, 5 aa, Neisseria
AGGEP

SEQ ID NO: 25557 - protein, 6 aa, Neisseria
VLEGKG

SEQ ID NO: 25558 - protein, 7 aa, Neisseria
GSGEYGD

SEQ ID NO: 25559 - protein, 7 aa, Neisseria
DPAKVTR

SEQ ID NO: 25560 - protein, 9 aa, Neisseria
EIPEDKPAM

SEQ ID NO: 25561 - protein, 6 aa, Neisseria
QYLALA

SEQ ID NO: 25562 - protein, 8 aa, Neisseria
LAGCDKAG

SEQ ID NO: 25563 - protein, 8 aa, Neisseria
SFVERIKH

SEQ ID NO: 25564 - protein, 10 aa, Neisseria
MLLPDFVQLV

SEQ ID NO: 25565 - protein, 19 aa, Neisseria
DPFYEFFKRLVPNMPEIPQ

SEQ ID NO: 25566 - protein, 6 aa, Neisseria
TGMGSI

SEQ ID NO: 25567 - protein, 8 aa, Neisseria
AKLIGSDV

SEQ ID NO: 25568 - protein, 10 aa, Neisseria
IGNPKDLKPG

SEQ ID NO: 25569 - protein, 6 aa, Neisseria
WVAAIG

SEQ ID NO: 25570 - protein, 10 aa, Neisseria
AEQLKNTGKV

SEQ ID NO: 25571 - protein, 8 aa, Neisseria
AAEHIGAS

SEQ ID NO: 25572 - protein, 7 aa, Neisseria
RKAMDKA

SEQ ID NO: 25573 - protein, 5 aa, Neisseria
VFKKY

SEQ ID NO: 25574 - protein, 6 aa, Neisseria
GCDKAG

SEQ ID NO: 25575 - protein, 22 aa, Neisseria
GADKKEASFVERIKHTKDDGSV

SEQ ID NO: 25576 - protein, 7 aa, Neisseria
VQSEGPA

SEQ ID NO: 25577 - protein, 25 aa, Neisseria
PAPRTQNGSSNAETDSDPLADSDPF

SEQ ID NO: 25578 - protein, 20 aa, Neisseria
KRLVPNMPEIPQEEADDGGL

SEQ ID NO: 25579 - protein, 7 aa, Neisseria
IISKDGY

SEQ ID NO: 25580 - protein, 8 aa, Neisseria
LNDKREYT

SEQ ID NO: 25581 - protein, 10 aa, Neisseria
IGSDVQSDVA

SEQ ID NO: 25582 - protein, 7 aa, Neisseria
DATEELP

SEQ ID NO: 25583 - protein, 11 aa, Neisseria
IGNPKDLKPGE

SEQ ID NO: 25584 - protein, 8 aa, Neisseria
FGFDNSVT

SEQ ID NO: 25585 - protein, 14 aa, Neisseria
  VARIANT 1: Xaa is any amino acid
XVSAKGRSLPNESY

SEQ ID NO: 25586 - protein, 8 aa, Neisseria
NPGNSGGP

SEQ ID NO: 25587 - protein, 6 aa, Neisseria
YSRSGG

SEQ ID NO: 25588 - protein, 14 aa, Neisseria
EQLKNTGKVQRGQL

SEQ ID NO: 25589 - protein, 8 aa, Neisseria
FGLDKAGG

SEQ ID NO: 25590 - protein, 15 aa, Neisseria
LPGSPAERAGLRAGD

SEQ ID NO: 25591 - protein, 12 aa, Neisseria
LDGGEIRSSGDL

SEQ ID NO: 25592 - protein, 7 aa, Neisseria
TPGKEVS

SEQ ID NO: 25593 - protein, 9 aa, Neisseria
WRKGEEITI

SEQ ID NO: 25594 - protein, 20 aa, Neisseria
IGASSKTDEAPYTEQQSGTF

SEQ ID NO: 25595 - protein, 8 aa, Neisseria
THTDSSGG

SEQ ID NO: 25596 - protein, 18 aa, Neisseria
RVSDAAERAGLRRGDEIL

SEQ ID NO: 25597 - protein, 19 aa, Neisseria
PVNDEAGFRKAMDKAGKNV

SEQ ID NO: 25598 - protein, 6 aa, Neisseria
MRRGNT

SEQ ID NO: 25599 - protein, 6 aa, Neisseria
GCDKAG

SEQ ID NO: 25600 - protein, 21 aa, Neisseria
GADKKEASFVERIKHTKDDGS

SEQ ID NO: 25601 - protein, 24 aa, Neisseria
PAPRTQNGSSNAETDSDPLADSDP

SEQ ID NO: 25602 - protein, 12 aa, Neisseria
PEIPQEEADDGG

SEQ ID NO: 25603 - protein, 5 aa, Neisseria
ISKDG

SEQ ID NO: 25604 - protein, 8 aa, Neisseria
LNDKREYT

SEQ ID NO: 25605 - protein, 7 aa, Neisseria
DATEELP

SEQ ID NO: 25606 - protein, 8 aa, Neisseria
GNPKDLKP

SEQ ID NO: 25607 - protein, 9 aa, Neisseria
VSAKGRSLP

SEQ ID NO: 25608 - protein, 13 aa, Neisseria
EQLKNTGKVQRGQ

SEQ ID NO: 25609 - protein, 6 aa, Neisseria
GLDKAG

SEQ ID NO: 25610 - protein, 12 aa, Neisseria
SPAERAGLRAGD

SEQ ID NO: 25611 - protein, 10 aa, Neisseria
DGGEIRSSGD

SEQ ID NO: 25612 - protein, 7 aa, Neisseria
TPGKEVS

SEQ ID NO: 25613 - protein, 8 aa, Neisseria
RKGEEITI

SEQ ID NO: 25614 - protein, 17 aa, Neisseria
IGASSKTDEAPYTEQQS

SEQ ID NO: 25615 - protein, 6 aa, Neisseria
HTDSSG

SEQ ID NO: 25616 - protein, 18 aa, Neisseria
RVSDAAERAGLRRGDEIL

SEQ ID NO: 25617 - protein, 17 aa, Neisseria
PVNDEAGFRKAMDKAGK

SEQ ID NO: 25618 - protein, 5 aa, Neisseria
CSSWL

SEQ ID NO: 25619 - protein, 15 aa, Neisseria
FNTSKPVRLDNILQI

SEQ ID NO: 25620 - protein, 5 aa, Neisseria
PHEAF

SEQ ID NO: 25621 - protein, 22 aa, Neisseria
NPFVLRKWRALGYLTDFPRLNR

SEQ ID NO: 25622 - protein, 7 aa, Neisseria
GDEYFKV

SEQ ID NO: 25623 - protein, 6 aa, Neisseria
LDILAT

SEQ ID NO: 25624 - protein, 13 aa, Neisseria
VGEVSHDFDRYWA

SEQ ID NO: 25625 - protein, 8 aa, Neisseria
ATRIIRSG

SEQ ID NO: 25626 - protein, 7 aa, Neisseria
IGKGLQA

SEQ ID NO: 25627 - protein, 10 aa, Neisseria
SDDPAKGLDR

SEQ ID NO: 25628 - protein, 10 aa, Neisseria
GRLQDALKQP

SEQ ID NO: 25629 - protein, 11 aa, Neisseria
GTDALAKLVQD

SEQ ID NO: 25630 - protein, 7 aa, Neisseria
QATDVAA

SEQ ID NO: 25631 - protein, 13 aa, Neisseria
KIAEQMERTLADT

SEQ ID NO: 25632 - protein, 22 aa, Neisseria
PEAKLWKRIAAKILSLLPIESL

SEQ ID NO: 25633 - protein, 5 aa, Neisseria
MKTRS

SEQ ID NO: 25634 - protein, 19 aa, Neisseria
PLEERTESRHFNTSKPVRL

SEQ ID NO: 25635 - protein, 9 aa, Neisseria
HTPHTNGLS

SEQ ID NO: 25636 - protein, 7 aa, Neisseria
ESAEHSL

SEQ ID NO: 25637 - protein, 9 aa, Neisseria
WRNDISGRL

SEQ ID NO: 25638 - protein, 6 aa, Neisseria
AERGVR

SEQ ID NO: 25639 - protein, 12 aa, Neisseria
LLLDDNNTRGLD

SEQ ID NO: 25640 - protein, 9 aa, Neisseria
SHPNIEVRL

SEQ ID NO: 25641 - protein, 20 aa, Neisseria
DFPRLNRRMHNKSFTADNRA

SEQ ID NO: 25642 - protein, 17 aa, Neisseria
GGRNIGDEYFKVGEDTV

SEQ ID NO: 25643 - protein, 9 aa, Neisseria
VSHDFDRYW

SEQ ID NO: 25644 - protein, 5 aa, Neisseria
HSAHN

SEQ ID NO: 25645 - protein, 12 aa, Neisseria
RIIRSGNIGKGL

SEQ ID NO: 25646 - protein, 8 aa, Neisseria
GYNDETSR

SEQ ID NO: 25647 - protein, 7 aa, Neisseria
RYRETVE

SEQ ID NO: 25648 - protein, 5 aa, Neisseria
SPLYQ

SEQ ID NO: 25649 - protein, 7 aa, Neisseria
IQTGRID

SEQ ID NO: 25650 - protein, 19 aa, Neisseria
LISDDPAKGLDRDRRKPPI

SEQ ID NO: 25651 - protein, 12 aa, Neisseria
RLQDALKQPEKS

SEQ ID NO: 25652 - protein, 10 aa, Neisseria
VPTKSGTDAL

SEQ ID NO: 25653 - protein, 7 aa, Neisseria
LVQDGID

SEQ ID NO: 25654 - protein, 8 aa, Neisseria
VKYRKPLL

SEQ ID NO: 25655 - protein, 11 aa, Neisseria
ATKDKGLTGSS

SEQ ID NO: 25656 - protein, 7 aa, Neisseria
VDGKRIF

SEQ ID NO: 25657 - protein, 12 aa, Neisseria
FNLDPRSARLNT

SEQ ID NO: 25658 - protein, 21 aa, Neisseria
ESPKIAEQMERTLADTSPEYA

SEQ ID NO: 25659 - protein, 30 aa, Neisseria; identical to SEQ ID NO: 13670

SEQ ID NO: 25660 - protein, 5 aa, Neisseria
MKTRS

SEQ ID NO: 25661 - protein, 12 aa, Neisseria
LEERTESRHFNT

SEQ ID NO: 25662 - protein, 5 aa, Neisseria
KPVRL

SEQ ID NO: 25663 - protein, 7 aa, Neisseria
ESAEHSL

SEQ ID NO: 25664 - protein, 6 aa, Neisseria
AERGVR

SEQ ID NO: 25665 - protein, 12 aa, Neisseria
LLLDDNNTRGLD

SEQ ID NO: 25666 - protein, 9 aa, Neisseria
PRLNRRMHN

SEQ ID NO: 25667 - protein, 7 aa, Neisseria
FTADNRA

SEQ ID NO: 25668 - protein, 10 aa, Neisseria
EYFKVGEDTV

SEQ ID NO: 25669 - protein, 7 aa, Neisseria
VSHDFDR

SEQ ID NO: 25670 - protein, 7 aa, Neisseria
YNDETSR

SEQ ID NO: 25671 - protein, 7 aa, Neisseria
RYRETVE

SEQ ID NO: 25672 - protein, 6 aa, Neisseria
QTGRID

SEQ ID NO: 25673 - protein, 19 aa, Neisseria
LISDDPAKGLDRDRRKPPI

SEQ ID NO: 25674 - protein, 12 aa, Neisseria
RLQDALKQPEKS

SEQ ID NO: 25675 - protein, 7 aa, Neisseria
KSGTDAL

SEQ ID NO: 25676 - protein, 7 aa, Neisseria
LVQDGID

SEQ ID NO: 25677 - protein, 8 aa, Neisseria
VKYRKPLL

SEQ ID NO: 25678 - protein, 8 aa, Neisseria
ATKDKGLT

SEQ ID NO: 25679 - protein, 10 aa, Neisseria
LDPRSARLNT

SEQ ID NO: 25680 - protein, 18 aa, Neisseria
ESPKIAEQMERTLADTSP

SEQ ID NO: 25681 - protein, 7 aa, Neisseria
TLDRHNR

SEQ ID NO: 25682 - protein, 17 aa, Neisseria
PATRKTYPNEPEAKLWK

SEQ ID NO: 25683 - protein, 6 aa, Neisseria
SKIEAL

SEQ ID NO: 25684 - protein, 6 aa, Neisseria
RRLKAM

SEQ ID NO: 25685 - protein, 5 aa, Neisseria
QMRGI

SEQ ID NO: 25686 - protein, 10 aa, Neisseria
DIVERAQSKV

SEQ ID NO: 25687 - protein, 12 aa, Neisseria
AKIIEVLGDYAD

SEQ ID NO: 25688 - protein, 20 aa, Neisseria
HQFSEACAKAAKKIPDHVRK

SEQ ID NO: 25689 - protein, 7 aa, Neisseria
TARDFDD

SEQ ID NO: 25690 - protein, 8 aa, Neisseria
EKIGRNYR

SEQ ID NO: 25691 - protein, 13 aa, Neisseria
AIADVSHYVRPDD

SEQ ID NO: 25692 - protein, 5 aa, Neisseria
NLSNG

SEQ ID NO: 25693 - protein, 8 aa, Neisseria
NQVWKWLS

SEQ ID NO: 25694 - protein, 5 aa, Neisseria
GIEHP

SEQ ID NO: 25695 - protein, 16 aa, Neisseria
KTQIDTLYKLFKILQK

SEQ ID NO: 25696 - protein, 11 aa, Neisseria
LGPTPEKLAAL

SEQ ID NO: 25697 - protein, 7 aa, Neisseria
KDYAALA

SEQ ID NO: 25698 - protein, 10 aa, Neisseria
VMMLRSMQQA

SEQ ID NO: 25699 - protein, 25 aa, Neisseria
AYAHFTSPIRRYPDLTVHRAIKAVL

SEQ ID NO: 25700 - protein, 12 aa, Neisseria
DDASRDVENWLK

SEQ ID NO: 25701 - protein, 13 aa, Neisseria
ISGMTSFGIFVTL

SEQ ID NO: 25702 - protein, 13 aa, Neisseria
HIDGLVHISDLGE

SEQ ID NO: 25703 - protein, 6 aa, Neisseria
MNKNIK

SEQ ID NO: 25704 - protein, 27 aa, Neisseria
LNLREKDPFLSREKQRYEHPLPSREWI

SEQ ID NO: 25705 - protein, 16 aa, Neisseria
LLERKGVPSKIEALVR

SEQ ID NO: 25706 - protein, 23 aa, Neisseria
LSIKEEEYEFFERRLKAMARDGQ

SEQ ID NO: 25707 - protein, 7 aa, Neisseria
INRRGAV

SEQ ID NO: 25708 - protein, 21 aa, Neisseria
AADKLDLVKCRVKAHKDRFGF

SEQ ID NO: 25709 - protein, 8 aa, Neisseria
LTPAKDGD

SEQ ID NO: 25710 - protein, 5 aa, Neisseria
RQMRG

SEQ ID NO: 25711 - protein, 13 aa, Neisseria
AGMDGRGRREGTV

SEQ ID NO: 25712 - protein, 11 aa, Neisseria
IVERAQSKVVG

SEQ ID NO: 25713 - protein, 8 aa, Neisseria
  VARIANT 2: Xaa is any amino acid
FXMDRGVA

SEQ ID NO: 25714 - protein, 10 aa, Neisseria
LEPEDKRLNQ

SEQ ID NO: 25715 - protein, 15 aa, Neisseria
LEPDGVARFKPESGQ

SEQ ID NO: 25716 - protein, 11 aa, Neisseria
EVYPEQNRPAV

SEQ ID NO: 25717 - protein, 11 aa, Neisseria
LGDYADSGMEI

SEQ ID NO: 25718 - protein, 8 aa, Neisseria
IAVRKHHL

SEQ ID NO: 25719 - protein, 26 aa, Neisseria
ACAKAAKKIPDHVRKSDLKGRVDLRD

SEQ ID NO: 25720 - protein, 12 aa, Neisseria
TIDGETARDFDD

SEQ ID NO: 25721 - protein, 8 aa, Neisseria
EKIGRNYR

SEQ ID NO: 25722 - protein, 20 aa, Neisseria
HYVRPDDAIDTDAQERSTSV

SEQ ID NO: 25723 - protein, 5 aa, Neisseria
FPRRV

SEQ ID NO: 25724 - protein, 8 aa, Neisseria
LPENLSNG

SEQ ID NO: 25725 - protein, 9 aa, Neisseria
AGNIKEYRF

SEQ ID NO: 25726 - protein, 13 aa, Neisseria
LSGGIEHPFKTQI

SEQ ID NO: 25727 - protein, 17 aa, Neisseria
LQKKRFERGAVEFDSIE

SEQ ID NO: 25728 - protein, 11 aa, Neisseria
MLFDDNGKIEK

SEQ ID NO: 25729 - protein, 10 aa, Neisseria
VRNDAHKLIE

SEQ ID NO: 25730 - protein, 7 aa, Neisseria
LKNKHTA

SEQ ID NO: 25731 - protein, 16 aa, Neisseria
HLGPTPEKLAALREQL

SEQ ID NO: 25732 - protein, 12 aa, Neisseria
GGGDNPSPKDYA

SEQ ID NO: 25733 - protein, 10 aa, Neisseria
QFKGRPDAEL

SEQ ID NO: 25734 - protein, 7 aa, Neisseria
EPHCDGH

SEQ ID NO: 25735 - protein, 11 aa, Neisseria
SPIRRYPDLTV

SEQ ID NO: 25736 - protein, 8 aa, Neisseria
TYTPKKSW

SEQ ID NO: 25737 - protein, 15 aa, Neisseria
FCERRADDASRDVEN

SEQ ID NO: 25738 - protein, 16 aa, Neisseria
YMRDKVGEVFEGKISG

SEQ ID NO: 25739 - protein, 12 aa, Neisseria
SDLGEDYFNFRP

SEQ ID NO: 25740 - protein, 33 aa, Neisseria; identical to SEQ ID NO: 13749

SEQ ID NO: 25741 - protein, 70 aa, Neisseria; identical to SEQ ID NO: 13750

SEQ ID NO: 25742 - protein, 6 aa, Neisseria
MNKNIK

SEQ ID NO: 25743 - protein, 19 aa, Neisseria
LNLREKDPFLSREKQRYEH

SEQ ID NO: 25744 - protein, 16 aa, Neisseria
LLERKGVPSKIEALVR

SEQ ID NO: 25745 - protein, 23 aa, Neisseria
LSIKEEEYEFFERRLKAMARDGQ

SEQ ID NO: 25746 - protein, 6 aa, Neisseria
INRRGA

SEQ ID NO: 25747 - protein, 19 aa, Neisseria
AADKLDLVKCRVKAHKDRF

SEQ ID NO: 25748 - protein, 6 aa, Neisseria
PAKDGD

SEQ ID NO: 25749 - protein, 13 aa, Neisseria
AGMDGRGRREGTV

SEQ ID NO: 25750 - protein, 11 aa, Neisseria
IVERAQSKVVG

SEQ ID NO: 25751 - protein, 8 aa, Neisseria
  VARIANT 2: Xaa is any amino acid
FXMDRGVA

SEQ ID NO: 25752 - protein, 9 aa, Neisseria
LEPEDKRLN

SEQ ID NO: 25753 - protein, 14 aa, Neisseria
LEPDGVARFKPESG

SEQ ID NO: 25754 - protein, 11 aa, Neisseria
EVYPEQNRPAV

SEQ ID NO: 25755 - protein, 8 aa, Neisseria
YADSGMEI

SEQ ID NO: 25756 - protein, 7 aa, Neisseria
IAVRKHH

SEQ ID NO: 25757 - protein, 26 aa, Neisseria
ACAKAAKKIPDHVRKSDLKGRVDLRD

SEQ ID NO: 25758 - protein, 11 aa, Neisseria
IDGETARDFDD

SEQ ID NO: 25759 - protein, 6 aa, Neisseria
KIGRNY

SEQ ID NO: 25760 - protein, 16 aa, Neisseria
VRPDDAIDTDAQERST

SEQ ID NO: 25761 - protein, 6 aa, Neisseria
NIKEYR

SEQ ID NO: 25762 - protein, 17 aa, Neisseria
LQKKRFERGAVEFDSIE

SEQ ID NO: 25763 - protein, 11 aa, Neisseria
MLFDDNGKIEK

SEQ ID NO: 25764 - protein, 10 aa, Neisseria
VRNDAHKLIE

SEQ ID NO: 25765 - protein, 13 aa, Neisseria
PTPEKLAALREQL

SEQ ID NO: 25766 - protein, 11 aa, Neisseria
GGDNPSPKDYA

SEQ ID NO: 25767 - protein, 9 aa, Neisseria
FKGRPDAEL

SEQ ID NO: 25768 - protein, 7 aa, Neisseria
PIRRYPD

SEQ ID NO: 25769 - protein, 7 aa, Neisseria
YTPKKSW

SEQ ID NO: 25770 - protein, 15 aa, Neisseria
FCERRADDASRDVEN

SEQ ID NO: 25771 - protein, 14 aa, Neisseria
YMRDKVGEVFEGKI

SEQ ID NO: 25772 - protein, 11 aa, Neisseria
IMAIEGERSGI

SEQ ID NO: 25773 - protein, 20 aa, Neisseria
NMGDRVAVRVARADLDDGKI

SEQ ID NO: 25774 - protein, 69 aa, Neisseria; identical to SEQ ID NO: 13783

SEQ ID NO: 25775 - protein, 6 aa, Neisseria
AGLTKL

SEQ ID NO: 25776 - protein, 5 aa, Neisseria
SATDF

SEQ ID NO: 25777 - protein, 6 aa, Neisseria
KSGKIT

SEQ ID NO: 25778 - protein, 6 aa, Neisseria
PHIYGA

SEQ ID NO: 25779 - protein, 17 aa, Neisseria
ELRKYADWGIMEKAKAL

SEQ ID NO: 25780 - protein, 9 aa, Neisseria
ETPPNPTKA

SEQ ID NO: 25781 - protein, 9 aa, Neisseria
SVHGMYKVS

SEQ ID NO: 25782 - protein, 6 aa, Neisseria
WTRHSR

SEQ ID NO: 25783 - protein, 8 aa, Neisseria
SYQISEPL

SEQ ID NO: 25784 - protein, 6 aa, Neisseria
FKNHAD

SEQ ID NO: 25785 - protein, 9 aa, Neisseria
AAAEAADAS

SEQ ID NO: 25786 - protein, 13 aa, Neisseria
PAGLTKLDSSQIS

SEQ ID NO: 25787 - protein, 10 aa, Neisseria
YEADSATDFT

SEQ ID NO: 25788 - protein, 13 aa, Neisseria
VQGSKSGKITKTT

SEQ ID NO: 25789 - protein, 7 aa, Neisseria
KVNDNLT

SEQ ID NO: 25790 - protein, 12 aa, Neisseria
GSATEYEKDSVL

SEQ ID NO: 25791 - protein, 6 aa, Neisseria
NINKLG

SEQ ID NO: 25792 - protein, 9 aa, Neisseria
KLNERHSFG

SEQ ID NO: 25793 - protein, 9 aa, Neisseria
TSAELRKYA

SEQ ID NO: 25794 - protein, 33 aa, Neisseria
EKAKALKETPPNPTKAAQIKADGHADVKGSDWG

SEQ ID NO: 25795 - protein, 28 aa, Neisseria
DINDRARVGVNYRSKVSHTLKGDAEWAA

SEQ ID NO: 25796 - protein, 5 aa, Neisseria
WDANK

SEQ ID NO: 25797 - protein, 15 aa, Neisseria
TPSEKARVKIVTPES

SEQ ID NO: 25798 - protein, 9 aa, Neisseria
YKVSDKADL

SEQ ID NO: 25799 - protein, 31 aa, Neisseria
TWTRHSRFDKAELVFEKEKTIVNGKSDRTTI

SEQ ID NO: 25800 - protein, 11 aa, Neisseria
PNWRNTYKVGF

SEQ ID NO: 25801 - protein, 9 aa, Neisseria
GSYQISELQ

SEQ ID NO: 25802 - protein, 22 aa, Neisseria
IAFDKSPVRNADYRMNSLPDGN

SEQ ID NO: 25803 - protein, 7 aa, Neisseria
HIGKNHV

SEQ ID NO: 25804 - protein, 29 aa, Neisseria
NDTSYRTAKASGNDVDSKGASSARFKNHA

SEQ ID NO: 25805 - protein, 7 aa, Neisseria
AAAEAAD

SEQ ID NO: 25806 - protein, 7 aa, Neisseria
TKLDSSQ

SEQ ID NO: 25807 - protein, 7 aa, Neisseria
YEADSAT

SEQ ID NO: 25808 - protein, 10 aa, Neisseria
QGSKSGKITK

SEQ ID NO: 25809 - protein, 9 aa, Neisseria
TEYEKDSVL

SEQ ID NO: 25810 - protein, 7 aa, Neisseria
KLNERHS

SEQ ID NO: 25811 - protein, 9 aa, Neisseria
TSAELRKYA

SEQ ID NO: 25812 - protein, 31 aa, Neisseria
EKAKALKETPPNPTKAAQIKADGHADVKGSD

SEQ ID NO: 25813 - protein, 7 aa, Neisseria
INDRARV

SEQ ID NO: 25814 - protein, 5 aa, Neisseria
YRSKV

SEQ ID NO: 25815 - protein, 9 aa, Neisseria
LKGDAEWAA

SEQ ID NO: 25816 - protein, 11 aa, Neisseria
PSEKARVKIVT

SEQ ID NO: 25817 - protein, 8 aa, Neisseria
KVSDKADL

SEQ ID NO: 25818 - protein, 17 aa, Neisseria
SRFDKAELVFEKEKTIV

SEQ ID NO: 25819 - protein, 8 aa, Neisseria
GKSDRTTI

SEQ ID NO: 25820 - protein, 15 aa, Neisseria
IAFDKSPVRNADYRM

SEQ ID NO: 25821 - protein, 6 aa, Neisseria
SLPDGN

SEQ ID NO: 25822 - protein, 27 aa, Neisseria
TSYRTAKASGNDVDSKGASSARFKNHA

SEQ ID NO: 25823 - protein, 22 aa, Neisseria
ITDTYGDNLKDAVKKQLQDLYK

SEQ ID NO: 25824 - protein, 7 aa, Neisseria
DLINKLV

SEQ ID NO: 25825 - protein, 7 aa, Neisseria
TSLNNIF

SEQ ID NO: 25826 - protein, 5 aa, Neisseria
DIHML

SEQ ID NO: 25827 - protein, 9 aa, Neisseria
PENLKTLDG

SEQ ID NO: 25828 - protein, 8 aa, Neisseria
YELLLKQC

SEQ ID NO: 25829 - protein, 14 aa, Neisseria
SYLHGYGGGVYAAW

SEQ ID NO: 25830 - protein, 9 aa, Neisseria
AYLDGWLQY

SEQ ID NO: 25831 - protein, 11 aa, Neisseria
TASVEGGYNAL

SEQ ID NO: 25832 - protein, 11 aa, Neisseria
QPFAAFNVLHR

SEQ ID NO: 25833 - protein, 26 aa, Neisseria
LGSNTRSTKIGDDADFSFSDKPKPGT

SEQ ID NO: 25834 - protein, 29 aa, Neisseria
FSSGKTDQNSSEYGYDEINIQGKNYNSGI

SEQ ID NO: 25835 - protein, 40 aa, Neisseria
YITDTYGDNLKDAVKKQLQDLYKTRPEAWEENKKRTEEAY

SEQ ID NO: 25836 - protein, 11 aa, Neisseria
SILKQKNPDLI

SEQ ID NO: 25837 - protein, 8 aa, Neisseria
HSNTSQTS

SEQ ID NO: 25838 - protein, 15 aa, Neisseria
FNKKLHVKIENKSHV

SEQ ID NO: 25839 - protein, 20 aa, Neisseria
TKMTLKDSLWEPRRHSDIHM

SEQ ID NO: 25840 - protein, 19 aa, Neisseria
ETSDNARIRLNTKDEKLTV

SEQ ID NO: 25841 - protein, 5 aa, Neisseria
YQGGA

SEQ ID NO: 25842 - protein, 60 aa, Neisseria
DVRESDKPALTFEEKVSGQSGVVLERRPENLKTLDGRKLIAAEKADSNSFAFKQNYRQGL

SEQ ID NO: 25843 - protein, 7 aa, Neisseria
KQCEGGF

SEQ ID NO: 25844 - protein, 6 aa, Neisseria
AIPEAE

SEQ ID NO: 25845 - protein, 19 aa, Neisseria
RAADRGDDVYAADPSRQKL

SEQ ID NO: 25846 - protein, 22 aa, Neisseria
IGGRSHQNIRGGAAADGRRKGV

SEQ ID NO: 25847 - protein, 12 aa, Neisseria
VFVRQNEGSRLA

SEQ ID NO: 25848 - protein, 7 aa, Neisseria
MGGRAGQ

SEQ ID NO: 25849 - protein, 9 aa, Neisseria
ASVNGKGGA

SEQ ID NO: 25850 - protein, 9 aa, Neisseria
LRDKQTGAY

SEQ ID NO: 25851 - protein, 21 aa, Neisseria
RFKHRINDENRAERYKTKGWT

SEQ ID NO: 25852 - protein, 5 aa, Neisseria
VEGGY

SEQ ID NO: 25853 - protein, 9 aa, Neisseria
VVGKGNNVR

SEQ ID NO: 25854 - protein, 11 aa, Neisseria
NGGFTDSEGTA

SEQ ID NO: 25855 - protein, 24 aa, Neisseria
GSGQWQSRAGIRAKTRFALRNGVN

SEQ ID NO: 25856 - protein, 18 aa, Neisseria
HRSKSFGVEMDGEKQTLA

SEQ ID NO: 25857 - protein, 9 aa, Neisseria
TALEGRFGI

SEQ ID NO: 25858 - protein, 7 aa, Neisseria
AGWKGHM

SEQ ID NO: 25859 - protein, 14 aa, Neisseria
GYGKRTDGDKEAAL

SEQ ID NO: 25860 - protein, 24 aa, Neisseria
SNTRSTKIGDDADFSFSDKPKPGT

SEQ ID NO: 25861 - protein, 8 aa, Neisseria
GKTDQNSS

SEQ ID NO: 25862 - protein, 16 aa, Neisseria
TYGDNLKDAVKKQLQD

SEQ ID NO: 25863 - protein, 19 aa, Neisseria
YKTRPEAWEENKKRTEEAY

SEQ ID NO: 25864 - protein, 11 aa, Neisseria
SILKQKNPDLI

SEQ ID NO: 25865 - protein, 11 aa, Neisseria
LHVKIENKSHV

SEQ ID NO: 25866 - protein, 6 aa, Neisseria
TKMTLK

SEQ ID NO: 25867 - protein, 10 aa, Neisseria
SLWEPRRHSD

SEQ ID NO: 25868 - protein, 19 aa, Neisseria
ETSDNARIRLNTKDEKLTV

SEQ ID NO: 25869 - protein, 18 aa, Neisseria
DVRESDKPALTFEEKVSG

SEQ ID NO: 25870 - protein, 26 aa, Neisseria
VLERRPENLKTLDGRKLIAAEKADSN

SEQ ID NO: 25871 - protein, 6 aa, Neisseria
AIPEAE

SEQ ID NO: 25872 - protein, 11 aa, Neisseria
RAADRGDDVYA

SEQ ID NO: 25873 - protein, 5 aa, Neisseria
DPSRQ

SEQ ID NO: 25874 - protein, 8 aa, Neisseria
RSHQNIRG

SEQ ID NO: 25875 - protein, 10 aa, Neisseria
AAADGRRKGV

SEQ ID NO: 25876 - protein, 10 aa, Neisseria
VFVRQNEGSR

SEQ ID NO: 25877 - protein, 7 aa, Neisseria
VNGKGGA

SEQ ID NO: 25878 - protein, 6 aa, Neisseria
LRDKQT

SEQ ID NO: 25879 - protein, 17 aa, Neisseria
RFKHRINDENRAERYKT

SEQ ID NO: 25880 - protein, 7 aa, Neisseria
VVGKGNN

SEQ ID NO: 25881 - protein, 7 aa, Neisseria
FTDSEGT

SEQ ID NO: 25882 - protein, 11 aa, Neisseria
AGIRAKTRFAL

SEQ ID NO: 25883 - protein, 18 aa, Neisseria
HRSKSFGVEMDGEKQTLA

SEQ ID NO: 25884 - protein, 5 aa, Neisseria
TALEG

SEQ ID NO: 25885 - protein, 14 aa, Neisseria
GYGKRTDGDKEAAL

SEQ ID NO: 25886 - protein, 22 aa, Neisseria
ITDTYGDNLKDAVKKQLQDLYK

SEQ ID NO: 25887 - protein, 7 aa, Neisseria
DLINKLV

SEQ ID NO: 25888 - protein, 7 aa, Neisseria
TSLNNIF

SEQ ID NO: 25889 - protein, 5 aa, Neisseria
DIHML

SEQ ID NO: 25890 - protein, 9 aa, Neisseria
PENLKTLDG

SEQ ID NO: 25891 - protein, 8 aa, Neisseria
YELLLKQC

SEQ ID NO: 25892 - protein, 14 aa, Neisseria
SYLHGYGGGVYAAW

SEQ ID NO: 25893 - protein, 9 aa, Neisseria
AYLDGWLQY

SEQ ID NO: 25894 - protein, 11 aa, Neisseria
TASVEGGYNAL

SEQ ID NO: 25895 - protein, 11 aa, Neisseria
QPFAAFNVLHR

SEQ ID NO: 25896 - protein, 26 aa, Neisseria
LGSNTRSTKIGDDADFSFSDKPKPGT

SEQ ID NO: 25897 - protein, 29 aa, Neisseria
FSSGKTDQNSSEYGYDEINIQGKNYNSGI

SEQ ID NO: 25898 - protein, 40 aa, Neisseria; identical to SEQ ID NO: 25835

SEQ ID NO: 25899 - protein, 11 aa, Neisseria
SILKQKNPDLI

SEQ ID NO: 25900 - protein, 8 aa, Neisseria
HSNTSQTS

SEQ ID NO: 25901 - protein, 15 aa, Neisseria
FNKKLHVKIENKSHV

SEQ ID NO: 25902 - protein, 20 aa, Neisseria
TKMTLKDSLWEPRRHSDIHM

SEQ ID NO: 25903 - protein, 19 aa, Neisseria
ETSDNARIRLNTKDEKLTV

SEQ ID NO: 25904 - protein, 5 aa, Neisseria
YQGGA

SEQ ID NO: 25905 - protein, 60 aa, Neisseria; identical to SEQ ID NO: 25842

SEQ ID NO: 25906 - protein, 7 aa, Neisseria
KQCEGGF

SEQ ID NO: 25907 - protein, 6 aa, Neisseria
AIPEAE

SEQ ID NO: 25908 - protein, 19 aa, Neisseria
RAADRGDDVYAADPSRQKL

SEQ ID NO: 25909 - protein, 22 aa, Neisseria
IGGRSHQNIRGGAAADGRRKGV

SEQ ID NO: 25910 - protein, 12 aa, Neisseria
VFVRQNEGSRLA

SEQ ID NO: 25911 - protein, 7 aa, Neisseria
MGGRAGQ

SEQ ID NO: 25912 - protein, 9 aa, Neisseria
ASVNGKGGA

SEQ ID NO: 25913 - protein, 9 aa, Neisseria
LRDKQTGAY

SEQ ID NO: 25914 - protein, 21 aa, Neisseria
RFKHRINDENRAERYKTKGWT

SEQ ID NO: 25915 - protein, 5 aa, Neisseria
VEGGY

SEQ ID NO: 25916 - protein, 9 aa, Neisseria
VVGKGNNVR

SEQ ID NO: 25917 - protein, 11 aa, Neisseria
NGGFTDSEGTA

SEQ ID NO: 25918 - protein, 24 aa, Neisseria
GSGQWQSRAGIRAKTRFALRNGVN

SEQ ID NO: 25919 - protein, 18 aa, Neisseria
HRSKSFGVEMDGEKQTLA

SEQ ID NO: 25920 - protein, 9 aa, Neisseria
TALEGRFGI

SEQ ID NO: 25921 - protein, 7 aa, Neisseria
AGWKGHM

SEQ ID NO: 25922 - protein, 14 aa, Neisseria
GYGKRTDGDKEAAL

SEQ ID NO: 25923 - protein, 24 aa, Neisseria
SNTRSTKIGDDADFSFSDKPKPGT

SEQ ID NO: 25924 - protein, 8 aa, Neisseria
GKTDQNSS

SEQ ID NO: 25925 - protein, 16 aa, Neisseria
TYGDNLKDAVKKQLQD

SEQ ID NO: 25926 - protein, 19 aa, Neisseria
YKTRPEAWEENKKRTEEAY

SEQ ID NO: 25927 - protein, 11 aa, Neisseria
SILKQKNPDLI

SEQ ID NO: 25928 - protein, 11 aa, Neisseria
LHVKIENKSHV

SEQ ID NO: 25929 - protein, 6 aa, Neisseria
TKMTLK

SEQ ID NO: 25930 - protein, 10 aa, Neisseria
SLWEPRRHSD

SEQ ID NO: 25931 - protein, 19 aa, Neisseria
ETSDNARIRLNTKDEKLTV

SEQ ID NO: 25932 - protein, 18 aa, Neisseria
DVRESDKPALTFEEKVSG

SEQ ID NO: 25933 - protein, 26 aa, Neisseria
VLERRPENLKTLDGRKLIAAEKADSN

SEQ ID NO: 25934 - protein, 6 aa, Neisseria
AIPEAE

SEQ ID NO: 25935 - protein, 11 aa, Neisseria
RAADRGDDVYA

SEQ ID NO: 25936 - protein, 5 aa, Neisseria
DPSRQ

SEQ ID NO: 25937 - protein, 8 aa, Neisseria
RSHQNIRG

SEQ ID NO: 25938 - protein, 10 aa, Neisseria
AAADGRRKGV

SEQ ID NO: 25939 - protein, 10 aa, Neisseria
VFVRQNEGSR

SEQ ID NO: 25940 - protein, 7 aa, Neisseria
VNGKGGA

SEQ ID NO: 25941 - protein, 6 aa, Neisseria
LRDKQT

SEQ ID NO: 25942 - protein, 17 aa, Neisseria
RFKHRINDENRAERYKT

SEQ ID NO: 25943 - protein, 7 aa, Neisseria
VVGKGNN

SEQ ID NO: 25944 - protein, 7 aa, Neisseria
FTDSEGT

SEQ ID NO: 25945 - protein, 11 aa, Neisseria
AGIRAKTRFAL

SEQ ID NO: 25946 - protein, 18 aa, Neisseria
HRSKSFGVEMDGEKQTLA

SEQ ID NO: 25947 - protein, 5 aa, Neisseria
TALEG

SEQ ID NO: 25948 - protein, 14 aa, Neisseria
GYGKRTDGDKEAAL

SEQ ID NO: 25949 - protein, 14 aa, Neisseria
RHLKNMQIKKIMKW

SEQ ID NO: 25950 - protein, 9 aa, Neisseria
LSLLGALGY

SEQ ID NO: 25951 - protein, 9 aa, Neisseria
AVLDVLGAA

SEQ ID NO: 25952 - protein, 11 aa, Neisseria
HRYTGTVSKVY

SEQ ID NO: 25953 - protein, 5 aa, Neisseria
QVQDG

SEQ ID NO: 25954 - protein, 5 aa, Neisseria
DFADY

SEQ ID NO: 25955 - protein, 9 aa, Neisseria
MFRRHRHLK

SEQ ID NO: 25956 - protein, 8 aa, Neisseria
GYGSEAVR

SEQ ID NO: 25957 - protein, 24 aa, Neisseria
AAGDAGSDAPARRRASAKSGHRYT

SEQ ID NO: 25958 - protein, 8 aa, Neisseria
SKVYDGDT

SEQ ID NO: 25959 - protein, 10 aa, Neisseria
IDGDGAKHKI

SEQ ID NO: 25960 - protein, 27 aa, Neisseria
DAPEMKQAYGTRSRDNLRAAAEGRKVS

SEQ ID NO: 25961 - protein, 12 aa, Neisseria
VFDTDRYQREVA

SEQ ID NO: 25962 - protein, 8 aa, Neisseria
SVGKTDLN

SEQ ID NO: 25963 - protein, 13 aa, Neisseria
KSYAKEQQDKADF

SEQ ID NO: 25964 - protein, 20 aa, Neisseria
QIQAERERKGLWKAKNPQAP

SEQ ID NO: 25965 - protein, 17 aa, Neisseria
AYRRAGRSGGGNKDWMD

SEQ ID NO: 25966 - protein, 9 aa, Neisseria
MFRRHRHLK

SEQ ID NO: 25967 - protein, 20 aa, Neisseria
GDAGSDAPARRRASAKSGHR

SEQ ID NO: 25968 - protein, 10 aa, Neisseria
IDGDGAKHKI

SEQ ID NO: 25969 - protein, 7 aa, Neisseria
DAPEMKQ

SEQ ID NO: 25970 - protein, 19 aa, Neisseria
YGTRSRDNLRAAAEGRKVS

SEQ ID NO: 25971 - protein, 12 aa, Neisseria
VFDTDRYQREVA

SEQ ID NO: 25972 - protein, 7 aa, Neisseria
SVGKTDL

SEQ ID NO: 25973 - protein, 12 aa, Neisseria
SYAKEQQDKADF

SEQ ID NO: 25974 - protein, 17 aa, Neisseria
QIQAERERKGLWKAKNP

SEQ ID NO: 25975 - protein, 13 aa, Neisseria
RAGRSGGGNKDWM

SEQ ID NO: 25976 - protein, 11 aa, Neisseria
SSFQGPLDLLL

SEQ ID NO: 25977 - protein, 11 aa, Neisseria
TEQYLHYIAQI

SEQ ID NO: 25978 - protein, 8 aa, Neisseria
GLDALPRA

SEQ ID NO: 25979 - protein, 10 aa, Neisseria
ITDLTQAWLS

SEQ ID NO: 25980 - protein, 8 aa, Neisseria
HTRSHEVI

SEQ ID NO: 25981 - protein, 23 aa, Neisseria
MTAILRRLNKHGICRFHDLFNPE

SEQ ID NO: 25982 - protein, 7 aa, Neisseria
VNFIALL

SEQ ID NO: 25983 - protein, 6 aa, Neisseria
SFQGPL

SEQ ID NO: 25984 - protein, 6 aa, Neisseria
RKQNID

SEQ ID NO: 25985 - protein, 22 aa, Neisseria
LLLPRTETVEDEEADPRAELVR

SEQ ID NO: 25986 - protein, 9 aa, Neisseria
ALPRAGRDF

SEQ ID NO: 25987 - protein, 17 aa, Neisseria
SRAKHTRSHEVIKETIS

SEQ ID NO: 25988 - protein, 8 aa, Neisseria
RRLNKHGI

SEQ ID NO: 25989 - protein, 6 aa, Neisseria
FNPEQG

SEQ ID NO: 25990 - protein, 6 aa, Neisseria
LAKEGL

SEQ ID NO: 25991 - protein, 21 aa, Neisseria
LNHEGAHSDGISGTRGGRDVF

SEQ ID NO: 25992 - protein, 6 aa, Neisseria
RKQNID

SEQ ID NO: 25993 - protein, 22 aa, Neisseria
LLLPRTETVEDEEADPRAELVR

SEQ ID NO: 25994 - protein, 7 aa, Neisseria
ALPRAGR

SEQ ID NO: 25995 - protein, 17 aa, Neisseria
SRAKHTRSHEVIKETIS

SEQ ID NO: 25996 - protein, 5 aa, Neisseria
RRLNK

SEQ ID NO: 25997 - protein, 6 aa, Neisseria
LAKEGL

SEQ ID NO: 25998 - protein, 17 aa, Neisseria
GAHSDGISGTRGGRDVF

SEQ ID NO: 25999 - protein, 10 aa, Neisseria
KSARTHAKIP

SEQ ID NO: 26000 - protein, 16 aa, Neisseria
PGESYPAQLQKLTGWN

SEQ ID NO: 26001 - protein, 11 aa, Neisseria
TSAQALSRLPA

SEQ ID NO: 26002 - protein, 7 aa, Neisseria
LRKVPKE

SEQ ID NO: 26003 - protein, 11 aa, Neisseria
NIAKIIETVQK

SEQ ID NO: 26004 - protein, 10 aa, Neisseria
LGALFGHLSD

SEQ ID NO: 26005 - protein, 5 aa, Neisseria
GAWAE

SEQ ID NO: 26006 - protein, 21 aa, Neisseria
NGKGYRKFAEDLNQFLRKQGF

SEQ ID NO: 26007 - protein, 6 aa, Neisseria
MNRRTF

SEQ ID NO: 26008 - protein, 17 aa, Neisseria
CGRKSARTHAKIPEGST

SEQ ID NO: 26009 - protein, 10 aa, Neisseria
YGANPGESYP

SEQ ID NO: 26010 - protein, 9 aa, Neisseria
GGVSGDTSA

SEQ ID NO: 26011 - protein, 6 aa, Neisseria
LARKPK

SEQ ID NO: 26012 - protein, 18 aa, Neisseria
GGNDFLRKVPKEQTRANI

SEQ ID NO: 26013 - protein, 9 aa, Neisseria
ETVQKENIP

SEQ ID NO: 26014 - protein, 14 aa, Neisseria
SDHPLYEDLSEEYG

SEQ ID NO: 26015 - protein, 35 aa, Neisseria; identical to SEQ ID NO: 13963

SEQ ID NO: 26016 - protein, 14 aa, Neisseria
CGRKSARTHAKIPE

SEQ ID NO: 26017 - protein, 6 aa, Neisseria
NPGESY

SEQ ID NO: 26018 - protein, 7 aa, Neisseria
VSGDTSA

SEQ ID NO: 26019 - protein, 6 aa, Neisseria
LARKPK

SEQ ID NO: 26020 - protein, 15 aa, Neisseria
DFLRKVPKEQTRANI

SEQ ID NO: 26021 - protein, 8 aa, Neisseria
ETVQKENI

SEQ ID NO: 26022 - protein, 8 aa, Neisseria
EDLSEEYG

SEQ ID NO: 26023 - protein, 11 aa, Neisseria
NNLKSDQIHAN

SEQ ID NO: 26024 - protein, 15 aa, Neisseria
KGYRKFAEDLNQFLR

SEQ ID NO: 26025 - protein, 8 aa, Neisseria
WAGLSAAV

SEQ ID NO: 26026 - protein, 14 aa, Neisseria
YRGVLRLMKTIGSD

SEQ ID NO: 26027 - protein, 8 aa, Neisseria
PLPAPLHI

SEQ ID NO: 26028 - protein, 24 aa, Neisseria
RVPSAFKAKLLADMSDLQKSARLG

SEQ ID NO: 26029 - protein, 13 aa, Neisseria
AAVMQFWQPLVWG

SEQ ID NO: 26030 - protein, 8 aa, Neisseria
VLCNVLSD

SEQ ID NO: 26031 - protein, 7 aa, Neisseria
ALAELQR

SEQ ID NO: 26032 - protein, 6 aa, Neisseria
RLNTLP

SEQ ID NO: 26033 - protein, 10 aa, Neisseria
EGTPEHVQTA

SEQ ID NO: 26034 - protein, 17 aa, Neisseria
YAEPVRLPAPLTGLADG

SEQ ID NO: 26035 - protein, 14 aa, Neisseria
DKVHADLKRILPHL

SEQ ID NO: 26036 - protein, 5 aa, Neisseria
EPEAV

SEQ ID NO: 26037 - protein, 9 aa, Neisseria
NTPHPRPKI

SEQ ID NO: 26038 - protein, 12 aa, Neisseria
EAGRQAGGRARA

SEQ ID NO: 26039 - protein, 8 aa, Neisseria
AGNTDGFG

SEQ ID NO: 26040 - protein, 9 aa, Neisseria
KTIGSDPHA

SEQ ID NO: 26041 - protein, 8 aa, Neisseria
RRVPSAFK

SEQ ID NO: 26042 - protein, 20 aa, Neisseria
LLADMSDLQKSARLGQPDTT

SEQ ID NO: 26043 - protein, 8 aa, Neisseria
LKQRNVPR

SEQ ID NO: 26044 - protein, 7 aa, Neisseria
TPLETAS

SEQ ID NO: 26045 - protein, 18 aa, Neisseria
GVLTKKSGSDYLLPKQDL

SEQ ID NO: 26046 - protein, 17 aa, Neisseria
ELQRLGADIRLETRICR

SEQ ID NO: 26047 - protein, 8 aa, Neisseria
NTLPDGKV

SEQ ID NO: 26048 - protein, 9 aa, Neisseria
LPEGTPEHV

SEQ ID NO: 26049 - protein, 6 aa, Neisseria
GLADGT

SEQ ID NO: 26050 - protein, 12 aa, Neisseria
CRGRLGLPENEV

SEQ ID NO: 26051 - protein, 7 aa, Neisseria
VSDRVGA

SEQ ID NO: 26052 - protein, 9 aa, Neisseria
VHADLKRIL

SEQ ID NO: 26053 - protein, 26 aa, Neisseria
LGEPEAVRVITEKRATTAADAPPPDL

SEQ ID NO: 26054 - protein, 12 aa, Neisseria
PAGDYLHPDYPA

SEQ ID NO: 26055 - protein, 7 aa, Neisseria
PHPRPKI

SEQ ID NO: 26056 - protein, 12 aa, Neisseria
EAGRQAGGRARA

SEQ ID NO: 26057 - protein, 5 aa, Neisseria
IGSDP

SEQ ID NO: 26058 - protein, 5 aa, Neisseria
RRVPS

SEQ ID NO: 26059 - protein, 20 aa, Neisseria
LLADMSDLQKSARLGQPDTT

SEQ ID NO: 26060 - protein, 8 aa, Neisseria
VLTKKSGS

SEQ ID NO: 26061 - protein, 7 aa, Neisseria
LLPKQDL

SEQ ID NO: 26062 - protein, 17 aa, Neisseria
ELQRLGADIRLETRICR

SEQ ID NO: 26063 - protein, 5 aa, Neisseria
PDGKV

SEQ ID NO: 26064 - protein, 6 aa, Neisseria
GTPEHV

SEQ ID NO: 26065 - protein, 10 aa, Neisseria
GRLGLPENEV

SEQ ID NO: 26066 - protein, 6 aa, Neisseria
VSDRVG

SEQ ID NO: 26067 - protein, 9 aa, Neisseria
VHADLKRIL

SEQ ID NO: 26068 - protein, 23 aa, Neisseria
GEPEAVRVITEKRATTAADAPPP

SEQ ID NO: 26069 - protein, 6 aa, Neisseria
AARRVS

SEQ ID NO: 26070 - protein, 5 aa, Neisseria
SGRAC

SEQ ID NO: 26071 - protein, 11 aa, Neisseria
ARFFGSVCNSA

SEQ ID NO: 26072 - protein, 20 aa, Neisseria
PQGKAARRVSANEVSGRACA

SEQ ID NO: 26073 - protein, 13 aa, Neisseria
TLPKRDTLNGSGT

SEQ ID NO: 26074 - protein, 9 aa, Neisseria
PRSLRSKST

SEQ ID NO: 26075 - protein, 5 aa, Neisseria
RFFGS

SEQ ID NO: 26076 - protein, 16 aa, Neisseria
CNSAARRSSCPSPKIG

SEQ ID NO: 26077 - protein, 17 aa, Neisseria
VPSEAMLRKSSGEKHSV

SEQ ID NO: 26078 - protein, 13 aa, Neisseria
DCPASSGRWDNTA

SEQ ID NO: 26079 - protein, 14 aa, Neisseria
GKAARRVSANEVSG

SEQ ID NO: 26080 - protein, 8 aa, Neisseria
LPKRDTLN

SEQ ID NO: 26081 - protein, 7 aa, Neisseria
RSLRSKS

SEQ ID NO: 26082 - protein, 11 aa, Neisseria
AARRSSCPSPK

SEQ ID NO: 26083 - protein, 13 aa, Neisseria
AMLRKSSGEKHSV

SEQ ID NO: 26084 - protein, 5 aa, Neisseria
GRWDN

SEQ ID NO: 26085 - protein, 5 aa, Neisseria
NQVVL

SEQ ID NO: 26086 - protein, 7 aa, Neisseria
VVEVFQR

SEQ ID NO: 26087 - protein, 17 aa, Neisseria
VQAEFVGIVGHFDGLGM

SEQ ID NO: 26088 - protein, 8 aa, Neisseria
HFFVRVFR

SEQ ID NO: 26089 - protein, 9 aa, Neisseria
FEGGGDDGF

SEQ ID NO: 26090 - protein, 9 aa, Neisseria
GRINDAEII

SEQ ID NO: 26091 - protein, 10 aa, Neisseria
PKAAAGEVNG

SEQ ID NO: 26092 - protein, 5 aa, Neisseria
RVHDC

SEQ ID NO: 26093 - protein, 7 aa, Neisseria
GGGDDGF

SEQ ID NO: 26094 - protein, 9 aa, Neisseria
GRINDAEII

SEQ ID NO: 26095 - protein, 9 aa, Neisseria
KAAAGEVNG

SEQ ID NO: 26096 - protein, 5 aa, Neisseria
RVHDC

SEQ ID NO: 26097 - protein, 7 aa, Neisseria
IQSMWKE

SEQ ID NO: 26098 - protein, 11 aa, Neisseria
LELLTVFGAIA

SEQ ID NO: 26099 - protein, 8 aa, Neisseria
LTDFSENY

SEQ ID NO: 26100 - protein, 11 aa, Neisseria
RLKEGGEKSAE

SEQ ID NO: 26101 - protein, 6 aa, Neisseria
QLRRLR

SEQ ID NO: 26102 - protein, 24 aa, Neisseria
APFAVIGSVGVVAEVPNIHRLLKK

SEQ ID NO: 26103 - protein, 5 aa, Neisseria
FKRTV

SEQ ID NO: 26104 - protein, 7 aa, Neisseria
THQLFKQ

SEQ ID NO: 26105 - protein, 9 aa, Neisseria
LNLIDEIST

SEQ ID NO: 26106 - protein, 6 aa, Neisseria
LLLKAF

SEQ ID NO: 26107 - protein, 5 aa, Neisseria
MGMDN

SEQ ID NO: 26108 - protein, 11 aa, Neisseria
MPEQEEIQSMW

SEQ ID NO: 26109 - protein, 10 aa, Neisseria
QSKKQSESGS

SEQ ID NO: 26110 - protein, 13 aa, Neisseria
DFSENYKKQRQSF

SEQ ID NO: 26111 - protein, 41 aa, Neisseria
SEEETKHQEKKEKKKEKAEAKAEKKRLKEGGEKSAETQKSR

SEQ ID NO: 26112 - protein, 7 aa, Neisseria
ESLRHEI

SEQ ID NO: 26113 - protein, 9 aa, Neisseria
AKPEDEVLL

SEQ ID NO: 26114 - protein, 7 aa, Neisseria
LESPGGV

SEQ ID NO: 26115 - protein, 10 aa, Neisseria
QLRRLRERNI

SEQ ID NO: 26116 - protein, 7 aa, Neisseria
AVDKVAA

SEQ ID NO: 26117 - protein, 10 aa, Neisseria
RLLKKHDIDV

SEQ ID NO: 26118 - protein, 6 aa, Neisseria
GEFKRT

SEQ ID NO: 26119 - protein, 19 aa, Neisseria
ENTEKGKQKFRQELEETHQ

SEQ ID NO: 26120 - protein, 16 aa, Neisseria
FVSENRPGLDIEKIAT

SEQ ID NO: 26121 - protein, 10 aa, Neisseria
DEISTSDDLL

SEQ ID NO: 26122 - protein, 7 aa, Neisseria
FENKQVI

SEQ ID NO: 26123 - protein, 9 aa, Neisseria
KYQEKRSLI

SEQ ID NO: 26124 - protein, 7 aa, Neisseria
ASVEKLF

SEQ ID NO: 26125 - protein, 7 aa, Neisseria
VNRRADV

SEQ ID NO: 26126 - protein, 11 aa, Neisseria
MPEQEEIQSMW

SEQ ID NO: 26127 - protein, 9 aa, Neisseria
QSKKQSESG

SEQ ID NO: 26128 - protein, 13 aa, Neisseria
DFSENYKKQRQSF

SEQ ID NO: 26129 - protein, 41 aa, Neisseria; identical to SEQ ID NO: 26111

SEQ ID NO: 26130 - protein, 7 aa, Neisseria
ESLRHEI

SEQ ID NO: 26131 - protein, 9 aa, Neisseria
AKPEDEVLL

SEQ ID NO: 26132 - protein, 5 aa, Neisseria
LESPG

SEQ ID NO: 26133 - protein, 10 aa, Neisseria
QLRRLRERNI

SEQ ID NO: 26134 - protein, 7 aa, Neisseria
AVDKVAA

SEQ ID NO: 26135 - protein, 10 aa, Neisseria
RLLKKHDIDV

SEQ ID NO: 26136 - protein, 5 aa, Neisseria
GEFKR

SEQ ID NO: 26137 - protein, 19 aa, Neisseria
ENTEKGKQKFRQELEETHQ

SEQ ID NO: 26138 - protein, 16 aa, Neisseria
FVSENRPGLDIEKIAT

SEQ ID NO: 26139 - protein, 10 aa, Neisseria
DEISTSDDLL

SEQ ID NO: 26140 - protein, 7 aa, Neisseria
FENKQVI

SEQ ID NO: 26141 - protein, 9 aa, Neisseria
KYQEKRSLI

SEQ ID NO: 26142 - protein, 7 aa, Neisseria
ASVEKLF

SEQ ID NO: 26143 - protein, 7 aa, Neisseria
VNRRADV

SEQ ID NO: 26144 - protein, 10 aa, Neisseria
KHIAKTHRKR

SEQ ID NO: 26145 - protein, 11 aa, Neisseria
TFSPVGLENLL

SEQ ID NO: 26146 - protein, 13 aa, Neisseria
RVWQALLYALVVF

SEQ ID NO: 26147 - protein, 15 aa, Neisseria
RRIADTRTFTRIYTE

SEQ ID NO: 26148 - protein, 7 aa, Neisseria
EFVSFFE

SEQ ID NO: 26149 - protein, 14 aa, Neisseria
TSVVSIFGACIMLL

SEQ ID NO: 26150 - protein, 8 aa, Neisseria
HYGLVSRL

SEQ ID NO: 26151 - protein, 10 aa, Neisseria
GYGSAGHIYS

SEQ ID NO: 26152 - protein, 17 aa, Neisseria
LDDVPRLVEQYSNLKDI

SEQ ID NO: 26153 - protein, 11 aa, Neisseria
KHIAKTHRKRL

SEQ ID NO: 26154 - protein, 12 aa, Neisseria
AARRIADTRTFT

SEQ ID NO: 26155 - protein, 11 aa, Neisseria
LEQRQRQVPHS

SEQ ID NO: 26156 - protein, 21 aa, Neisseria
LNNSLERDNHFIRKGDERQLY

SEQ ID NO: 26157 - protein, 7 aa, Neisseria
ISNREAF

SEQ ID NO: 26158 - protein, 33 aa, Neisseria
SLDDVPRLVEQYSNLKDIGQRIEWSERNIKAGT

SEQ ID NO: 26159 - protein, 11 aa, Neisseria
KHIAKTHRKRL

SEQ ID NO: 26160 - protein, 11 aa, Neisseria
AARRIADTRTF

SEQ ID NO: 26161 - protein, 9 aa, Neisseria
LEQRQRQVP

SEQ ID NO: 26162 - protein, 18 aa, Neisseria
NSLERDNHFIRKGDERQL

SEQ ID NO: 26163 - protein, 6 aa, Neisseria
ISNREA

SEQ ID NO: 26164 - protein, 10 aa, Neisseria
SLDDVPRLVE

SEQ ID NO: 26165 - protein, 8 aa, Neisseria
SNLKDIGQ

SEQ ID NO: 26166 - protein, 12 aa, Neisseria
IEWSERNIKAGT

SEQ ID NO: 26167 - protein, 8 aa, Neisseria
HSMVKGIN

SEQ ID NO: 26168 - protein, 14 aa, Neisseria
VATYIMNAFDNGGG

SEQ ID NO: 26169 - protein, 8 aa, Neisseria
MNTTRLPT

SEQ ID NO: 26170 - protein, 19 aa, Neisseria
SAADNSIMTKGQKVYESNC

SEQ ID NO: 26171 - protein, 14 aa, Neisseria
CHGKKGEGRGTAFP

SEQ ID NO: 26172 - protein, 11 aa, Neisseria
LFRSDYIMNKP

SEQ ID NO: 26173 - protein, 10 aa, Neisseria
IKVNGKTYNG

SEQ ID NO: 26174 - protein, 5 aa, Neisseria
SDADI

SEQ ID NO: 26175 - protein, 22 aa, Neisseria
AFDNGGGSVTEKDVKQAKGKKN

SEQ ID NO: 26176 - protein, 10 aa, Neisseria
IMTKGQKVYE

SEQ ID NO: 26177 - protein, 9 aa, Neisseria
HGKKGEGRG

SEQ ID NO: 26178 - protein, 5 aa, Neisseria
SDADI

SEQ ID NO: 26179 - protein, 16 aa, Neisseria
SVTEKDVKQAKGKLYN

SEQ ID NO: 26180 - protein, 16 aa, Neisseria
LDNPAQQIRGALDALS

SEQ ID NO: 26181 - protein, 8 aa, Neisseria
QPDFINAV

SEQ ID NO: 26182 - protein, 5 aa, Neisseria
TVSTT

SEQ ID NO: 26183 - protein, 11 aa, Neisseria
DGIALLAELNR

SEQ ID NO: 26184 - protein, 5 aa, Neisseria
FRNAP

SEQ ID NO: 26185 - protein, 9 aa, Neisseria
RPLAEILPD

SEQ ID NO: 26186 - protein, 15 aa, Neisseria
LGKYGKVVELSKRLG

SEQ ID NO: 26187 - protein, 5 aa, Neisseria
MNNRH

SEQ ID NO: 26188 - protein, 15 aa, Neisseria
GSNLDNPAQQIRGAL

SEQ ID NO: 26189 - protein, 11 aa, Neisseria
LSSHPDIRLEQ

SEQ ID NO: 26190 - protein, 10 aa, Neisseria
VGYDNQPRDF

SEQ ID NO: 26191 - protein, 52 aa, Neisseria; identical to SEQ ID NO: 14162

SEQ ID NO: 26192 - protein, 20 aa, Neisseria
ILGKYGKVVELSKRLGNQGI

SEQ ID NO: 26193 - protein, 5 aa, Neisseria
LLPDR

SEQ ID NO: 26194 - protein, 9 aa, Neisseria
NLDNPAQQI

SEQ ID NO: 26195 - protein, 7 aa, Neisseria
PDIRLEQ

SEQ ID NO: 26196 - protein, 23 aa, Neisseria
ELNRIEADFGRERSFRNAPRTLD

SEQ ID NO: 26197 - protein, 10 aa, Neisseria
DGISSDDPRL

SEQ ID NO: 26198 - protein, 8 aa, Neisseria
RAHERSFV

SEQ ID NO: 26199 - protein, 8 aa, Neisseria
VELSKRLG

SEQ ID NO: 26200 - protein, 5 aa, Neisseria
LLPDR

SEQ ID NO: 26201 - protein, 26 aa, Neisseria
VAFERHHHKSKAEQNTHRRADAEIAE

SEQ ID NO: 26202 - protein, 11 aa, Neisseria
NQHTQARNQSV

SEQ ID NO: 26203 - protein, 5 aa, Neisseria
FSDKV

SEQ ID NO: 26204 - protein, 10 aa, Neisseria
ADGGKTWQKP

SEQ ID NO: 26205 - protein, 26 aa, Neisseria
VAFERHHHKSKAEQNTHRRADAEIAE

SEQ ID NO: 26206 - protein, 7 aa, Neisseria
TQARNQS

SEQ ID NO: 26207 - protein, 7 aa, Neisseria
DGGKTWQ

SEQ ID NO: 26208 - protein, 5 aa, Neisseria
SASLG

SEQ ID NO: 26209 - protein, 6 aa, Neisseria
YDTVKG

SEQ ID NO: 26210 - protein, 8 aa, Neisseria
YQRPFGGH

SEQ ID NO: 26211 - protein, 7 aa, Neisseria
EHGKRAV

SEQ ID NO: 26212 - protein, 6 aa, Neisseria
LHTLYQ

SEQ ID NO: 26213 - protein, 5 aa, Neisseria
ASSTN

SEQ ID NO: 26214 - protein, 7 aa, Neisseria
YMNTGDG

SEQ ID NO: 26215 - protein, 7 aa, Neisseria
RYAPTVK

SEQ ID NO: 26216 - protein, 9 aa, Neisseria
IMEKLPGIR

SEQ ID NO: 26217 - protein, 10 aa, Neisseria
GIDPIKDPIP

SEQ ID NO: 26218 - protein, 8 aa, Neisseria
GGIPTNYH

SEQ ID NO: 26219 - protein, 5 aa, Neisseria
GGGAG

SEQ ID NO: 26220 - protein, 6 aa, Neisseria
LSKSGL

SEQ ID NO: 26221 - protein, 6 aa, Neisseria
FPTRSH

SEQ ID NO: 26222 - protein, 8 aa, Neisseria
NVQEDRWD

SEQ ID NO: 26223 - protein, 15 aa, Neisseria
DTVKGSDWLGDQDAI

SEQ ID NO: 26224 - protein, 17 aa, Neisseria
MPFDRVESGKIYQRPFG

SEQ ID NO: 26225 - protein, 20 aa, Neisseria
TAEHGKRAVERACAVADRTG

SEQ ID NO: 26226 - protein, 7 aa, Neisseria
QNVRANT

SEQ ID NO: 26227 - protein, 10 aa, Neisseria
DLIRDENGDV

SEQ ID NO: 26228 - protein, 7 aa, Neisseria
MEMETGE

SEQ ID NO: 26229 - protein, 7 aa, Neisseria
TGGGGRI

SEQ ID NO: 26230 - protein, 5 aa, Neisseria
NTGDG

SEQ ID NO: 26231 - protein, 7 aa, Neisseria
IPLEDME

SEQ ID NO: 26232 - protein, 9 aa, Neisseria
EGVRGEGGI

SEQ ID NO: 26233 - protein, 9 aa, Neisseria
NADGERFME

SEQ ID NO: 26234 - protein, 15 aa, Neisseria
YAPTVKDLASRDVVS

SEQ ID NO: 26235 - protein, 14 aa, Neisseria
IYEGRGCGKNKDHV

SEQ ID NO: 26236 - protein, 19 aa, Neisseria
DHIGAEKIMEKLPGIREIS

SEQ ID NO: 26237 - protein, 9 aa, Neisseria
GIDPIKDPI

SEQ ID NO: 26238 - protein, 12 aa, Neisseria
VVPQGDEYEVPV

SEQ ID NO: 26239 - protein, 10 aa, Neisseria
GANRLGTNSL

SEQ ID NO: 26240 - protein, 5 aa, Neisseria
RPTPR

SEQ ID NO: 26241 - protein, 5 aa, Neisseria
SKSGL

SEQ ID NO: 26242 - protein, 8 aa, Neisseria
NVQEDRWD

SEQ ID NO: 26243 - protein, 5 aa, Neisseria
DTVKG

SEQ ID NO: 26244 - protein, 9 aa, Neisseria
DWLGDQDAI

SEQ ID NO: 26245 - protein, 11 aa, Neisseria
PFDRVESGKIY

SEQ ID NO: 26246 - protein, 20 aa, Neisseria
TAEHGKRAVERACAVADRTG

SEQ ID NO: 26247 - protein, 9 aa, Neisseria
DLIRDENGD

SEQ ID NO: 26248 - protein, 7 aa, Neisseria
MEMETGE

SEQ ID NO: 26249 - protein, 7 aa, Neisseria
IPLEDME

SEQ ID NO: 26250 - protein, 7 aa, Neisseria
EGVRGEG

SEQ ID NO: 26251 - protein, 8 aa, Neisseria
ADGERFME

SEQ ID NO: 26252 - protein, 15 aa, Neisseria
YAPTVKDLASRDVVS

SEQ ID NO: 26253 - protein, 14 aa, Neisseria
IYEGRGCGKNKDHV

SEQ ID NO: 26254 - protein, 19 aa, Neisseria
DHIGAEKIMEKLPGIREIS

SEQ ID NO: 26255 - protein, 7 aa, Neisseria
DPIKDPI

SEQ ID NO: 26256 - protein, 9 aa, Neisseria
QGDEYEVPV

SEQ ID NO: 26257 - protein, 7 aa, Neisseria
IRLINAA

SEQ ID NO: 26258 - protein, 5 aa, Neisseria
AILTK

SEQ ID NO: 26259 - protein, 14 aa, Neisseria
DVLHRYLPQMLSAG

SEQ ID NO: 26260 - protein, 13 aa, Neisseria
TGAAGMADMGKVM

SEQ ID NO: 26261 - protein, 9 aa, Neisseria
MKTHRKTCS

SEQ ID NO: 26262 - protein, 37 aa, Neisseria
TASKPAVSIRHPSEDIMSLKTRLTEDMKTAMRAKDQV

SEQ ID NO: 26263 - protein, 16 aa, Neisseria
KQFEVDERTEADDAKI

SEQ ID NO: 26264 - protein, 28 aa, Neisseria
MVKQRKDGAKIYTEAGRQDLADKENAEI

SEQ ID NO: 26265 - protein, 9 aa, Neisseria
SAGEIRTAV

SEQ ID NO: 26266 - protein, 16 aa, Neisseria
TRLAGKADMGEVNKIL

SEQ ID NO: 26267 - protein, 8 aa, Neisseria
MKTHRKTC

SEQ ID NO: 26268 - protein, 27 aa, Neisseria
HPSEDIMSLKTRLTEDMKTAMRAKDQV

SEQ ID NO: 26269 - protein, 16 aa, Neisseria
KQFEVDERTEADDAKI

SEQ ID NO: 26270 - protein, 28 aa, Neisseria
MVKQRKDGAKIYTEAGRQDLADKENAEI

SEQ ID NO: 26271 - protein, 7 aa, Neisseria
GEIRTAV

SEQ ID NO: 26272 - protein, 16 aa, Neisseria
TRLAGKADMGEVNKIL

SEQ ID NO: 26273 - protein, 24 aa, Neisseria
DKLLEQLMRFLQFLPEFLFALFRI

SEQ ID NO: 26274 - protein, 8 aa, Neisseria
RALKFARR

SEQ ID NO: 26275 - protein, 7 aa, Neisseria
NNFIRHT

SEQ ID NO: 26276 - protein, 6 aa, Neisseria
AAACRD

SEQ ID NO: 26277 - protein, 6 aa, Neisseria
HAARTF

SEQ ID NO: 26278 - protein, 6 aa, Neisseria
QGFYGV

SEQ ID NO: 26279 - protein, 16 aa, Neisseria
GFLRFGRFLPALLQTL

SEQ ID NO: 26280 - protein, 16 aa, Neisseria
FTHKSNRALKFARRHH

SEQ ID NO: 26281 - protein, 25 aa, Neisseria
RHFRHHTHRTDDRKRSGNNFIRHTR

SEQ ID NO: 26282 - protein, 13 aa, Neisseria
ACRDLIDGDGQRN

SEQ ID NO: 26283 - protein, 9 aa, Neisseria
QTPKLRSRQ

SEQ ID NO: 26284 - protein, 8 aa, Neisseria
TFQSEQNL

SEQ ID NO: 26285 - protein, 14 aa, Neisseria
RLGNQKHRRNLMTQ

SEQ ID NO: 26286 - protein, 7 aa, Neisseria
IQHKKAG

SEQ ID NO: 26287 - protein, 13 aa, Neisseria
KSNRALKFARRHH

SEQ ID NO: 26288 - protein, 12 aa, Neisseria
HTHRTDDRKRSG

SEQ ID NO: 26289 - protein, 12 aa, Neisseria
ACRDLIDGDGQR

SEQ ID NO: 26290 - protein, 7 aa, Neisseria
PKLRSRQ

SEQ ID NO: 26291 - protein, 9 aa, Neisseria
GNQKHRRNL

SEQ ID NO: 26292 - protein, 7 aa, Neisseria
IQHKKAG

SEQ ID NO: 26293 - protein, 10 aa, Neisseria
LVGFWKALPH

SEQ ID NO: 26294 - protein, 6 aa, Neisseria
MCCIAC

SEQ ID NO: 26295 - protein, 8 aa, Neisseria
WKNPEKPL

SEQ ID NO: 26296 - protein, 9 aa, Neisseria
MRARPRSTK

SEQ ID NO: 26297 - protein, 6 aa, Neisseria
NPEKPL

SEQ ID NO: 26298 - protein, 9 aa, Neisseria
MRARPRSTK

SEQ ID NO: 26299 - protein, 5 aa, Neisseria
IQHLR

SEQ ID NO: 26300 - protein, 14 aa, Neisseria
HLMRPCQQVSQMFG

SEQ ID NO: 26301 - protein, 6 aa, Neisseria
RIGNGY

SEQ ID NO: 26302 - protein, 7 aa, Neisseria
MVERHIQ

SEQ ID NO: 26303 - protein, 6 aa, Neisseria
LRNGHL

SEQ ID NO: 26304 - protein, 15 aa, Neisseria
FGGRAYDFRADKAAG

SEQ ID NO: 26305 - protein, 7 aa, Neisseria
YFADDKF

SEQ ID NO: 26306 - protein, 6 aa, Neisseria
LRGNLR

SEQ ID NO: 26307 - protein, 17 aa, Neisseria
FQTDKADLRTGKHHANG

SEQ ID NO: 26308 - protein, 7 aa, Neisseria
ADIRVAA

SEQ ID NO: 26309 - protein, 14 aa, Neisseria
RVARNKDMRNAGLH

SEQ ID NO: 26310 - protein, 6 aa, Neisseria
RIGNGY

SEQ ID NO: 26311 - protein, 5 aa, Neisseria
RTATY

SEQ ID NO: 26312 - protein, 6 aa, Neisseria
SEHGFR

SEQ ID NO: 26313 - protein, 7 aa, Neisseria
MVERHIQ

SEQ ID NO: 26314 - protein, 11 aa, Neisseria
RAYDFRADKAA

SEQ ID NO: 26315 - protein, 7 aa, Neisseria
YFADDKF

SEQ ID NO: 26316 - protein, 15 aa, Neisseria
FQTDKADLRTGKHHA

SEQ ID NO: 26317 - protein, 7 aa, Neisseria
ADIRVAA

SEQ ID NO: 26318 - protein, 10 aa, Neisseria
RVARNKDMRN

SEQ ID NO: 26319 - protein, 6 aa, Neisseria
PADNIE

SEQ ID NO: 26320 - protein, 19 aa, Neisseria
GKTLADYGGYPSALDAVKQ

SEQ ID NO: 26321 - protein, 6 aa, Neisseria
LENTGD

SEQ ID NO: 26322 - protein, 13 aa, Neisseria
AMAENVRKEWLKS

SEQ ID NO: 26323 - protein, 22 aa, Neisseria
  VARIANT 6: Xaa is any amino acid
AAELVXNTGKLPSGCTKLLEQA

SEQ ID NO: 26324 - protein, 9 aa, Neisseria
DAWRGVRGL

SEQ ID NO: 26325 - protein, 13 aa, Neisseria
AALGSPFDGGTQG

SEQ ID NO: 26326 - protein, 10 aa, Neisseria
NVIGKEARKS

SEQ ID NO: 26327 - protein, 7 aa, Neisseria
ALLSEME

SEQ ID NO: 26328 - protein, 10 aa, Neisseria
NVPAALDYYG

SEQ ID NO: 26329 - protein, 19 aa, Neisseria
RRWDELASVISHMPEKLQK

SEQ ID NO: 26330 - protein, 10 aa, Neisseria
QEAEKLYKQA

SEQ ID NO: 26331 - protein, 5 aa, Neisseria
RYISP

SEQ ID NO: 26332 - protein, 7 aa, Neisseria
QGLMQVM

SEQ ID NO: 26333 - protein, 8 aa, Neisseria
RDYVKKVM

SEQ ID NO: 26334 - protein, 5 aa, Neisseria
SSTNT

SEQ ID NO: 26335 - protein, 40 aa, Neisseria
PAGKTPADNIETADLSASVPTRPAEPEGKTLADYGGYPSA

SEQ ID NO: 26336 - protein, 10 aa, Neisseria
DAVKQNNDAA

SEQ ID NO: 26337 - protein, 8 aa, Neisseria
ENTGDSAM

SEQ ID NO: 26338 - protein, 8 aa, Neisseria
ENVRKEWL

SEQ ID NO: 26339 - protein, 6 aa, Neisseria
LGARRQ

SEQ ID NO: 26340 - protein, 30 aa, Neisseria
EYAKLKPEGGAQEVECYADSSRNDYTRAAE

SEQ ID NO: 26341 - protein, 10 aa, Neisseria
  VARIANT 1: Xaa is any amino acid
XNTGKLPSGC

SEQ ID NO: 26342 - protein, 10 aa, Neisseria
GGNDAWRGVR

SEQ ID NO: 26343 - protein, 11 aa, Neisseria
LAGRPTTDGRN

SEQ ID NO: 26344 - protein, 13 aa, Neisseria
SPFDGGTQGSREY

SEQ ID NO: 26345 - protein, 11 aa, Neisseria
IGKEARKSPNA

SEQ ID NO: 26346 - protein, 13 aa, Neisseria
SEMESGLSPEQRS

SEQ ID NO: 26347 - protein, 5 aa, Neisseria
QSQSL

SEQ ID NO: 26348 - protein, 16 aa, Neisseria
YYGKVADRRQLTDDQI

SEQ ID NO: 26349 - protein, 10 aa, Neisseria
AALRARRWDE

SEQ ID NO: 26350 - protein, 10 aa, Neisseria
MPEKLQKSPT

SEQ ID NO: 26351 - protein, 17 aa, Neisseria
RSRAATGNTQEAEKLYK

SEQ ID NO: 26352 - protein, 6 aa, Neisseria
AATGRN

SEQ ID NO: 26353 - protein, 23 aa, Neisseria
AGEELGRKIDTRNNVPDAGKNSV

SEQ ID NO: 26354 - protein, 9 aa, Neisseria
RMAEDGAIK

SEQ ID NO: 26355 - protein, 17 aa, Neisseria
RNSRTAGDAKMRRQAQA

SEQ ID NO: 26356 - protein, 12 aa, Neisseria
FATRGFDEDKLL

SEQ ID NO: 26357 - protein, 11 aa, Neisseria
SAERTDRKLNY

SEQ ID NO: 26358 - protein, 8 aa, Neisseria
SPFKDTVI

SEQ ID NO: 26359 - protein, 9 aa, Neisseria
AQNVNVDPA

SEQ ID NO: 26360 - protein, 7 aa, Neisseria
IRQESRF

SEQ ID NO: 26361 - protein, 7 aa, Neisseria
AQSRVGA

SEQ ID NO: 26362 - protein, 7 aa, Neisseria
TAREIAG

SEQ ID NO: 26363 - protein, 10 aa, Neisseria
YTADGNIRMG

SEQ ID NO: 26364 - protein, 11 aa, Neisseria
DTKRRLQNNEI

SEQ ID NO: 26365 - protein, 19 aa, Neisseria
GYNAGPGRARRWQADTPLE

SEQ ID NO: 26366 - protein, 8 aa, Neisseria
SETRDYVK

SEQ ID NO: 26367 - protein, 12 aa, Neisseria
PLKQRMGTVPAR

SEQ ID NO: 26368 - protein, 13 aa, Neisseria
GKTPADNIETADL

SEQ ID NO: 26369 - protein, 14 aa, Neisseria
VPTRPAEPEGKTLA

SEQ ID NO: 26370 - protein, 10 aa, Neisseria
DAVKQNNDAA

SEQ ID NO: 26371 - protein, 7 aa, Neisseria
NTGDSAM

SEQ ID NO: 26372 - protein, 8 aa, Neisseria
ENVRKEWL

SEQ ID NO: 26373 - protein, 6 aa, Neisseria
LGARRQ

SEQ ID NO: 26374 - protein, 30 aa, Neisseria; identical to SEQ ID NO: 26340

SEQ ID NO: 26375 - protein, 7 aa, Neisseria
GKLPSGC

SEQ ID NO: 26376 - protein, 5 aa, Neisseria
DAWRG

SEQ ID NO: 26377 - protein, 7 aa, Neisseria
PTTDGRN

SEQ ID NO: 26378 - protein, 10 aa, Neisseria
FDGGTQGSRE

SEQ ID NO: 26379 - protein, 10 aa, Neisseria
IGKEARKSPN

SEQ ID NO: 26380 - protein, 13 aa, Neisseria
SEMESGLSPEQRS

SEQ ID NO: 26381 - protein, 12 aa, Neisseria
VADRRQLTDDQI

SEQ ID NO: 26382 - protein, 10 aa, Neisseria
AALRARRWDE

SEQ ID NO: 26383 - protein, 7 aa, Neisseria
MPEKLQK

SEQ ID NO: 26384 - protein, 6 aa, Neisseria
RSRAAT

SEQ ID NO: 26385 - protein, 10 aa, Neisseria
NTQEAEKLYK

SEQ ID NO: 26386 - protein, 20 aa, Neisseria
AGEELGRKIDTRNNVPDAGK

SEQ ID NO: 26387 - protein, 9 aa, Neisseria
RMAEDGAIK

SEQ ID NO: 26388 - protein, 17 aa, Neisseria
RNSRTAGDAKMRRQAQA

SEQ ID NO: 26389 - protein, 10 aa, Neisseria
TRGFDEDKLL

SEQ ID NO: 26390 - protein, 9 aa, Neisseria
SAERTDRKL

SEQ ID NO: 26391 - protein, 7 aa, Neisseria
IRQESRF

SEQ ID NO: 26392 - protein, 7 aa, Neisseria
TAREIAG

SEQ ID NO: 26393 - protein, 8 aa, Neisseria
DTKRRLQN

SEQ ID NO: 26394 - protein, 10 aa, Neisseria
GPGRARRWQA

SEQ ID NO: 26395 - protein, 8 aa, Neisseria
SETRDYVK

SEQ ID NO: 26396 - protein, 6 aa, Neisseria
LKQRMG

SEQ ID NO: 26397 - protein, 32 aa, Neisseria
EYPAWQAFFSQAWVKVFTQVSFIAVFLHAWVG

SEQ ID NO: 26398 - protein, 8 aa, Neisseria
DLWMDYIK

SEQ ID NO: 26399 - protein, 7 aa, Neisseria
MVERKLT

SEQ ID NO: 26400 - protein, 8 aa, Neisseria
LPKEYPAW

SEQ ID NO: 26401 - protein, 7 aa, Neisseria
MVERKLT

SEQ ID NO: 26402 - protein, 14 aa, Neisseria
AACTAVAALLGGCA

SEQ ID NO: 26403 - protein, 7 aa, Neisseria
GMQTVSS

SEQ ID NO: 26404 - protein, 8 aa, Neisseria
NPYGATPY

SEQ ID NO: 26405 - protein, 10 aa, Neisseria
DFRAWNGMTD

SEQ ID NO: 26406 - protein, 7 aa, Neisseria
IGQIVKV

SEQ ID NO: 26407 - protein, 5 aa, Neisseria
VKPAA

SEQ ID NO: 26408 - protein, 7 aa, Neisseria
VQSAPQP

SEQ ID NO: 26409 - protein, 5 aa, Neisseria
SGTRS

SEQ ID NO: 26410 - protein, 6 aa, Neisseria
KVVADF

SEQ ID NO: 26411 - protein, 7 aa, Neisseria
GLRGYGN

SEQ ID NO: 26412 - protein, 5 aa, Neisseria
ATQQP

SEQ ID NO: 26413 - protein, 5 aa, Neisseria
VRGDT

SEQ ID NO: 26414 - protein, 15 aa, Neisseria
NISKRYHISQDDFRA

SEQ ID NO: 26415 - protein, 8 aa, Neisseria
NGMTDNTL

SEQ ID NO: 26416 - protein, 7 aa, Neisseria
VKVKPAG

SEQ ID NO: 26417 - protein, 15 aa, Neisseria
AAPKTAAVESRPAVP

SEQ ID NO: 26418 - protein, 17 aa, Neisseria
TPVKPAAQPPVQSAPQP

SEQ ID NO: 26419 - protein, 9 aa, Neisseria
PAAENKAVP

SEQ ID NO: 26420 - protein, 17 aa, Neisseria
PAPQSPAASPSGTRSVG

SEQ ID NO: 26421 - protein, 19 aa, Neisseria
RPTQGKVVADFGGGNKGVD

SEQ ID NO: 26422 - protein, 5 aa, Neisseria
ADGKV

SEQ ID NO: 26423 - protein, 7 aa, Neisseria
SGLRGYG

SEQ ID NO: 26424 - protein, 5 aa, Neisseria
YGHNQ

SEQ ID NO: 26425 - protein, 13 aa, Neisseria
LVGEGQQVKRGQQ

SEQ ID NO: 26426 - protein, 10 aa, Neisseria
GNTDASRTQL

SEQ ID NO: 26427 - protein, 14 aa, Neisseria
FEVRQNGKPVNPNS

SEQ ID NO: 26428 - protein, 5 aa, Neisseria
VRGDT

SEQ ID NO: 26429 - protein, 9 aa, Neisseria
YHISQDDFR

SEQ ID NO: 26430 - protein, 5 aa, Neisseria
VKVKP

SEQ ID NO: 26431 - protein, 8 aa, Neisseria
AAVESRPA

SEQ ID NO: 26432 - protein, 7 aa, Neisseria
TPVKPAA

SEQ ID NO: 26433 - protein, 9 aa, Neisseria
PAAENKAVP

SEQ ID NO: 26434 - protein, 5 aa, Neisseria
SGTRS

SEQ ID NO: 26435 - protein, 8 aa, Neisseria
GGGNKGVD

SEQ ID NO: 26436 - protein, 5 aa, Neisseria
ADGKV

SEQ ID NO: 26437 - protein, 9 aa, Neisseria
EGQQVKRGQ

SEQ ID NO: 26438 - protein, 6 aa, Neisseria
TDASRT

SEQ ID NO: 26439 - protein, 9 aa, Neisseria
VRQNGKPVN

SEQ ID NO: 26440 - protein, 9 aa, Neisseria
AVLRRPRFE

SEQ ID NO: 26441 - protein, 13 aa, Neisseria
PFAGNVYPRFVQI

SEQ ID NO: 26442 - protein, 14 aa, Neisseria
VHGQIQHPVQPFLR

SEQ ID NO: 26443 - protein, 9 aa, Neisseria
LGLLRRFDV

SEQ ID NO: 26444 - protein, 5 aa, Neisseria
QTALR

SEQ ID NO: 26445 - protein, 12 aa, Neisseria
LCQQCKQFFQIA

SEQ ID NO: 26446 - protein, 5 aa, Neisseria
MRRNV

SEQ ID NO: 26447 - protein, 7 aa, Neisseria
VLRRPRF

SEQ ID NO: 26448 - protein, 10 aa, Neisseria
RAVPAGKQGF

SEQ ID NO: 26449 - protein, 6 aa, Neisseria
CRLTQR

SEQ ID NO: 26450 - protein, 5 aa, Neisseria
GQRNL

SEQ ID NO: 26451 - protein, 12 aa, Neisseria
LEQRVVAHRQRV

SEQ ID NO: 26452 - protein, 11 aa, Neisseria
RRFDVGGRVGA

SEQ ID NO: 26453 - protein, 8 aa, Neisseria
PAFDQPGA

SEQ ID NO: 26454 - protein, 14 aa, Neisseria
LPPRRQLARQRPTV

SEQ ID NO: 26455 - protein, 18 aa, Neisseria
ALRQPPQRRRKIAPRQVL

SEQ ID NO: 26456 - protein, 8 aa, Neisseria
RHLCQQCK

SEQ ID NO: 26457 - protein, 9 aa, Neisseria
PVCRNRVLR

SEQ ID NO: 26458 - protein, 21 aa, Neisseria
VKIRRKPVQNHNRPTQISKNQ

SEQ ID NO: 26459 - protein, 5 aa, Neisseria
MRRNV

SEQ ID NO: 26460 - protein, 7 aa, Neisseria
VLRRPRF

SEQ ID NO: 26461 - protein, 5 aa, Neisseria
CRLTQ

SEQ ID NO: 26462 - protein, 12 aa, Neisseria
LEQRVVAHRQRV

SEQ ID NO: 26463 - protein, 7 aa, Neisseria
RRFDVGG

SEQ ID NO: 26464 - protein, 13 aa, Neisseria
PPRRQLARQRPTV

SEQ ID NO: 26465 - protein, 13 aa, Neisseria
LRQPPQRRRKIAP

SEQ ID NO: 26466 - protein, 6 aa, Neisseria
CRNRVL

SEQ ID NO: 26467 - protein, 21 aa, Neisseria
VKIRRKPVQNHNRPTQISKNQ

SEQ ID NO: 26468 - protein, 15 aa, Neisseria
QYGGLAGFPKRCESE

SEQ ID NO: 26469 - protein, 9 aa, Neisseria
GQAFEALNC

SEQ ID NO: 26470 - protein, 23 aa, Neisseria
VGALPKYLASNVVRDMHGLLSTV

SEQ ID NO: 26471 - protein, 14 aa, Neisseria
QTGKVLDKIPGAME

SEQ ID NO: 26472 - protein, 6 aa, Neisseria
IKTLAE

SEQ ID NO: 26473 - protein, 4 aa, Neisseria
FENF

SEQ ID NO: 26474 - protein, 21 aa, Neisseria
GPVDGHNVENLVDVLKDLRSR

SEQ ID NO: 26475 - protein, 5 aa, Neisseria
AENDP

SEQ ID NO: 26476 - protein, 14 aa, Neisseria
KYHAVANLPKEGGA

SEQ ID NO: 26477 - protein, 7 aa, Neisseria
YTQVFGK

SEQ ID NO: 26478 - protein, 8 aa, Neisseria
FPDRYFDV

SEQ ID NO: 26479 - protein, 8 aa, Neisseria
KPVVAIYS

SEQ ID NO: 26480 - protein, 9 aa, Neisseria
FLQRAYDQL

SEQ ID NO: 26481 - protein, 5 aa, Neisseria
CVPNM

SEQ ID NO: 26482 - protein, 11 aa, Neisseria
APAAVRYPRGT

SEQ ID NO: 26483 - protein, 9 aa, Neisseria
VSDGMETVE

SEQ ID NO: 26484 - protein, 5 aa, Neisseria
IIRRE

SEQ ID NO: 26485 - protein, 10 aa, Neisseria
MRFVKPIDEE

SEQ ID NO: 26486 - protein, 6 aa, Neisseria
RSHDRI

SEQ ID NO: 26487 - protein, 6 aa, Neisseria
AVLEVL

SEQ ID NO: 26488 - protein, 13 aa, Neisseria
DTVTEHGDPKKLL

SEQ ID NO: 26489 - protein, 13 aa, Neisseria
AGFPKRCESEYDA

SEQ ID NO: 26490 - protein, 6 aa, Neisseria
HSSTSI

SEQ ID NO: 26491 - protein, 13 aa, Neisseria
AADKLLGGDRRSV

SEQ ID NO: 26492 - protein, 6 aa, Neisseria
GDGAMT

SEQ ID NO: 26493 - protein, 7 aa, Neisseria
CAGDMDV

SEQ ID NO: 26494 - protein, 7 aa, Neisseria
NDNEMSI

SEQ ID NO: 26495 - protein, 8 aa, Neisseria
NVVRDMHG

SEQ ID NO: 26496 - protein, 14 aa, Neisseria
VKAQTGKVLDKIPG

SEQ ID NO: 26497 - protein, 21 aa, Neisseria
FAQKVEHKIKTLAEEAEHAKQ

SEQ ID NO: 26498 - protein, 9 aa, Neisseria
YTGPVDGHN

SEQ ID NO: 26499 - protein, 12 aa, Neisseria
VLKDLRSRKGPQ

SEQ ID NO: 26500 - protein, 17 aa, Neisseria
ITKKGNGYKLAENDPVK

SEQ ID NO: 26501 - protein, 24 aa, Neisseria
NLPKEGGAQMPSEKEPKPAAKPTY

SEQ ID NO: 26502 - protein, 8 aa, Neisseria
RAAADSRL

SEQ ID NO: 26503 - protein, 20 aa, Neisseria
AMREGSGLVEFEQRFPDRYF

SEQ ID NO: 26504 - protein, 8 aa, Neisseria
VGADGPTH

SEQ ID NO: 26505 - protein, 10 aa, Neisseria
AAPSDENECR

SEQ ID NO: 26506 - protein, 34 aa, Neisseria; identical to SEQ ID NO: 253

SEQ ID NO: 26507 - protein, 8 aa, Neisseria
KPIDEELI

SEQ ID NO: 26508 - protein, 22 aa, Neisseria
LARSHDRIVTLEENAEQGGAGG

SEQ ID NO: 26509 - protein, 17 aa, Neisseria
TVTEHGDPKKLLDDLGL

SEQ ID NO: 26510 - protein, 18 aa, Neisseria
EAVERRVREWLPDRDAAN

SEQ ID NO: 26511 - protein, 10 aa, Neisseria
FPKRCESEYD

SEQ ID NO: 26512 - protein, 13 aa, Neisseria
AADKLLGGDRRSV

SEQ ID NO: 26513 - protein, 5 aa, Neisseria
GDMDV

SEQ ID NO: 26514 - protein, 7 aa, Neisseria
NDNEMSI

SEQ ID NO: 26515 - protein, 6 aa, Neisseria
VVRDMH

SEQ ID NO: 26516 - protein, 8 aa, Neisseria
KVLDKIPG

SEQ ID NO: 26517 - protein, 21 aa, Neisseria
FAQKVEHKIKTLAEEAEHAKQ

SEQ ID NO: 26518 - protein, 11 aa, Neisseria
VLKDLRSRKGP

SEQ ID NO: 26519 - protein, 7 aa, Neisseria
ITKKGNG

SEQ ID NO: 26520 - protein, 9 aa, Neisseria
KLAENDPVK

SEQ ID NO: 26521 - protein, 7 aa, Neisseria
LPKEGGA

SEQ ID NO: 26522 - protein, 11 aa, Neisseria
MPSEKEPKPAA

SEQ ID NO: 26523 - protein, 8 aa, Neisseria
RAAADSRL

SEQ ID NO: 26524 - protein, 7 aa, Neisseria
AMREGSG

SEQ ID NO: 26525 - protein, 12 aa, Neisseria
VEFEQRFPDRYF

SEQ ID NO: 26526 - protein, 7 aa, Neisseria
PSDENEC

SEQ ID NO: 26527 - protein, 24 aa, Neisseria
PVSDGMETVEIGKGIIRREGEKTA

SEQ ID NO: 26528 - protein, 8 aa, Neisseria
KPIDEELI

SEQ ID NO: 26529 - protein, 19 aa, Neisseria
LARSHDRIVTLEENAEQGG

SEQ ID NO: 26530 - protein, 13 aa, Neisseria
TVTEHGDPKKLLD

SEQ ID NO: 26531 - protein, 18 aa, Neisseria
EAVERRVREWLPDRDAAN

SEQ ID NO: 26532 - protein, 5 aa, Neisseria
LDHAA

SEQ ID NO: 26533 - protein, 14 aa, Neisseria
NLEQMRAIMEAADQ

SEQ ID NO: 26534 - protein, 9 aa, Neisseria
AVEEFPHIP

SEQ ID NO: 26535 - protein, 6 aa, Neisseria
TVVNFS

SEQ ID NO: 26536 - protein, 10 aa, Neisseria
IGVLGNLETG

SEQ ID NO: 26537 - protein, 15 aa, Neisseria
LTSVEDAVRFVKDTG

SEQ ID NO: 26538 - protein, 9 aa, Neisseria
YKFTRPPTG

SEQ ID NO: 26539 - protein, 14 aa, Neisseria
VLRIDRIKEIHQAL

SEQ ID NO: 26540 - protein, 35 aa, Neisseria; identical to SEQ ID NO: 289

SEQ ID NO: 26541 - protein, 7 aa, Neisseria
RRYLAEN

SEQ ID NO: 26542 - protein, 9 aa, Neisseria
LGKTIEAMK

SEQ ID NO: 26543 - protein, 6 aa, Neisseria
LPKETQ

SEQ ID NO: 26544 - protein, 8 aa, Neisseria
HAAENSYG

SEQ ID NO: 26545 - protein, 13 aa, Neisseria
EQMRAIMEAADQV

SEQ ID NO: 26546 - protein, 8 aa, Neisseria
SAGARKYA

SEQ ID NO: 26547 - protein, 15 aa, Neisseria
HQDHGASPDVCQRSI

SEQ ID NO: 26548 - protein, 14 aa, Neisseria
SLLEDGKTPSSYEY

SEQ ID NO: 26549 - protein, 5 aa, Neisseria
VEGEI

SEQ ID NO: 26550 - protein, 15 aa, Neisseria
NLETGEAGEEDGVGA

SEQ ID NO: 26551 - protein, 5 aa, Neisseria
LSHDQ

SEQ ID NO: 26552 - protein, 15 aa, Neisseria
SVEDAVRFVKDTGVD

SEQ ID NO: 26553 - protein, 5 aa, Neisseria
TSHGA

SEQ ID NO: 26554 - protein, 20 aa, Neisseria
KFTRPPTGDVLRIDRIKEIH

SEQ ID NO: 26555 - protein, 6 aa, Neisseria
GSSSVP

SEQ ID NO: 26556 - protein, 9 aa, Neisseria
NEYGGNIGE

SEQ ID NO: 26557 - protein, 27 aa, Neisseria
EIVEGIKHGVRKVNIDTDLRLASTGAV

SEQ ID NO: 26558 - protein, 23 aa, Neisseria
YLAENPSDFDPRKYLGKTIEAMK

SEQ ID NO: 26559 - protein, 25 aa, Neisseria
CEGQAGKIKPVSLEKMASRYAKGEL

SEQ ID NO: 26560 - protein, 13 aa, Neisseria
EQMRAIMEAADQV

SEQ ID NO: 26561 - protein, 7 aa, Neisseria
AGARKYA

SEQ ID NO: 26562 - protein, 10 aa, Neisseria
DHGASPDVCQ

SEQ ID NO: 26563 - protein, 10 aa, Neisseria
SLLEDGKTPS

SEQ ID NO: 26564 - protein, 5 aa, Neisseria
VEGEI

SEQ ID NO: 26565 - protein, 13 aa, Neisseria
ETGEAGEEDGVGA

SEQ ID NO: 26566 - protein, 14 aa, Neisseria
SVEDAVRFVKDTGV

SEQ ID NO: 26567 - protein, 12 aa, Neisseria
DVLRIDRIKEIH

SEQ ID NO: 26568 - protein, 21 aa, Neisseria
EIVEGIKHGVRKVNIDTDLRL

SEQ ID NO: 26569 - protein, 11 aa, Neisseria
NPSDFDPRKYL

SEQ ID NO: 26570 - protein, 6 aa, Neisseria
TIEAMK

SEQ ID NO: 26571 - protein, 23 aa, Neisseria
GQAGKIKPVSLEKMASRYAKGEL

SEQ ID NO: 26572 - protein, 12 aa, Neisseria
SSGRFCQTIKAA

SEQ ID NO: 26573 - protein, 11 aa, Neisseria
ADGLQTVSSAA

SEQ ID NO: 26574 - protein, 13 aa, Neisseria
AVRRVPRQLRDSR

SEQ ID NO: 26575 - protein, 17 aa, Neisseria
CRTTHKTLRPYARPQRR

SEQ ID NO: 26576 - protein, 16 aa, Neisseria
PARTSSSRRCVPSGRC

SEQ ID NO: 26577 - protein, 17 aa, Neisseria
YSSRADATPRRRHSGAV

SEQ ID NO: 26578 - protein, 9 aa, Neisseria
CSSDSSGRF

SEQ ID NO: 26579 - protein, 20 aa, Neisseria
SFSARKTCSDGETSADSNWR

SEQ ID NO: 26580 - protein, 10 aa, Neisseria
AAQSDGEAGR

SEQ ID NO: 26581 - protein, 36 aa, Neisseria
SGRFCCGRRAVRRVPRQLRDSRRRGRARENRRRSAY

SEQ ID NO: 26582 - protein, 10 aa, Neisseria
CLRRADGFPV

SEQ ID NO: 26583 - protein, 17 aa, Neisseria
THCRCRLKRRTPRGGQC

SEQ ID NO: 26584 - protein, 35 aa, Neisseria
PPYRLDNRSNGGGSACRTTHKTLRPYARPQRRVCS

SEQ ID NO: 26585 - protein, 17 aa, Neisseria
AARRRHRAWGCRLKACR

SEQ ID NO: 26586 - protein, 13 aa, Neisseria
LPNLAPRRCRYAV

SEQ ID NO: 26587 - protein, 11 aa, Neisseria
ARTSSSRRCVP

SEQ ID NO: 26588 - protein, 13 aa, Neisseria
SRADATPRRRHSG

SEQ ID NO: 26589 - protein, 8 aa, Neisseria
CSSDSSGR

SEQ ID NO: 26590 - protein, 13 aa, Neisseria
SARKTCSDGETSA

SEQ ID NO: 26591 - protein, 9 aa, Neisseria
AQSDGEAGR

SEQ ID NO: 26592 - protein, 32 aa, Neisseria
CCGRRAVRRVPRQLRDSRRRGRARENRRRSAY

SEQ ID NO: 26593 - protein, 9 aa, Neisseria
CLRRADGFP

SEQ ID NO: 26594 - protein, 16 aa, Neisseria
THCRCRLKRRTPRGGQ

SEQ ID NO: 26595 - protein, 10 aa, Neisseria
YRLDNRSNGG

SEQ ID NO: 26596 - protein, 21 aa, Neisseria
SACRTTHKTLRPYARPQRRVC

SEQ ID NO: 26597 - protein, 9 aa, Neisseria
AARRRHRAW

SEQ ID NO: 26598 - protein, 5 aa, Neisseria
LKACR

SEQ ID NO: 26599 - protein, 9 aa, Neisseria
APRRCRYAV

SEQ ID NO: 26600 - protein, 11 aa, Neisseria
GKLSAVQEVEK

SEQ ID NO: 26601 - protein, 7 aa, Neisseria
APIASLN

SEQ ID NO: 26602 - protein, 18 aa, Neisseria
EFGQFLEPVRTYRRQYGV

SEQ ID NO: 26603 - protein, 7 aa, Neisseria
TDFRQDF

SEQ ID NO: 26604 - protein, 11 aa, Neisseria
EFTTKAGRRSP

SEQ ID NO: 26605 - protein, 8 aa, Neisseria
GLFNDGAS

SEQ ID NO: 26606 - protein, 6 aa, Neisseria
IESGIR

SEQ ID NO: 26607 - protein, 6 aa, Neisseria
LAEKGV

SEQ ID NO: 26608 - protein, 14 aa, Neisseria
YNRKEAKDRGEGGV

SEQ ID NO: 26609 - protein, 21 aa, Neisseria
VISAGTSVRESIKLIEAEGAT

SEQ ID NO: 26610 - protein, 13 aa, Neisseria
LDRMEKGTGKLSA

SEQ ID NO: 26611 - protein, 9 aa, Neisseria
QEVEKQYGL

SEQ ID NO: 26612 - protein, 8 aa, Neisseria
QNNPEFGQ

SEQ ID NO: 26613 - protein, 13 aa, Neisseria
EPVRTYRRQYGVE

SEQ ID NO: 26614 - protein, 7 aa, Neisseria
TDFRQDF

SEQ ID NO: 26615 - protein, 10 aa, Neisseria
EFTTKAGRRS

SEQ ID NO: 26616 - protein, 6 aa, Neisseria
LAEKGV

SEQ ID NO: 26617 - protein, 12 aa, Neisseria
YNRKEAKDRGEG

SEQ ID NO: 26618 - protein, 16 aa, Neisseria
TSVRESIKLIEAEGAT

SEQ ID NO: 26619 - protein, 10 aa, Neisseria
LDRMEKGTGK

SEQ ID NO: 26620 - protein, 7 aa, Neisseria
QEVEKQY

SEQ ID NO: 26621 - protein, 8 aa, Neisseria
RTYRRQYG

SEQ ID NO: 26622 - protein, 6 aa, Neisseria
SFVAHF

SEQ ID NO: 26623 - protein, 11 aa, Neisseria
AAPYIRQMRGT

SEQ ID NO: 26624 - protein, 6 aa, Neisseria
GTLNKL

SEQ ID NO: 26625 - protein, 5 aa, Neisseria
HFLDR

SEQ ID NO: 26626 - protein, 13 aa, Neisseria
PHYCRGLRVTDET

SEQ ID NO: 26627 - protein, 6 aa, Neisseria
AQQFAG

SEQ ID NO: 26628 - protein, 9 aa, Neisseria
SVSGFARAP

SEQ ID NO: 26629 - protein, 5 aa, Neisseria
MGVID

SEQ ID NO: 26630 - protein, 6 aa, Neisseria
YAGVIR

SEQ ID NO: 26631 - protein, 14 aa, Neisseria
LSDGISRPDGTLAE

SEQ ID NO: 26632 - protein, 12 aa, Neisseria
SAQEAQSLAEHA

SEQ ID NO: 26633 - protein, 8 aa, Neisseria
SAVAALEG

SEQ ID NO: 26634 - protein, 5 aa, Neisseria
IGTSI

SEQ ID NO: 26635 - protein, 20 aa, Neisseria
IRQAHSGDIPHIAALIRPLE

SEQ ID NO: 26636 - protein, 11 aa, Neisseria
YLENHISEFSI

SEQ ID NO: 26637 - protein, 13 aa, Neisseria
YGCAALKTFAEAD

SEQ ID NO: 26638 - protein, 6 aa, Neisseria
RLLAHI

SEQ ID NO: 26639 - protein, 5 aa, Neisseria
SRLFA

SEQ ID NO: 26640 - protein, 5 aa, Neisseria
NAPDS

SEQ ID NO: 26641 - protein, 15 aa, Neisseria
FREAAPYIRQMRGTT

SEQ ID NO: 26642 - protein, 11 aa, Neisseria
GIDGRLLEGGT

SEQ ID NO: 26643 - protein, 21 aa, Neisseria
QGRTPHYCRGLRVTDETSLGQ

SEQ ID NO: 26644 - protein, 7 aa, Neisseria
TVRSRFE

SEQ ID NO: 26645 - protein, 5 aa, Neisseria
RAPSV

SEQ ID NO: 26646 - protein, 5 aa, Neisseria
RPMGV

SEQ ID NO: 26647 - protein, 7 aa, Neisseria
DGTDMEY

SEQ ID NO: 26648 - protein, 8 aa, Neisseria
IRKTDTAA

SEQ ID NO: 26649 - protein, 5 aa, Neisseria
LDAGN

SEQ ID NO: 26650 - protein, 11 aa, Neisseria
LGHSYGGKTFN

SEQ ID NO: 26651 - protein, 12 aa, Neisseria
SDGISRPDGTLA

SEQ ID NO: 26652 - protein, 10 aa, Neisseria
LSAQEAQSLA

SEQ ID NO: 26653 - protein, 9 aa, Neisseria
AASETRRLI

SEQ ID NO: 26654 - protein, 5 aa, Neisseria
LEGGV

SEQ ID NO: 26655 - protein, 8 aa, Neisseria
GAADGSLL

SEQ ID NO: 26656 - protein, 14 aa, Neisseria
FTRNGIGTSIAKEA

SEQ ID NO: 26657 - protein, 8 aa, Neisseria
RQAHSGDI

SEQ ID NO: 26658 - protein, 7 aa, Neisseria
RPLEEQG

SEQ ID NO: 26659 - protein, 7 aa, Neisseria
HRSREYL

SEQ ID NO: 26660 - protein, 10 aa, Neisseria
SILEHDGDLY

SEQ ID NO: 26661 - protein, 9 aa, Neisseria
TFAEADCGE

SEQ ID NO: 26662 - protein, 12 aa, Neisseria
PQAQDGGYGERL

SEQ ID NO: 26663 - protein, 6 aa, Neisseria
IDKARG

SEQ ID NO: 26664 - protein, 5 aa, Neisseria
TNTGE

SEQ ID NO: 26665 - protein, 29 aa, Neisseria
RGFQTASEDELPETRRKDYRSNGRNPHIL

SEQ ID NO: 26666 - protein, 6 aa, Neisseria
FREAAP

SEQ ID NO: 26667 - protein, 7 aa, Neisseria
IDGRLLE

SEQ ID NO: 26668 - protein, 9 aa, Neisseria
LRVTDETSL

SEQ ID NO: 26669 - protein, 6 aa, Neisseria
VRSRFE

SEQ ID NO: 26670 - protein, 7 aa, Neisseria
DGTDMEY

SEQ ID NO: 26671 - protein, 8 aa, Neisseria
IRKTDTAA

SEQ ID NO: 26672 - protein, 9 aa, Neisseria
GISRPDGTL

SEQ ID NO: 26673 - protein, 10 aa, Neisseria
LSAQEAQSLA

SEQ ID NO: 26674 - protein, 9 aa, Neisseria
AASETRRLI

SEQ ID NO: 26675 - protein, 6 aa, Neisseria
QAHSGD

SEQ ID NO: 26676 - protein, 7 aa, Neisseria
RPLEEQG

SEQ ID NO: 26677 - protein, 7 aa, Neisseria
HRSREYL

SEQ ID NO: 26678 - protein, 6 aa, Neisseria
EHDGDL

SEQ ID NO: 26679 - protein, 9 aa, Neisseria
TFAEADCGE

SEQ ID NO: 26680 - protein, 9 aa, Neisseria
QAQDGGYGE

SEQ ID NO: 26681 - protein, 6 aa, Neisseria
IDKARG

SEQ ID NO: 26682 - protein, 25 aa, Neisseria
RGFQTASEDELPETRRKDYRSNGRN

SEQ ID NO: 26683 - protein, 14 aa, Neisseria
DPYRHFENLDSAET

SEQ ID NO: 26684 - protein, 9 aa, Neisseria
DGILNQMQD

SEQ ID NO: 26685 - protein, 11 aa, Neisseria
PKGVYRMCTAA

SEQ ID NO: 26686 - protein, 8 aa, Neisseria
VADFDELL

SEQ ID NO: 26687 - protein, 10 aa, Neisseria
GVSHLVEQPN

SEQ ID NO: 26688 - protein, 9 aa, Neisseria
MVNAWRYLD

SEQ ID NO: 26689 - protein, 7 aa, Neisseria
IDLIEAS

SEQ ID NO: 26690 - protein, 14 aa, Neisseria
PLNLPNDCDVVGYL

SEQ ID NO: 26691 - protein, 8 aa, Neisseria
QALESVET

SEQ ID NO: 26692 - protein, 10 aa, Neisseria
ASLLENVQGR

SEQ ID NO: 26693 - protein, 6 aa, Neisseria
DFTTPL

SEQ ID NO: 26694 - protein, 16 aa, Neisseria
GFGIPELPHYLGSVGK

SEQ ID NO: 26695 - protein, 24 aa, Neisseria
AAQGISKHKSVDDLLAVVRDLSER

SEQ ID NO: 26696 - protein, 5 aa, Neisseria
SSPKH

SEQ ID NO: 26697 - protein, 6 aa, Neisseria
VREPQS

SEQ ID NO: 26698 - protein, 7 aa, Neisseria
LTDMIRY

SEQ ID NO: 26699 - protein, 19 aa, Neisseria
WTDEYGNPQKYEACKRRLG

SEQ ID NO: 26700 - protein, 15 aa, Neisseria
LSPYHNLSDGIDYPP

SEQ ID NO: 26701 - protein, 5 aa, Neisseria
AHALK

SEQ ID NO: 26702 - protein, 5 aa, Neisseria
GHTGN

SEQ ID NO: 26703 - protein, 5 aa, Neisseria
TQRES

SEQ ID NO: 26704 - protein, 20 aa, Neisseria
MKSYPDPYRHFENLDSAETQ

SEQ ID NO: 26705 - protein, 22 aa, Neisseria
ANAETRARFLNNDKARALSDGI

SEQ ID NO: 26706 - protein, 9 aa, Neisseria
MQDTRQIPF

SEQ ID NO: 26707 - protein, 6 aa, Neisseria
QEHRAR

SEQ ID NO: 26708 - protein, 9 aa, Neisseria
QNAEYPKGV

SEQ ID NO: 26709 - protein, 8 aa, Neisseria
YRSGYPEW

SEQ ID NO: 26710 - protein, 11 aa, Neisseria
DFDELLGDDVY

SEQ ID NO: 26711 - protein, 5 aa, Neisseria
EQPNR

SEQ ID NO: 26712 - protein, 8 aa, Neisseria
LNKSGGDT

SEQ ID NO: 26713 - protein, 10 aa, Neisseria
VDLEAGELVE

SEQ ID NO: 26714 - protein, 14 aa, Neisseria
AGKNHVSWRDENSV

SEQ ID NO: 26715 - protein, 31 aa, Neisseria
PAWDERQLTESGYPREVWLVERGKSFEESLP

SEQ ID NO: 26716 - protein, 6 aa, Neisseria
QIDKGA

SEQ ID NO: 26717 - protein, 20 aa, Neisseria
RYLDPQGSPIDLIEASDGFY

SEQ ID NO: 26718 - protein, 18 aa, Neisseria
VSSEGGAKPLNLPNDCDV

SEQ ID NO: 26719 - protein, 14 aa, Neisseria
LRKDWHRANQSYPS

SEQ ID NO: 26720 - protein, 8 aa, Neisseria
KLNRGELG

SEQ ID NO: 26721 - protein, 6 aa, Neisseria
PDETQA

SEQ ID NO: 26722 - protein, 7 aa, Neisseria
ESVETTK

SEQ ID NO: 26723 - protein, 7 aa, Neisseria
VQGRLKA

SEQ ID NO: 26724 - protein, 18 aa, Neisseria
RFADSKWQEAELPHLPSG

SEQ ID NO: 26725 - protein, 9 aa, Neisseria
EMTDQPWGG

SEQ ID NO: 26726 - protein, 12 aa, Neisseria
QPQQFVSDGIEV

SEQ ID NO: 26727 - protein, 8 aa, Neisseria
VSSDGERI

SEQ ID NO: 26728 - protein, 8 aa, Neisseria
GKNAAPDT

SEQ ID NO: 26729 - protein, 13 aa, Neisseria
NIRGGGEFGPRWH

SEQ ID NO: 26730 - protein, 10 aa, Neisseria
GISKHKSVDD

SEQ ID NO: 26731 - protein, 13 aa, Neisseria
RDLSERGMSSPKH

SEQ ID NO: 26732 - protein, 5 aa, Neisseria
GGSNG

SEQ ID NO: 26733 - protein, 10 aa, Neisseria
FVREPQSIGA

SEQ ID NO: 26734 - protein, 27 aa, Neisseria
GSSWTDEYGNPQKYEACKRRLGELSPY

SEQ ID NO: 26735 - protein, 9 aa, Neisseria
NLSDGIDYP

SEQ ID NO: 26736 - protein, 9 aa, Neisseria
TSLSDDRVH

SEQ ID NO: 26737 - protein, 10 aa, Neisseria
AKLRETSPQS

SEQ ID NO: 26738 - protein, 21 aa, Neisseria
YSPDGGGHTGNGTQRESADKL

SEQ ID NO: 26739 - protein, 8 aa, Neisseria
SYPDPYRH

SEQ ID NO: 26740 - protein, 8 aa, Neisseria
ENLDSAET

SEQ ID NO: 26741 - protein, 19 aa, Neisseria
ANAETRARFLNNDKARALS

SEQ ID NO: 26742 - protein, 6 aa, Neisseria
MQDTRQ

SEQ ID NO: 26743 - protein, 6 aa, Neisseria
QEHRAR

SEQ ID NO: 26744 - protein, 7 aa, Neisseria
DFDELLG

SEQ ID NO: 26745 - protein, 5 aa, Neisseria
KSGGD

SEQ ID NO: 26746 - protein, 10 aa, Neisseria
VDLEAGELVE

SEQ ID NO: 26747 - protein, 8 aa, Neisseria
VSWRDENS

SEQ ID NO: 26748 - protein, 7 aa, Neisseria
WDERQLT

SEQ ID NO: 26749 - protein, 10 aa, Neisseria
ERGKSFEESL

SEQ ID NO: 26750 - protein, 6 aa, Neisseria
QIDKGA

SEQ ID NO: 26751 - protein, 7 aa, Neisseria
DLIEASD

SEQ ID NO: 26752 - protein, 7 aa, Neisseria
SSEGGAK

SEQ ID NO: 26753 - protein, 7 aa, Neisseria
LRKDWHR

SEQ ID NO: 26754 - protein, 8 aa, Neisseria
KLNRGELG

SEQ ID NO: 26755 - protein, 6 aa, Neisseria
PDETQA

SEQ ID NO: 26756 - protein, 7 aa, Neisseria
ESVETTK

SEQ ID NO: 26757 - protein, 7 aa, Neisseria
VQGRLKA

SEQ ID NO: 26758 - protein, 10 aa, Neisseria
ADSKWQEAEL

SEQ ID NO: 26759 - protein, 5 aa, Neisseria
DGIEV

SEQ ID NO: 26760 - protein, 5 aa, Neisseria
SDGER

SEQ ID NO: 26761 - protein, 6 aa, Neisseria
KNAAPD

SEQ ID NO: 26762 - protein, 7 aa, Neisseria
RGGGEFG

SEQ ID NO: 26763 - protein, 10 aa, Neisseria
GISKHKSVDD

SEQ ID NO: 26764 - protein, 10 aa, Neisseria
RDLSERGMSS

SEQ ID NO: 26765 - protein, 7 aa, Neisseria
FVREPQS

SEQ ID NO: 26766 - protein, 7 aa, Neisseria
WTDEYGN

SEQ ID NO: 26767 - protein, 12 aa, Neisseria
QKYEACKRRLGE

SEQ ID NO: 26768 - protein, 7 aa, Neisseria
LSDDRVH

SEQ ID NO: 26769 - protein, 7 aa, Neisseria
AKLRETS

SEQ ID NO: 26770 - protein, 10 aa, Neisseria
GTQRESADKL

SEQ ID NO: 26771 - protein, 6 aa, Neisseria
LSNTST

SEQ ID NO: 26772 - protein, 5 aa, Neisseria
AVRSM

SEQ ID NO: 26773 - protein, 10 aa, Neisseria
SPLVRILPLS

SEQ ID NO: 26774 - protein, 9 aa, Neisseria
SMVVAFFAN

SEQ ID NO: 26775 - protein, 14 aa, Neisseria
SALSNTSTAAGPSC

SEQ ID NO: 26776 - protein, 26 aa, Neisseria
YSKETGCPCPSLRKDSSTGGRPMSPC

SEQ ID NO: 26777 - protein, 12 aa, Neisseria
LANRDCVPKADT

SEQ ID NO: 26778 - protein, 9 aa, Neisseria
TDSTSPRPL

SEQ ID NO: 26779 - protein, 6 aa, Neisseria
WANSAS

SEQ ID NO: 26780 - protein, 14 aa, Neisseria
SATRASLPKIRDRV

SEQ ID NO: 26781 - protein, 9 aa, Neisseria
CSYASAPGP

SEQ ID NO: 26782 - protein, 14 aa, Neisseria
GLWRCRDSQSGSNS

SEQ ID NO: 26783 - protein, 5 aa, Neisseria
NAGCK

SEQ ID NO: 26784 - protein, 7 aa, Neisseria
YSKETGC

SEQ ID NO: 26785 - protein, 13 aa, Neisseria
SLRKDSSTGGRPM

SEQ ID NO: 26786 - protein, 11 aa, Neisseria
ANRDCVPKADT

SEQ ID NO: 26787 - protein, 6 aa, Neisseria
DSTSPR

SEQ ID NO: 26788 - protein, 12 aa, Neisseria
TRASLPKIRDRV

SEQ ID NO: 26789 - protein, 8 aa, Neisseria
RCRDSQSG

SEQ ID NO: 26790 - protein, 8 aa, Neisseria
ERFVEPSR

SEQ ID NO: 26791 - protein, 17 aa, Neisseria
KVHRGLDGAARFDEGER

SEQ ID NO: 26792 - protein, 6 aa, Neisseria
ASGDGF

SEQ ID NO: 26793 - protein, 11 aa, Neisseria
DAAGDFGDGQR

SEQ ID NO: 26794 - protein, 8 aa, Neisseria
QNIGGFVY

SEQ ID NO: 26795 - protein, 5 aa, Neisseria
MPSAP

SEQ ID NO: 26796 - protein, 17 aa, Neisseria
RRQKSVMPPERFVEPSR

SEQ ID NO: 26797 - protein, 19 aa, Neisseria
KVHRGLDGAARFDEGERVF

SEQ ID NO: 26798 - protein, 10 aa, Neisseria
AAQASGDGFA

SEQ ID NO: 26799 - protein, 16 aa, Neisseria
QPDAAGDFGDGQRAGE

SEQ ID NO: 26800 - protein, 5 aa, Neisseria
AEGEA

SEQ ID NO: 26801 - protein, 17 aa, Neisseria
RRQKSVMPPERFVEPSR

SEQ ID NO: 26802 - protein, 19 aa, Neisseria
KVHRGLDGAARFDEGERVF

SEQ ID NO: 26803 - protein, 14 aa, Neisseria
DAAGDFGDGQRAGE

SEQ ID NO: 26804 - protein, 5 aa, Neisseria
AEGEA

SEQ ID NO: 26805 - protein, 6 aa, Neisseria
RPTSSP

SEQ ID NO: 26806 - protein, 9 aa, Neisseria
TSCSGLMVS

SEQ ID NO: 26807 - protein, 6 aa, Neisseria
FSLFSS

SEQ ID NO: 26808 - protein, 5 aa, Neisseria
KSASS

SEQ ID NO: 26809 - protein, 7 aa, Neisseria
SCNAFSS

SEQ ID NO: 26810 - protein, 11 aa, Neisseria
RPTSSPPRRAC

SEQ ID NO: 26811 - protein, 25 aa, Neisseria
IRTRSSAKRKTCNAPGQSIRPASCS

SEQ ID NO: 26812 - protein, 7 aa, Neisseria
PNMERLP

SEQ ID NO: 26813 - protein, 21 aa, Neisseria
SRYSLERTRAMRPGMLNRSAA

SEQ ID NO: 26814 - protein, 27 aa, Neisseria
SLRESASSKSASSAPARYNVKGDAPLP

SEQ ID NO: 26815 - protein, 10 aa, Neisseria
TVWTSRRLPV

SEQ ID NO: 26816 - protein, 8 aa, Neisseria
EPTCPLPK

SEQ ID NO: 26817 - protein, 10 aa, Neisseria
PTSSPPRRAC

SEQ ID NO: 26818 - protein, 13 aa, Neisseria
IRTRSSAKRKTCN

SEQ ID NO: 26819 - protein, 7 aa, Neisseria
QSIRPAS

SEQ ID NO: 26820 - protein, 6 aa, Neisseria
NMERLP

SEQ ID NO: 26821 - protein, 12 aa, Neisseria
SRYSLERTRAMR

SEQ ID NO: 26822 - protein, 12 aa, Neisseria
SLRESASSKSAS

SEQ ID NO: 26823 - protein, 9 aa, Neisseria
YNVKGDAPL

SEQ ID NO: 26824 - protein, 12 aa, Neisseria
IADIAQDLPDGA

SEQ ID NO: 26825 - protein, 7 aa, Neisseria
AENIGAV

SEQ ID NO: 26826 - protein, 11 aa, Neisseria
NICYRLAKQLE

SEQ ID NO: 26827 - protein, 8 aa, Neisseria
YIDEIDVF

SEQ ID NO: 26828 - protein, 5 aa, Neisseria
SALLA

SEQ ID NO: 26829 - protein, 5 aa, Neisseria
LLEGN

SEQ ID NO: 26830 - protein, 6 aa, Neisseria
IGSILA

SEQ ID NO: 26831 - protein, 9 aa, Neisseria
SGIKWPEGC

SEQ ID NO: 26832 - protein, 10 aa, Neisseria
IAAVVRAGTG

SEQ ID NO: 26833 - protein, 9 aa, Neisseria
ILNELEKLI

SEQ ID NO: 26834 - protein, 8 aa, Neisseria
QARRGGLL

SEQ ID NO: 26835 - protein, 10 aa, Neisseria
IAQDLPDGAD

SEQ ID NO: 26836 - protein, 6 aa, Neisseria
YRNNRL

SEQ ID NO: 26837 - protein, 5 aa, Neisseria
IEGDE

SEQ ID NO: 26838 - protein, 14 aa, Neisseria
PELRPKETSTRRIM

SEQ ID NO: 26839 - protein, 5 aa, Neisseria
KQLEH

SEQ ID NO: 26840 - protein, 12 aa, Neisseria
IIECRPRRAEWI

SEQ ID NO: 26841 - protein, 7 aa, Neisseria
ENLDNTL

SEQ ID NO: 26842 - protein, 17 aa, Neisseria
SATDETLLDNEYIDEID

SEQ ID NO: 26843 - protein, 8 aa, Neisseria
TNDDESNI

SEQ ID NO: 26844 - protein, 6 aa, Neisseria
LGAKRV

SEQ ID NO: 26845 - protein, 5 aa, Neisseria
NRSSY

SEQ ID NO: 26846 - protein, 6 aa, Neisseria
LEGNKI

SEQ ID NO: 26847 - protein, 8 aa, Neisseria
HIRRGDIV

SEQ ID NO: 26848 - protein, 11 aa, Neisseria
PIRRGTAEAIE

SEQ ID NO: 26849 - protein, 8 aa, Neisseria
AHGDKKTS

SEQ ID NO: 26850 - protein, 15 aa, Neisseria
IGRRISGIKWPEGCH

SEQ ID NO: 26851 - protein, 7 aa, Neisseria
RAGTGET

SEQ ID NO: 26852 - protein, 7 aa, Neisseria
VIQDGDH

SEQ ID NO: 26853 - protein, 12 aa, Neisseria
VSRRRILNELEK

SEQ ID NO: 26854 - protein, 6 aa, Neisseria
QARRGG

SEQ ID NO: 26855 - protein, 10 aa, Neisseria
IAQDLPDGAD

SEQ ID NO: 26856 - protein, 5 aa, Neisseria
IEGDE

SEQ ID NO: 26857 - protein, 14 aa, Neisseria
PELRPKETSTRRIM

SEQ ID NO: 26858 - protein, 12 aa, Neisseria
IIECRPRRAEWI

SEQ ID NO: 26859 - protein, 8 aa, Neisseria
SATDETLL

SEQ ID NO: 26860 - protein, 7 aa, Neisseria
EYIDEID

SEQ ID NO: 26861 - protein, 8 aa, Neisseria
TNDDESNI

SEQ ID NO: 26862 - protein, 6 aa, Neisseria
LGAKRV

SEQ ID NO: 26863 - protein, 6 aa, Neisseria
LEGNKI

SEQ ID NO: 26864 - protein, 6 aa, Neisseria
IRRGDI

SEQ ID NO: 26865 - protein, 11 aa, Neisseria
PIRRGTAEAIE

SEQ ID NO: 26866 - protein, 8 aa, Neisseria
AHGDKKTS

SEQ ID NO: 26867 - protein, 6 aa, Neisseria
IGRRIS

SEQ ID NO: 26868 - protein, 6 aa, Neisseria
VIQDGD

SEQ ID NO: 26869 - protein, 11 aa, Neisseria
SRRRILNELEK

SEQ ID NO: 26870 - protein, 5 aa, Neisseria
QHLLE

SEQ ID NO: 26871 - protein, 10 aa, Neisseria
DHAVDGIGQM

SEQ ID NO: 26872 - protein, 5 aa, Neisseria
QPFGQ

SEQ ID NO: 26873 - protein, 10 aa, Neisseria
EHFAPVDGFR

SEQ ID NO: 26874 - protein, 7 aa, Neisseria
IGVFPAL

SEQ ID NO: 26875 - protein, 5 aa, Neisseria
SDFRR

SEQ ID NO: 26876 - protein, 11 aa, Neisseria
ARLTQVFQAFF

SEQ ID NO: 26877 - protein, 8 aa, Neisseria
VLNLCRRA

SEQ ID NO: 26878 - protein, 7 aa, Neisseria
FDYRTRL

SEQ ID NO: 26879 - protein, 6 aa, Neisseria
ISKERH

SEQ ID NO: 26880 - protein, 9 aa, Neisseria
RRTDHAVDG

SEQ ID NO: 26881 - protein, 5 aa, Neisseria
DQPFG

SEQ ID NO: 26882 - protein, 20 aa, Neisseria
APVDGFRVQDIDLDGHQRLF

SEQ ID NO: 26883 - protein, 11 aa, Neisseria
FRNPVCRRTGF

SEQ ID NO: 26884 - protein, 10 aa, Neisseria
GIEPDSPPRF

SEQ ID NO: 26885 - protein, 12 aa, Neisseria
FRNRHLQGSLRV

SEQ ID NO: 26886 - protein, 9 aa, Neisseria
FLKDDHRVG

SEQ ID NO: 26887 - protein, 17 aa, Neisseria
SDFRRFGQRHIGRRGIH

SEQ ID NO: 26888 - protein, 13 aa, Neisseria
LCRRANPRPKRSL

SEQ ID NO: 26889 - protein, 6 aa, Neisseria
ISKERH

SEQ ID NO: 26890 - protein, 7 aa, Neisseria
RRTDHAV

SEQ ID NO: 26891 - protein, 17 aa, Neisseria
DGFRVQDIDLDGHQRLF

SEQ ID NO: 26892 - protein, 8 aa, Neisseria
PVCRRTGF

SEQ ID NO: 26893 - protein, 7 aa, Neisseria
EPDSPPR

SEQ ID NO: 26894 - protein, 8 aa, Neisseria
FLKDDHRV

SEQ ID NO: 26895 - protein, 7 aa, Neisseria
DFRRFGQ

SEQ ID NO: 26896 - protein, 8 aa, Neisseria
HIGRRGIH

SEQ ID NO: 26897 - protein, 13 aa, Neisseria
LCRRANPRPKRSL

SEQ ID NO: 26898 - protein, 14 aa, Neisseria
IQSICDAFQFISYY

SEQ ID NO: 26899 - protein, 14 aa, Neisseria
PKDYIDALYKAWQK

SEQ ID NO: 26900 - protein, 5 aa, Neisseria
VNEGV

SEQ ID NO: 26901 - protein, 12 aa, Neisseria
NPSDNIVDWVLK

SEQ ID NO: 26902 - protein, 5 aa, Neisseria
PTMGA

SEQ ID NO: 26903 - protein, 9 aa, Neisseria
LELFEKVNA

SEQ ID NO: 26904 - protein, 7 aa, Neisseria
GLGGLTT

SEQ ID NO: 26905 - protein, 5 aa, Neisseria
AMIPN

SEQ ID NO: 26906 - protein, 8 aa, Neisseria
NGKRVDVD

SEQ ID NO: 26907 - protein, 10 aa, Neisseria
KRLVASMLDK

SEQ ID NO: 26908 - protein, 7 aa, Neisseria
VDFTNRL

SEQ ID NO: 26909 - protein, 8 aa, Neisseria
PVDPVGDE

SEQ ID NO: 26910 - protein, 11 aa, Neisseria
ATRMDKFTRQM

SEQ ID NO: 26911 - protein, 8 aa, Neisseria
KSSKVLAF

SEQ ID NO: 26912 - protein, 7 aa, Neisseria
ATAPRKW

SEQ ID NO: 26913 - protein, 7 aa, Neisseria
IKQEDFI

SEQ ID NO: 26914 - protein, 10 aa, Neisseria
YHPKDYIDAL

SEQ ID NO: 26915 - protein, 13 aa, Neisseria
WQKEENPAAKDAM

SEQ ID NO: 26916 - protein, 16 aa, Neisseria
SRMCAENNRPICQDTG

SEQ ID NO: 26917 - protein, 26 aa, Neisseria
MSVEKMVNEGVRRAYTWEGNTLRASV

SEQ ID NO: 26918 - protein, 13 aa, Neisseria
DPAGKRQNTKDNT

SEQ ID NO: 26919 - protein, 7 aa, Neisseria
PGGKVEV

SEQ ID NO: 26920 - protein, 12 aa, Neisseria
AKGGGSENKSKL

SEQ ID NO: 26921 - protein, 6 aa, Neisseria
NPSDNI

SEQ ID NO: 26922 - protein, 17 aa, Neisseria
GIGGTPEKAVLMAKESL

SEQ ID NO: 26923 - protein, 17 aa, Neisseria
DIQELQEKAASGAELST

SEQ ID NO: 26924 - protein, 48 aa, Neisseria
  VARIANT (1)...(48): Xaa is any amino acid
RHVEFELDGSGPVELTPPRVEDXPDLTYSPDNGKRVDVDKLTKEEVAS

SEQ ID NO: 26925 - protein, 4 aa, Neisseria
KTGD

SEQ ID NO: 26926 - protein, 11 aa, Neisseria
LTGRDAAHKRL

SEQ ID NO: 26927 - protein, 8 aa, Neisseria
LDKGEELP

SEQ ID NO: 26928 - protein, 29 aa, Neisseria
PVDPVGDEVVGPAGPTTATRMDKFTRQML

SEQ ID NO: 26929 - protein, 10 aa, Neisseria
IGKSERGAAT

SEQ ID NO: 26930 - protein, 7 aa, Neisseria
AIADNKA

SEQ ID NO: 26931 - protein, 6 aa, Neisseria
AIKSSK

SEQ ID NO: 26932 - protein, 7 aa, Neisseria
FEVKDMP

SEQ ID NO: 26933 - protein, 8 aa, Neisseria
VDSKGESI

SEQ ID NO: 26934 - protein, 7 aa, Neisseria
APRKWQA

SEQ ID NO: 26935 - protein, 7 aa, Neisseria
IKQEDFI

SEQ ID NO: 26936 - protein, 13 aa, Neisseria
WQKEENPAAKDAM

SEQ ID NO: 26937 - protein, 10 aa, Neisseria
MCAENNRPIC

SEQ ID NO: 26938 - protein, 13 aa, Neisseria
MSVEKMVNEGVRR

SEQ ID NO: 26939 - protein, 12 aa, Neisseria
PAGKRQNTKDNT

SEQ ID NO: 26940 - protein, 5 aa, Neisseria
GKVEV

SEQ ID NO: 26941 - protein, 12 aa, Neisseria
AKGGGSENKSKL

SEQ ID NO: 26942 - protein, 14 aa, Neisseria
GTPEKAVLMAKESL

SEQ ID NO: 26943 - protein, 11 aa, Neisseria
DIQELQEKAAS

SEQ ID NO: 26944 - protein, 5 aa, Neisseria
AELST

SEQ ID NO: 26945 - protein, 9 aa, Neisseria
RHVEFELDG

SEQ ID NO: 26946 - protein, 10 aa, Neisseria
  VARIANT 8: Xaa is any amino acid
TPPRVEDXPD

SEQ ID NO: 26947 - protein, 19 aa, Neisseria
PDNGKRVDVDKLTKEEVAS

SEQ ID NO: 26948 - protein, 11 aa, Neisseria
LTGRDAAHKRL

SEQ ID NO: 26949 - protein, 8 aa, Neisseria
LDKGEELP

SEQ ID NO: 26950 - protein, 7 aa, Neisseria
PVGDEVV

SEQ ID NO: 26951 - protein, 11 aa, Neisseria
TRMDKFTRQML

SEQ ID NO: 26952 - protein, 9 aa, Neisseria
GKSERGAAT

SEQ ID NO: 26953 - protein, 7 aa, Neisseria
AIADNKA

SEQ ID NO: 26954 - protein, 6 aa, Neisseria
AIKSSK

SEQ ID NO: 26955 - protein, 7 aa, Neisseria
FEVKDMP

SEQ ID NO: 26956 - protein, 8 aa, Neisseria
VDSKGESI

SEQ ID NO: 26957 - protein, 7 aa, Neisseria
APRKWQA

SEQ ID NO: 26958 - protein, 12 aa, Neisseria
APCFKGCEPTGD

SEQ ID NO: 26959 - protein, 18 aa, Neisseria
AKASKSATSPKGLDGVSK

SEQ ID NO: 26960 - protein, 9 aa, Neisseria
TAAFHSFIS

SEQ ID NO: 26961 - protein, 8 aa, Neisseria
MPNLVTML

SEQ ID NO: 26962 - protein, 7 aa, Neisseria
VAEETEI

SEQ ID NO: 26963 - protein, 21 aa, Neisseria
CFKGCEPTGDSRLLSTTKSAP

SEQ ID NO: 26964 - protein, 25 aa, Neisseria
CANSAKASKSATSPKGLDGVSKNSS

SEQ ID NO: 26965 - protein, 10 aa, Neisseria
SVGDTRLTPM

SEQ ID NO: 26966 - protein, 23 aa, Neisseria
VVPNRLRLETTWSPACRKVKNAA

SEQ ID NO: 26967 - protein, 7 aa, Neisseria
VAEETEI

SEQ ID NO: 26968 - protein, 11 aa, Neisseria
KGCEPTGDSRL

SEQ ID NO: 26969 - protein, 5 aa, Neisseria
TKSAP

SEQ ID NO: 26970 - protein, 22 aa, Neisseria
NSAKASKSATSPKGLDGVSKNS

SEQ ID NO: 26971 - protein, 5 aa, Neisseria
GDTRL

SEQ ID NO: 26972 - protein, 5 aa, Neisseria
NRLRL

SEQ ID NO: 26973 - protein, 9 aa, Neisseria
ACRKVKNAA

SEQ ID NO: 26974 - protein, 17 aa, Neisseria
KSAAKTPTTIQPASIPS

SEQ ID NO: 26975 - protein, 8 aa, Neisseria
APYLRQVL

SEQ ID NO: 26976 - protein, 6 aa, Neisseria
FKKCLA

SEQ ID NO: 26977 - protein, 6 aa, Neisseria
FRRPPN

SEQ ID NO: 26978 - protein, 22 aa, Neisseria
VADFFQTCVNRFFEVVEIIGIG

SEQ ID NO: 26979 - protein, 11 aa, Neisseria
ENTKSAAKTPT

SEQ ID NO: 26980 - protein, 6 aa, Neisseria
QPASIP

SEQ ID NO: 26981 - protein, 5 aa, Neisseria
AKASG

SEQ ID NO: 26982 - protein, 21 aa, Neisseria
EFFRRPPNIRKSVFQKSEYDK

SEQ ID NO: 26983 - protein, 9 aa, Neisseria
ENTKSAAKT

SEQ ID NO: 26984 - protein, 5 aa, Neisseria
AKASG

SEQ ID NO: 26985 - protein, 21 aa, Neisseria
EFFRRPPNIRKSVFQKSEYDK

SEQ ID NO: 26986 - protein, 8 aa, Neisseria
EAMERLTR

SEQ ID NO: 26987 - protein, 6 aa, Neisseria
FPDTVE

SEQ ID NO: 26988 - protein, 8 aa, Neisseria
PVARWGDH

SEQ ID NO: 26989 - protein, 15 aa, Neisseria
SAEMLRRYDEFSTVL

SEQ ID NO: 26990 - protein, 12 aa, Neisseria
KRLRLFTEAWQH

SEQ ID NO: 26991 - protein, 12 aa, Neisseria
MWDNAEAMERLT

SEQ ID NO: 26992 - protein, 6 aa, Neisseria
NSNHLP

SEQ ID NO: 26993 - protein, 5 aa, Neisseria
VSLKG

SEQ ID NO: 26994 - protein, 7 aa, Neisseria
YSDKKAL

SEQ ID NO: 26995 - protein, 15 aa, Neisseria
NILRTDINGAQEAYR

SEQ ID NO: 26996 - protein, 11 aa, Neisseria
MVRRRFPDTVE

SEQ ID NO: 26997 - protein, 11 aa, Neisseria
LTERKPVARWG

SEQ ID NO: 26998 - protein, 10 aa, Neisseria
ALVDGEGNVF

SEQ ID NO: 26999 - protein, 9 aa, Neisseria
ARLDRPGMP

SEQ ID NO: 27000 - protein, 7 aa, Neisseria
RGAEGTS

SEQ ID NO: 27001 - protein, 8 aa, Neisseria
EMLRRYDE

SEQ ID NO: 27002 - protein, 5 aa, Neisseria
LGIKE

SEQ ID NO: 27003 - protein, 5 aa, Neisseria
LDNGI

SEQ ID NO: 27004 - protein, 13 aa, Neisseria
RLGRENEMKRLRL

SEQ ID NO: 27005 - protein, 10 aa, Neisseria
LLRKNKNRLS

SEQ ID NO: 27006 - protein, 9 aa, Neisseria
MRYKDGFSV

SEQ ID NO: 27007 - protein, 13 aa, Neisseria
HAPDGLPEKESEE

SEQ ID NO: 27008 - protein, 10 aa, Neisseria
DNAEAMERLT

SEQ ID NO: 27009 - protein, 7 aa, Neisseria
YSDKKAL

SEQ ID NO: 27010 - protein, 13 aa, Neisseria
LRTDINGAQEAYR

SEQ ID NO: 27011 - protein, 10 aa, Neisseria
MVRRRFPDTV

SEQ ID NO: 27012 - protein, 11 aa, Neisseria
LTERKPVARWG

SEQ ID NO: 27013 - protein, 10 aa, Neisseria
ALVDGEGNVF

SEQ ID NO: 27014 - protein, 7 aa, Neisseria
ARLDRPG

SEQ ID NO: 27015 - protein, 7 aa, Neisseria
RGAEGTS

SEQ ID NO: 27016 - protein, 8 aa, Neisseria
EMLRRYDE

SEQ ID NO: 27017 - protein, 5 aa, Neisseria
LGIKE

SEQ ID NO: 27018 - protein, 13 aa, Neisseria
RLGRENEMKRLRL

SEQ ID NO: 27019 - protein, 9 aa, Neisseria
LRKNKNRLS

SEQ ID NO: 27020 - protein, 8 aa, Neisseria
MRYKDGFS

SEQ ID NO: 27021 - protein, 13 aa, Neisseria
HAPDGLPEKESEE

SEQ ID NO: 27022 - protein, 14 aa, Neisseria
KPVSRIVTDSRDIR

SEQ ID NO: 27023 - protein, 6 aa, Neisseria
VGGVLS

SEQ ID NO: 27024 - protein, 6 aa, Neisseria
ALKVDD

SEQ ID NO: 27025 - protein, 14 aa, Neisseria
LAALQTLAKAWRDN

SEQ ID NO: 27026 - protein, 9 aa, Neisseria
KEMLAAVLR

SEQ ID NO: 27027 - protein, 5 aa, Neisseria
DAVSA

SEQ ID NO: 27028 - protein, 15 aa, Neisseria
MNHFGELAVLTQIAK

SEQ ID NO: 27029 - protein, 5 aa, Neisseria
NNALR

SEQ ID NO: 27030 - protein, 9 aa, Neisseria
DGVGDIAKA

SEQ ID NO: 27031 - protein, 13 aa, Neisseria
LNDVAEGLQGFSN

SEQ ID NO: 27032 - protein, 10 aa, Neisseria
AAVDVLARMP

SEQ ID NO: 27033 - protein, 10 aa, Neisseria
VMGDMGELGE

SEQ ID NO: 27034 - protein, 5 aa, Neisseria
VEAAE

SEQ ID NO: 27035 - protein, 11 aa, Neisseria
LPMPSENKPVS

SEQ ID NO: 27036 - protein, 12 aa, Neisseria
IVTDSRDIREGD

SEQ ID NO: 27037 - protein, 7 aa, Neisseria
AGGRFDA

SEQ ID NO: 27038 - protein, 7 aa, Neisseria
VSREDCA

SEQ ID NO: 27039 - protein, 7 aa, Neisseria
LKVDDTL

SEQ ID NO: 27040 - protein, 9 aa, Neisseria
AWRDNVNPF

SEQ ID NO: 27041 - protein, 12 aa, Neisseria
GSGGKTTVKEML

SEQ ID NO: 27042 - protein, 10 aa, Neisseria
LRRRFGDDAV

SEQ ID NO: 27043 - protein, 6 aa, Neisseria
NFNNHI

SEQ ID NO: 27044 - protein, 7 aa, Neisseria
KLNEKHR

SEQ ID NO: 27045 - protein, 5 aa, Neisseria
AKPDA

SEQ ID NO: 27046 - protein, 17 aa, Neisseria
GCGFDGVGDIAKAKSEI

SEQ ID NO: 27047 - protein, 6 aa, Neisseria
PQEDAN

SEQ ID NO: 27048 - protein, 13 aa, Neisseria
GVDSGDVRAENIV

SEQ ID NO: 27049 - protein, 7 aa, Neisseria
CGDERTA

SEQ ID NO: 27050 - protein, 7 aa, Neisseria
VPGRHNV

SEQ ID NO: 27051 - protein, 9 aa, Neisseria
SNIKGRLNV

SEQ ID NO: 27052 - protein, 18 aa, Neisseria
TLIDDTYNANPDSMKAAV

SEQ ID NO: 27053 - protein, 11 aa, Neisseria
DMGELGEDEAA

SEQ ID NO: 27054 - protein, 8 aa, Neisseria
AYARDQGI

SEQ ID NO: 27055 - protein, 13 aa, Neisseria
GDNSVEAAEKFGA

SEQ ID NO: 27056 - protein, 8 aa, Neisseria
DLPERATV

SEQ ID NO: 27057 - protein, 5 aa, Neisseria
VKGSR

SEQ ID NO: 27058 - protein, 10 aa, Neisseria
EEVVEALEDK

SEQ ID NO: 27059 - protein, 9 aa, Neisseria
MPSENKPVS

SEQ ID NO: 27060 - protein, 12 aa, Neisseria
IVTDSRDIREGD

SEQ ID NO: 27061 - protein, 5 aa, Neisseria
GRFDA

SEQ ID NO: 27062 - protein, 7 aa, Neisseria
VSREDCA

SEQ ID NO: 27063 - protein, 7 aa, Neisseria
LKVDDTL

SEQ ID NO: 27064 - protein, 6 aa, Neisseria
AWRDNV

SEQ ID NO: 27065 - protein, 11 aa, Neisseria
SGGKTTVKEML

SEQ ID NO: 27066 - protein, 10 aa, Neisseria
LRRRFGDDAV

SEQ ID NO: 27067 - protein, 7 aa, Neisseria
KLNEKHR

SEQ ID NO: 27068 - protein, 5 aa, Neisseria
AKPDA

SEQ ID NO: 27069 - protein, 12 aa, Neisseria
GVGDIAKAKSEI

SEQ ID NO: 27070 - protein, 6 aa, Neisseria
PQEDAN

SEQ ID NO: 27071 - protein, 11 aa, Neisseria
DSGDVRAENIV

SEQ ID NO: 27072 - protein, 7 aa, Neisseria
CGDERTA

SEQ ID NO: 27073 - protein, 7 aa, Neisseria
IKGRLNV

SEQ ID NO: 27074 - protein, 13 aa, Neisseria
TYNANPDSMKAAV

SEQ ID NO: 27075 - protein, 11 aa, Neisseria
DMGELGEDEAA

SEQ ID NO: 27076 - protein, 8 aa, Neisseria
AYARDQGI

SEQ ID NO: 27077 - protein, 11 aa, Neisseria
NSVEAAEKFGA

SEQ ID NO: 27078 - protein, 8 aa, Neisseria
DLPERATV

SEQ ID NO: 27079 - protein, 10 aa, Neisseria
EEVVEALEDK

SEQ ID NO: 27080 - protein, 14 aa, Neisseria
RIKNMDQTLKNTLG

SEQ ID NO: 27081 - protein, 5 aa, Neisseria
CALLA

SEQ ID NO: 27082 - protein, 6 aa, Neisseria
AVGALA

SEQ ID NO: 27083 - protein, 5 aa, Neisseria
FPRVS

SEQ ID NO: 27084 - protein, 9 aa, Neisseria
QIVGSILES

SEQ ID NO: 27085 - protein, 8 aa, Neisseria
EFVGNLPG

SEQ ID NO: 27086 - protein, 17 aa, Neisseria
MKQSARIKNMDQTLKNT

SEQ ID NO: 27087 - protein, 8 aa, Neisseria
YEYGYRYS

SEQ ID NO: 27088 - protein, 13 aa, Neisseria
LESNPAEAREFVG

SEQ ID NO: 27089 - protein, 14 aa, Neisseria
MKQSARIKNMDQTL

SEQ ID NO: 27090 - protein, 9 aa, Neisseria
NPAEAREFV

SEQ ID NO: 27091 - protein, 13 aa, Neisseria
ERVAQIGKMFDGL

SEQ ID NO: 27092 - protein, 10 aa, Neisseria
LKDALDNGFD

SEQ ID NO: 27093 - protein, 15 aa, Neisseria
NGGRVLGDIELLADI

SEQ ID NO: 27094 - protein, 6 aa, Neisseria
TSLVGY

SEQ ID NO: 27095 - protein, 7 aa, Neisseria
IAGNIGT

SEQ ID NO: 27096 - protein, 6 aa, Neisseria
ENTESL

SEQ ID NO: 27097 - protein, 13 aa, Neisseria
EDHLDRYDDLLDY

SEQ ID NO: 27098 - protein, 5 aa, Neisseria
GDGVQ

SEQ ID NO: 27099 - protein, 12 aa, Neisseria
FCRAMKRAGREV

SEQ ID NO: 27100 - protein, 15 aa, Neisseria
HNAANVMAAVALCEA

SEQ ID NO: 27101 - protein, 16 aa, Neisseria
HVKTFQGLPHRVEKIG

SEQ ID NO: 27102 - protein, 6 aa, Neisseria
AAIAGL

SEQ ID NO: 27103 - protein, 7 aa, Neisseria
GKGQDFT

SEQ ID NO: 27104 - protein, 12 aa, Neisseria
TDCVTLEEAVQT

SEQ ID NO: 27105 - protein, 8 aa, Neisseria
SFDMFKGY

SEQ ID NO: 27106 - protein, 6 aa, Neisseria
QNKKIL

SEQ ID NO: 27107 - protein, 23 aa, Neisseria
YLRKNGAEVAAYDAELKAERVAQ

SEQ ID NO: 27108 - protein, 11 aa, Neisseria
GRLKDALDNGF

SEQ ID NO: 27109 - protein, 23 aa, Neisseria
SPGISERQPDIEAFKQNGGRVLG

SEQ ID NO: 27110 - protein, 9 aa, Neisseria
IVNRRGDKV

SEQ ID NO: 27111 - protein, 8 aa, Neisseria
TGSNGKTT

SEQ ID NO: 27112 - protein, 13 aa, Neisseria
LEAELQREGKKAD

SEQ ID NO: 27113 - protein, 15 aa, Neisseria
SSFQLENTESLRPTA

SEQ ID NO: 27114 - protein, 13 aa, Neisseria
ISEDHLDRYDDLL

SEQ ID NO: 27115 - protein, 13 aa, Neisseria
AHTKAEIFRGDGV

SEQ ID NO: 27116 - protein, 6 aa, Neisseria
NADDVF

SEQ ID NO: 27117 - protein, 18 aa, Neisseria
AMKRAGREVKRFSLEHEA

SEQ ID NO: 27118 - protein, 20 aa, Neisseria
RGTGCLKQGNEDLISTQDIP

SEQ ID NO: 27119 - protein, 7 aa, Neisseria
GLPREAL

SEQ ID NO: 27120 - protein, 13 aa, Neisseria
LPHRVEKIGEKNG

SEQ ID NO: 27121 - protein, 10 aa, Neisseria
FIDDSKGTNV

SEQ ID NO: 27122 - protein, 20 aa, Neisseria
GMGKGQDFTPLRDALKDKAK

SEQ ID NO: 27123 - protein, 13 aa, Neisseria
DAPQIRRDLDGCG

SEQ ID NO: 27124 - protein, 7 aa, Neisseria
VTLEEAV

SEQ ID NO: 27125 - protein, 5 aa, Neisseria
YAHRS

SEQ ID NO: 27126 - protein, 6 aa, Neisseria
QNKKIL

SEQ ID NO: 27127 - protein, 6 aa, Neisseria
RKNGAE

SEQ ID NO: 27128 - protein, 14 aa, Neisseria
AAYDAELKAERVAQ

SEQ ID NO: 27129 - protein, 10 aa, Neisseria
RLKDALDNGF

SEQ ID NO: 27130 - protein, 16 aa, Neisseria
ISERQPDIEAFKQNGG

SEQ ID NO: 27131 - protein, 9 aa, Neisseria
IVNRRGDKV

SEQ ID NO: 27132 - protein, 6 aa, Neisseria
SNGKTT

SEQ ID NO: 27133 - protein, 13 aa, Neisseria
LEAELQREGKKAD

SEQ ID NO: 27134 - protein, 8 aa, Neisseria
ENTESLRP

SEQ ID NO: 27135 - protein, 13 aa, Neisseria
ISEDHLDRYDDLL

SEQ ID NO: 27136 - protein, 12 aa, Neisseria
AHTKAEIFRGDG

SEQ ID NO: 27137 - protein, 18 aa, Neisseria
AMKRAGREVKRFSLEHEA

SEQ ID NO: 27138 - protein, 15 aa, Neisseria
RGTGCLKQGNEDLIS

SEQ ID NO: 27139 - protein, 7 aa, Neisseria
GLPREAL

SEQ ID NO: 27140 - protein, 11 aa, Neisseria
HRVEKIGEKNG

SEQ ID NO: 27141 - protein, 7 aa, Neisseria
DDSKGTN

SEQ ID NO: 27142 - protein, 5 aa, Neisseria
GKGQD

SEQ ID NO: 27143 - protein, 12 aa, Neisseria
TPLRDALKDKAK

SEQ ID NO: 27144 - protein, 9 aa, Neisseria
PQIRRDLDG

SEQ ID NO: 27145 - protein, 7 aa, Neisseria
VTLEEAV

SEQ ID NO: 27146 - protein, 5 aa, Neisseria
YAHRS

SEQ ID NO: 27147 - protein, 9 aa, Neisseria
MRTWRRLVP

SEQ ID NO: 27148 - protein, 6 aa, Neisseria
INGATR

SEQ ID NO: 27149 - protein, 9 aa, Neisseria
PTELFKLAV

SEQ ID NO: 27150 - protein, 20 aa, Neisseria
EVLRSMESLGWQSIWRGTAN

SEQ ID NO: 27151 - protein, 6 aa, Neisseria
EMYGRF

SEQ ID NO: 27152 - protein, 5 aa, Neisseria
SFVVI

SEQ ID NO: 27153 - protein, 16 aa, Neisseria
RVQRVVAFLDPWKDPQ

SEQ ID NO: 27154 - protein, 6 aa, Neisseria
GFFGMC

SEQ ID NO: 27155 - protein, 7 aa, Neisseria
WIGIQSF

SEQ ID NO: 27156 - protein, 8 aa, Neisseria
LASKEGGD

SEQ ID NO: 27157 - protein, 7 aa, Neisseria
RMRTWRR

SEQ ID NO: 27158 - protein, 8 aa, Neisseria
AGREINGA

SEQ ID NO: 27159 - protein, 12 aa, Neisseria
FTRREEVLRSME

SEQ ID NO: 27160 - protein, 5 aa, Neisseria
WRGTA

SEQ ID NO: 27161 - protein, 13 aa, Neisseria
ATNPQARRETLEM

SEQ ID NO: 27162 - protein, 5 aa, Neisseria
APYRV

SEQ ID NO: 27163 - protein, 10 aa, Neisseria
LDPWKDPQGA

SEQ ID NO: 27164 - protein, 12 aa, Neisseria
GLGASLSKRGFL

SEQ ID NO: 27165 - protein, 10 aa, Neisseria
SIGKQSRDLG

SEQ ID NO: 27166 - protein, 6 aa, Neisseria
LPTKGL

SEQ ID NO: 27167 - protein, 15 aa, Neisseria
IDYENRQKMRGYRVE

SEQ ID NO: 27168 - protein, 7 aa, Neisseria
ASKEGGD

SEQ ID NO: 27169 - protein, 7 aa, Neisseria
AGREING

SEQ ID NO: 27170 - protein, 12 aa, Neisseria
FTRREEVLRSME

SEQ ID NO: 27171 - protein, 10 aa, Neisseria
PQARRETLEM

SEQ ID NO: 27172 - protein, 7 aa, Neisseria
PWKDPQG

SEQ ID NO: 27173 - protein, 7 aa, Neisseria
LSKRGFL

SEQ ID NO: 27174 - protein, 6 aa, Neisseria
KQSRDL

SEQ ID NO: 27175 - protein, 15 aa, Neisseria
IDYENRQKMRGYRVE

SEQ ID NO: 27176 - protein, 10 aa, Neisseria
KTVREAQRII

SEQ ID NO: 27177 - protein, 17 aa, Neisseria
GFGGFVTFPGGLAAKLL

SEQ ID NO: 27178 - protein, 20 aa, Neisseria
GLSNRHLSRWAKRVLYAFPK

SEQ ID NO: 27179 - protein, 6 aa, Neisseria
VGNPVR

SEQ ID NO: 27180 - protein, 9 aa, Neisseria
GADVLNKTV

SEQ ID NO: 27181 - protein, 11 aa, Neisseria
VEFITDMVSAY

SEQ ID NO: 27182 - protein, 8 aa, Neisseria
EKLAEILG

SEQ ID NO: 27183 - protein, 5 aa, Neisseria
WAENA

SEQ ID NO: 27184 - protein, 7 aa, Neisseria
DSLRVRG

SEQ ID NO: 27185 - protein, 17 aa, Neisseria
LGSKDSMEERIVPQYGI

SEQ ID NO: 27186 - protein, 12 aa, Neisseria
KGIRGNGIKRKL

SEQ ID NO: 27187 - protein, 15 aa, Neisseria
KTVREAQRIIRKHRV

SEQ ID NO: 27188 - protein, 11 aa, Neisseria
LSNRHLSRWAK

SEQ ID NO: 27189 - protein, 7 aa, Neisseria
FSHEGGL

SEQ ID NO: 27190 - protein, 8 aa, Neisseria
NPVRADIS

SEQ ID NO: 27191 - protein, 12 aa, Neisseria
PAERFQGREGRL

SEQ ID NO: 27192 - protein, 6 aa, Neisseria
VLNKTV

SEQ ID NO: 27193 - protein, 19 aa, Neisseria
LPEEVRPQMYHQSGRNKLG

SEQ ID NO: 27194 - protein, 5 aa, Neisseria
ADYDA

SEQ ID NO: 27195 - protein, 6 aa, Neisseria
GVKAEC

SEQ ID NO: 27196 - protein, 7 aa, Neisseria
SAYRDAD

SEQ ID NO: 27197 - protein, 8 aa, Neisseria
AVDDHQTA

SEQ ID NO: 27198 - protein, 9 aa, Neisseria
QLTAEKLAE

SEQ ID NO: 27199 - protein, 9 aa, Neisseria
SLNREKCLK

SEQ ID NO: 27200 - protein, 5 aa, Neisseria
ENART

SEQ ID NO: 27201 - protein, 8 aa, Neisseria
HSADDVAE

SEQ ID NO: 27202 - protein, 7 aa, Neisseria
DSLRVRG

SEQ ID NO: 27203 - protein, 10 aa, Neisseria
SKDSMEERIV

SEQ ID NO: 27204 - protein, 7 aa, Neisseria
NGIKRKL

SEQ ID NO: 27205 - protein, 14 aa, Neisseria
TVREAQRIIRKHRV

SEQ ID NO: 27206 - protein, 7 aa, Neisseria
HLSRWAK

SEQ ID NO: 27207 - protein, 5 aa, Neisseria
VRADI

SEQ ID NO: 27208 - protein, 12 aa, Neisseria
PAERFQGREGRL

SEQ ID NO: 27209 - protein, 7 aa, Neisseria
LPEEVRP

SEQ ID NO: 27210 - protein, 6 aa, Neisseria
SGRNKL

SEQ ID NO: 27211 - protein, 6 aa, Neisseria
GVKAEC

SEQ ID NO: 27212 - protein, 7 aa, Neisseria
SAYRDAD

SEQ ID NO: 27213 - protein, 8 aa, Neisseria
AVDDHQTA

SEQ ID NO: 27214 - protein, 8 aa, Neisseria
LTAEKLAE

SEQ ID NO: 27215 - protein, 8 aa, Neisseria
LNREKCLK

SEQ ID NO: 27216 - protein, 8 aa, Neisseria
HSADDVAE

SEQ ID NO: 27217 - protein, 16 aa, Neisseria
HFSNWLTGLNIFQYTT

SEQ ID NO: 27218 - protein, 7 aa, Neisseria
RAVMAAL

SEQ ID NO: 27219 - protein, 12 aa, Neisseria
TIRRLTALKCGQ

SEQ ID NO: 27220 - protein, 7 aa, Neisseria
LWGNWAN

SEQ ID NO: 27221 - protein, 11 aa, Neisseria
GFYDDWRKVVY

SEQ ID NO: 27222 - protein, 8 aa, Neisseria
AVIAGLAL

SEQ ID NO: 27223 - protein, 10 aa, Neisseria
GFLVLSYLTI

SEQ ID NO: 27224 - protein, 16 aa, Neisseria
TSNAVNLTDGLDGLAA

SEQ ID NO: 27225 - protein, 12 aa, Neisseria
HYQFSQYLQLPY

SEQ ID NO: 27226 - protein, 10 aa, Neisseria
TAMCGACLGF

SEQ ID NO: 27227 - protein, 15 aa, Neisseria
TALKCGQAVRTDGPQ

SEQ ID NO: 27228 - protein, 8 aa, Neisseria
VKNGTPTM

SEQ ID NO: 27229 - protein, 18 aa, Neisseria
DDWRKVVYKDPNGVSAKF

SEQ ID NO: 27230 - protein, 6 aa, Neisseria
LTDGLD

SEQ ID NO: 27231 - protein, 7 aa, Neisseria
KKTKKRI

SEQ ID NO: 27232 - protein, 11 aa, Neisseria
YEQKGWKETQV

SEQ ID NO: 27233 - protein, 7 aa, Neisseria
VRTDGPQ

SEQ ID NO: 27234 - protein, 14 aa, Neisseria
DDWRKVVYKDPNGV

SEQ ID NO: 27235 - protein, 7 aa, Neisseria
KKTKKRI

SEQ ID NO: 27236 - protein, 5 aa, Neisseria
KGWKE

SEQ ID NO: 27237 - protein, 12 aa, Neisseria
FSTRCGKPWKVL

SEQ ID NO: 27238 - protein, 13 aa, Neisseria
LAALCKPCSGMSC

SEQ ID NO: 27239 - protein, 5 aa, Neisseria
RPARF

SEQ ID NO: 27240 - protein, 10 aa, Neisseria
MPPKITKSGF

SEQ ID NO: 27241 - protein, 10 aa, Neisseria
FSTRCGKPWK

SEQ ID NO: 27242 - protein, 16 aa, Neisseria
CSSNASRGKPTASHKA

SEQ ID NO: 27243 - protein, 9 aa, Neisseria
LCKPCSGMS

SEQ ID NO: 27244 - protein, 58 aa, Neisseria
VEIKSSLPCFKQPVPRSNQKSASCSKENRFTSRPARFMARQNTSSAFKTCTPSPRKIS

SEQ ID NO: 27245 - protein, 5 aa, Neisseria
RCGKP

SEQ ID NO: 27246 - protein, 13 aa, Neisseria
NASRGKPTASHKA

SEQ ID NO: 27247 - protein, 5 aa, Neisseria
VEIKS

SEQ ID NO: 27248 - protein, 27 aa, Neisseria
PVPRSNQKSASCSKENRFTSRPARFMA

SEQ ID NO: 27249 - protein, 8 aa, Neisseria
TPSPRKIS

SEQ ID NO: 27250 - protein, 12 aa, Neisseria
SQSLKRFDKHFR

SEQ ID NO: 27251 - protein, 6 aa, Neisseria
RLNRLF

SEQ ID NO: 27252 - protein, 6 aa, Neisseria
DAVGQV

SEQ ID NO: 27253 - protein, 6 aa, Neisseria
FAVVDE

SEQ ID NO: 27254 - protein, 10 aa, Neisseria
ADFFHTVRQA

SEQ ID NO: 27255 - protein, 11 aa, Neisseria
EGFDVFQQCFA

SEQ ID NO: 27256 - protein, 7 aa, Neisseria
QTDGLAQ

SEQ ID NO: 27257 - protein, 10 aa, Neisseria
VGGVVQTLQR

SEQ ID NO: 27258 - protein, 10 aa, Neisseria
VVRIQNLHSI

SEQ ID NO: 27259 - protein, 5 aa, Neisseria
VVEQI

SEQ ID NO: 27260 - protein, 11 aa, Neisseria
ETVVQRIFQTT

SEQ ID NO: 27261 - protein, 9 aa, Neisseria
PVKHLTDLR

SEQ ID NO: 27262 - protein, 20 aa, Neisseria
NLRAVFAQIGNHGNTRAAKS

SEQ ID NO: 27263 - protein, 14 aa, Neisseria
TASQSLKRFDKHFR

SEQ ID NO: 27264 - protein, 15 aa, Neisseria
HIETRAGGAEQDNIA

SEQ ID NO: 27265 - protein, 11 aa, Neisseria
RLNRLFQSDAV

SEQ ID NO: 27266 - protein, 12 aa, Neisseria
ADLRRIDADQEH

SEQ ID NO: 27267 - protein, 6 aa, Neisseria
AQGREV

SEQ ID NO: 27268 - protein, 21 aa, Neisseria
QNHEERVLQTGNRGGGRADIR

SEQ ID NO: 27269 - protein, 6 aa, Neisseria
QALEGF

SEQ ID NO: 27270 - protein, 19 aa, Neisseria
FARQTDGLAQSHGSHNVGG

SEQ ID NO: 27271 - protein, 11 aa, Neisseria
TLQRDVLRRNQ

SEQ ID NO: 27272 - protein, 8 aa, Neisseria
TARPAFQP

SEQ ID NO: 27273 - protein, 12 aa, Neisseria
FQGKPFHFTPCP

SEQ ID NO: 27274 - protein, 10 aa, Neisseria
VHHRRRSRAQ

SEQ ID NO: 27275 - protein, 6 aa, Neisseria
EAGKLQ

SEQ ID NO: 27276 - protein, 16 aa, Neisseria
LQNRRTDIARNDGIQP

SEQ ID NO: 27277 - protein, 13 aa, Neisseria
LDAEIADQARYRG

SEQ ID NO: 27278 - protein, 6 aa, Neisseria
AGNRNH

SEQ ID NO: 27279 - protein, 5 aa, Neisseria
VRQQF

SEQ ID NO: 27280 - protein, 5 aa, Neisseria
ERLDI

SEQ ID NO: 27281 - protein, 9 aa, Neisseria
DAGTERQNI

SEQ ID NO: 27282 - protein, 10 aa, Neisseria
QTTRVKHQPV

SEQ ID NO: 27283 - protein, 7 aa, Neisseria
HLTDLRH

SEQ ID NO: 27284 - protein, 5 aa, Neisseria
ISGNL

SEQ ID NO: 27285 - protein, 16 aa, Neisseria
NHGNTRAAKSGDEDFF

SEQ ID NO: 27286 - protein, 13 aa, Neisseria
ASQSLKRFDKHFR

SEQ ID NO: 27287 - protein, 15 aa, Neisseria
HIETRAGGAEQDNIA

SEQ ID NO: 27288 - protein, 12 aa, Neisseria
ADLRRIDADQEH

SEQ ID NO: 27289 - protein, 6 aa, Neisseria
AQGREV

SEQ ID NO: 27290 - protein, 8 aa, Neisseria
QNHEERVL

SEQ ID NO: 27291 - protein, 11 aa, Neisseria
GNRGGGRADIR

SEQ ID NO: 27292 - protein, 7 aa, Neisseria
RQTDGLA

SEQ ID NO: 27293 - protein, 10 aa, Neisseria
LQRDVLRRNQ

SEQ ID NO: 27294 - protein, 8 aa, Neisseria
HHRRRSRA

SEQ ID NO: 27295 - protein, 6 aa, Neisseria
EAGKLQ

SEQ ID NO: 27296 - protein, 13 aa, Neisseria
QNRRTDIARNDGI

SEQ ID NO: 27297 - protein, 12 aa, Neisseria
LDAEIADQARYR

SEQ ID NO: 27298 - protein, 5 aa, Neisseria
ERLDI

SEQ ID NO: 27299 - protein, 8 aa, Neisseria
AGTERQNI

SEQ ID NO: 27300 - protein, 7 aa, Neisseria
TRVKHQP

SEQ ID NO: 27301 - protein, 5 aa, Neisseria
TDLRH

SEQ ID NO: 27302 - protein, 14 aa, Neisseria
GNTRAAKSGDEDFF

SEQ ID NO: 27303 - protein, 15 aa, Neisseria
KPLSDGIASRLITRL

SEQ ID NO: 27304 - protein, 11 aa, Neisseria
VLVSVLTSLAK

SEQ ID NO: 27305 - protein, 7 aa, Neisseria
VPPSPAT

SEQ ID NO: 27306 - protein, 18 aa, Neisseria
ILGRRRPPLPKPLSDGIA

SEQ ID NO: 27307 - protein, 8 aa, Neisseria
LLSERKVL

SEQ ID NO: 27308 - protein, 9 aa, Neisseria
ILGRRRPPL

SEQ ID NO: 27309 - protein, 8 aa, Neisseria
LLSERKVL

SEQ ID NO: 27310 - protein, 10 aa, Neisseria
GMSGIAEVLH

SEQ ID NO: 27311 - protein, 9 aa, Neisseria
ARNAATEHL

SEQ ID NO: 27312 - protein, 8 aa, Neisseria
HTAEHVNG

SEQ ID NO: 27313 - protein, 5 aa, Neisseria
ALERQ

SEQ ID NO: 27314 - protein, 8 aa, Neisseria
AELMRFRD

SEQ ID NO: 27315 - protein, 12 aa, Neisseria
LTPIMSVVTNID

SEQ ID NO: 27316 - protein, 19 aa, Neisseria
TYGHSVEKLHQAFIDFIHR

SEQ ID NO: 27317 - protein, 12 aa, Neisseria
VRAILPKVSKPY

SEQ ID NO: 27318 - protein, 8 aa, Neisseria
TYGLDDTA

SEQ ID NO: 27319 - protein, 9 aa, Neisseria
NVLNALAAI

SEQ ID NO: 27320 - protein, 7 aa, Neisseria
VEAIQKG

SEQ ID NO: 27321 - protein, 11 aa, Neisseria
GRRFQKYGDIK

SEQ ID NO: 27322 - protein, 22 aa, Neisseria
RYTRTRDLFEDFTKVLNTVDAL

SEQ ID NO: 27323 - protein, 11 aa, Neisseria
LARAIRVLGKL

SEQ ID NO: 27324 - protein, 13 aa, Neisseria
CENVADLPQMLMN

SEQ ID NO: 27325 - protein, 6 aa, Neisseria
ANGQTF

SEQ ID NO: 27326 - protein, 19 aa, Neisseria
TPLRTKNQPERNIMMKNRV

SEQ ID NO: 27327 - protein, 11 aa, Neisseria
VSGSDQARNAA

SEQ ID NO: 27328 - protein, 9 aa, Neisseria
AVKKENPEV

SEQ ID NO: 27329 - protein, 7 aa, Neisseria
AALERQI

SEQ ID NO: 27330 - protein, 7 aa, Neisseria
MRFRDGI

SEQ ID NO: 27331 - protein, 8 aa, Neisseria
GTHGKTTT

SEQ ID NO: 27332 - protein, 11 aa, Neisseria
GTNARLGKGEY

SEQ ID NO: 27333 - protein, 7 aa, Neisseria
EADESDA

SEQ ID NO: 27334 - protein, 11 aa, Neisseria
NIDEDHMDTYG

SEQ ID NO: 27335 - protein, 6 aa, Neisseria
SVEKLH

SEQ ID NO: 27336 - protein, 6 aa, Neisseria
VDSEHV

SEQ ID NO: 27337 - protein, 10 aa, Neisseria
ILPKVSKPYA

SEQ ID NO: 27338 - protein, 7 aa, Neisseria
GLDDTAD

SEQ ID NO: 27339 - protein, 7 aa, Neisseria
DIENVGA

SEQ ID NO: 27340 - protein, 9 aa, Neisseria
MKGHEQGSF

SEQ ID NO: 27341 - protein, 18 aa, Neisseria
GVGRRFQKYGDIKLPNGG

SEQ ID NO: 27342 - protein, 7 aa, Neisseria
DDYGHHP

SEQ ID NO: 27343 - protein, 7 aa, Neisseria
AYPEKRL

SEQ ID NO: 27344 - protein, 17 aa, Neisseria
QPHRYTRTRDLFEDFTK

SEQ ID NO: 27345 - protein, 17 aa, Neisseria
AAGEEPVAAADSRALAR

SEQ ID NO: 27346 - protein, 6 aa, Neisseria
LQDGDV

SEQ ID NO: 27347 - protein, 11 aa, Neisseria
GAGSINRVPSA

SEQ ID NO: 27348 - protein, 18 aa, Neisseria
PLRTKNQPERNIMMKNRV

SEQ ID NO: 27349 - protein, 10 aa, Neisseria
SGSDQARNAA

SEQ ID NO: 27350 - protein, 8 aa, Neisseria
AVKKENPE

SEQ ID NO: 27351 - protein, 7 aa, Neisseria
AALERQI

SEQ ID NO: 27352 - protein, 5 aa, Neisseria
MRFRD

SEQ ID NO: 27353 - protein, 5 aa, Neisseria
HGKTT

SEQ ID NO: 27354 - protein, 7 aa, Neisseria
ARLGKGE

SEQ ID NO: 27355 - protein, 7 aa, Neisseria
EADESDA

SEQ ID NO: 27356 - protein, 8 aa, Neisseria
NIDEDHMD

SEQ ID NO: 27357 - protein, 6 aa, Neisseria
SVEKLH

SEQ ID NO: 27358 - protein, 5 aa, Neisseria
DSEHV

SEQ ID NO: 27359 - protein, 7 aa, Neisseria
GLDDTAD

SEQ ID NO: 27360 - protein, 7 aa, Neisseria
KGHEQGS

SEQ ID NO: 27361 - protein, 8 aa, Neisseria
GVGRRFQK

SEQ ID NO: 27362 - protein, 5 aa, Neisseria
GDIKL

SEQ ID NO: 27363 - protein, 7 aa, Neisseria
AYPEKRL

SEQ ID NO: 27364 - protein, 14 aa, Neisseria
RYTRTRDLFEDFTK

SEQ ID NO: 27365 - protein, 17 aa, Neisseria
AAGEEPVAAADSRALAR

SEQ ID NO: 27366 - protein, 5 aa, Neisseria
QDGDV

SEQ ID NO: 27367 - protein, 5 aa, Neisseria
TAILN

SEQ ID NO: 27368 - protein, 8 aa, Neisseria
TAFNILHG

SEQ ID NO: 27369 - protein, 13 aa, Neisseria
GRLKSVYEELKHL

SEQ ID NO: 27370 - protein, 9 aa, Neisseria
IHIIPATEF

SEQ ID NO: 27371 - protein, 5 aa, Neisseria
FLKDT

SEQ ID NO: 27372 - protein, 9 aa, Neisseria
INTLPGMTG

SEQ ID NO: 27373 - protein, 15 aa, Neisseria
GGFSSEREISLDSGT

SEQ ID NO: 27374 - protein, 7 aa, Neisseria
LKSKGID

SEQ ID NO: 27375 - protein, 17 aa, Neisseria
AFDPKETPLSELKERGF

SEQ ID NO: 27376 - protein, 9 aa, Neisseria
GTYGEDGAV

SEQ ID NO: 27377 - protein, 7 aa, Neisseria
GMDKYRC

SEQ ID NO: 27378 - protein, 13 aa, Neisseria
DDTDFDAVEEKLG

SEQ ID NO: 27379 - protein, 7 aa, Neisseria
PAAEGSS

SEQ ID NO: 27380 - protein, 19 aa, Neisseria
KVKEKGRLKSVYEELKHLQ

SEQ ID NO: 27381 - protein, 9 aa, Neisseria
RFIGGGEYS

SEQ ID NO: 27382 - protein, 6 aa, Neisseria
NGKGLP

SEQ ID NO: 27383 - protein, 32 aa, Neisseria; identical to SEQ ID NO: 1127

SEQ ID NO: 27384 - protein, 6 aa, Neisseria
GAEGCV

SEQ ID NO: 27385 - protein, 8 aa, Neisseria
DFLKDTDG

SEQ ID NO: 27386 - protein, 6 aa, Neisseria
TLPGMT

SEQ ID NO: 27387 - protein, 6 aa, Neisseria
VPKSAA

SEQ ID NO: 27388 - protein, 8 aa, Neisseria
SSEREISL

SEQ ID NO: 27389 - protein, 7 aa, Neisseria
LKSKGID

SEQ ID NO: 27390 - protein, 17 aa, Neisseria
AFDPKETPLSELKERGF

SEQ ID NO: 27391 - protein, 7 aa, Neisseria
YGEDGAV

SEQ ID NO: 27392 - protein, 7 aa, Neisseria
GMDKYRC

SEQ ID NO: 27393 - protein, 13 aa, Neisseria
DDTDFDAVEEKLG

SEQ ID NO: 27394 - protein, 7 aa, Neisseria
PAAEGSS

SEQ ID NO: 27395 - protein, 19 aa, Neisseria
KVKEKGRLKSVYEELKHLQ

SEQ ID NO: 27396 - protein, 13 aa, Neisseria
YDYEAKYNRDDTI

SEQ ID NO: 27397 - protein, 14 aa, Neisseria
PSEDLTEAEESLMR

SEQ ID NO: 27398 - protein, 8 aa, Neisseria
DFLKDTDG

SEQ ID NO: 27399 - protein, 9 aa, Neisseria
LPPITKVGS

SEQ ID NO: 27400 - protein, 8 aa, Neisseria
RGITGICR

SEQ ID NO: 27401 - protein, 7 aa, Neisseria
FSFLTAV

SEQ ID NO: 27402 - protein, 7 aa, Neisseria
PLPKRAL

SEQ ID NO: 27403 - protein, 11 aa, Neisseria
GSSPAAPRMEA

SEQ ID NO: 27404 - protein, 8 aa, Neisseria
MPSRKRIS

SEQ ID NO: 27405 - protein, 6 aa, Neisseria
SIKARG

SEQ ID NO: 27406 - protein, 9 aa, Neisseria
CRSNAATTS

SEQ ID NO: 27407 - protein, 6 aa, Neisseria
LPKRAL

SEQ ID NO: 27408 - protein, 7 aa, Neisseria
AAPRMEA

SEQ ID NO: 27409 - protein, 7 aa, Neisseria
PSRKRIS

SEQ ID NO: 27410 - protein, 6 aa, Neisseria
SIKARG

SEQ ID NO: 27411 - protein, 20 aa, Neisseria
GGCISNLFRQFQQRGGNAVD

SEQ ID NO: 27412 - protein, 18 aa, Neisseria
  VARIANT 3: Xaa is any amino acid
ILXNIHQHLRQVGDVFAV

SEQ ID NO: 27413 - protein, 5 aa, Neisseria
YADST

SEQ ID NO: 27414 - protein, 22 aa, Neisseria
FGQYQRINGIEYFGKVFKQIAR

SEQ ID NO: 27415 - protein, 11 aa, Neisseria
KGCRHFDGVVS

SEQ ID NO: 27416 - protein, 24 aa, Neisseria
FLDRFNRCADFQRHADGCQCVQHV

SEQ ID NO: 27417 - protein, 5 aa, Neisseria
QHDFK

SEQ ID NO: 27418 - protein, 12 aa, Neisseria
DVGGIVQTVSSI

SEQ ID NO: 27419 - protein, 16 aa, Neisseria
TVDEIDKRLMQFFDAV

SEQ ID NO: 27420 - protein, 9 aa, Neisseria
NGDAVTEAH

SEQ ID NO: 27421 - protein, 6 aa, Neisseria
VNVFCG

SEQ ID NO: 27422 - protein, 13 aa, Neisseria
MLGSGISRLIRTG

SEQ ID NO: 27423 - protein, 13 aa, Neisseria
AQIVQDFGDTAHA

SEQ ID NO: 27424 - protein, 16 aa, Neisseria
FQQRGGNAVDASRTHI

SEQ ID NO: 27425 - protein, 17 aa, Neisseria
QYADSTRQGAGVGGGNR

SEQ ID NO: 27426 - protein, 9 aa, Neisseria
VRLEGEHQT

SEQ ID NO: 27427 - protein, 13 aa, Neisseria
AACSGKGCRHFDG

SEQ ID NO: 27428 - protein, 12 aa, Neisseria
AAADAFKAEQAF

SEQ ID NO: 27429 - protein, 17 aa, Neisseria
DRFNRCADFQRHADGCQ

SEQ ID NO: 27430 - protein, 5 aa, Neisseria
HDFKR

SEQ ID NO: 27431 - protein, 7 aa, Neisseria
GQNRADV

SEQ ID NO: 27432 - protein, 8 aa, Neisseria
NTQKGFAV

SEQ ID NO: 27433 - protein, 10 aa, Neisseria
HTVDEIDKRL

SEQ ID NO: 27434 - protein, 17 aa, Neisseria
  VARIANT 13: Xaa is any amino acid
DIGNDGHNRGQMXERGI

SEQ ID NO: 27435 - protein, 24 aa, Neisseria
FAADNESGVESCRAEDGGGQAGGR

SEQ ID NO: 27436 - protein, 12 aa, Neisseria
FAVRTGNGDAVT

SEQ ID NO: 27437 - protein, 18 aa, Neisseria
QGARNNGNLPLQRSDNFG

SEQ ID NO: 27438 - protein, 12 aa, Neisseria
LDGGRGNDDIRT

SEQ ID NO: 27439 - protein, 9 aa, Neisseria
RLIRTGNFK

SEQ ID NO: 27440 - protein, 19 aa, Neisseria
QDFGDTAHADAADTDKMDV

SEQ ID NO: 27441 - protein, 16 aa, Neisseria
FQQRGGNAVDASRTHI

SEQ ID NO: 27442 - protein, 7 aa, Neisseria
DSTRQGA

SEQ ID NO: 27443 - protein, 7 aa, Neisseria
VRLEGEH

SEQ ID NO: 27444 - protein, 10 aa, Neisseria
CSGKGCRHFD

SEQ ID NO: 27445 - protein, 12 aa, Neisseria
AAADAFKAEQAF

SEQ ID NO: 27446 - protein, 9 aa, Neisseria
ADFQRHADG

SEQ ID NO: 27447 - protein, 5 aa, Neisseria
HDFKR

SEQ ID NO: 27448 - protein, 10 aa, Neisseria
HTVDEIDKRL

SEQ ID NO: 27449 - protein, 16 aa, Neisseria
  VARIANT 12: Xaa is any amino acid
IGNDGHNRGQMXERGI

SEQ ID NO: 27450 - protein, 19 aa, Neisseria
FAADNESGVESCRAEDGGG

SEQ ID NO: 27451 - protein, 8 aa, Neisseria
TGNGDAVT

SEQ ID NO: 27452 - protein, 7 aa, Neisseria
QGARNNG

SEQ ID NO: 27453 - protein, 6 aa, Neisseria
LQRSDN

SEQ ID NO: 27454 - protein, 10 aa, Neisseria
GGRGNDDIRT

SEQ ID NO: 27455 - protein, 13 aa, Neisseria
AHADAADTDKMDV

SEQ ID NO: 27456 - protein, 9 aa, Neisseria
GIFEEIDAH

SEQ ID NO: 27457 - protein, 7 aa, Neisseria
INGVVSV

SEQ ID NO: 27458 - protein, 14 aa, Neisseria
QFFVNAFQTAFFFD

SEQ ID NO: 27459 - protein, 6 aa, Neisseria
  VARIANT 6: Xaa is any amino acid
ELGNGX

SEQ ID NO: 27460 - protein, 5 aa, Neisseria
NQFAA

SEQ ID NO: 27461 - protein, 9 aa, Neisseria
TAAGIGNAQ

SEQ ID NO: 27462 - protein, 5 aa, Neisseria
  VARIANT 1: Xaa is any amino acid
XRRFL

SEQ ID NO: 27463 - protein, 5 aa, Neisseria
HTGQG

SEQ ID NO: 27464 - protein, 5 aa, Neisseria
EEIDA

SEQ ID NO: 27465 - protein, 5 aa, Neisseria
FRTDC

SEQ ID NO: 27466 - protein, 9 aa, Neisseria
LGCGDDVYA

SEQ ID NO: 27467 - protein, 5 aa, Neisseria
VQDGA

SEQ ID NO: 27468 - protein, 8 aa, Neisseria
AADKTFGN

SEQ ID NO: 27469 - protein, 12 aa, Neisseria
AFGRRLHKHRQT

SEQ ID NO: 27470 - protein, 10 aa, Neisseria
  VARIANT 6: Xaa is any amino acid
ELGNGXSQCL

SEQ ID NO: 27471 - protein, 8 aa, Neisseria
ADGGGGDT

SEQ ID NO: 27472 - protein, 11 aa, Neisseria
TVKDVECRLKA

SEQ ID NO: 27473 - protein, 5 aa, Neisseria
EEIDA

SEQ ID NO: 27474 - protein, 7 aa, Neisseria
GCGDDVY

SEQ ID NO: 27475 - protein, 7 aa, Neisseria
AADKTFG

SEQ ID NO: 27476 - protein, 11 aa, Neisseria
AFGRRLHKHRQ

SEQ ID NO: 27477 - protein, 7 aa, Neisseria
DGGGGDT

SEQ ID NO: 27478 - protein, 11 aa, Neisseria
TVKDVECRLKA

SEQ ID NO: 27479 - protein, 13 aa, Neisseria
AGLTTFLTMCYIV

SEQ ID NO: 27480 - protein, 27 aa, Neisseria
ATLVGLGDIHQPSALLALFGFVMVVVL

SEQ ID NO: 27481 - protein, 24 aa, Neisseria
TITVIASLMGLNEFHGVVGEVPGI

SEQ ID NO: 27482 - protein, 5 aa, Neisseria
LFTVS

SEQ ID NO: 27483 - protein, 6 aa, Neisseria
FDSTGT

SEQ ID NO: 27484 - protein, 8 aa, Neisseria
MLRSARDI

SEQ ID NO: 27485 - protein, 10 aa, Neisseria
MDISKGLTLL

SEQ ID NO: 27486 - protein, 11 aa, Neisseria
KANGTTVRTEL

SEQ ID NO: 27487 - protein, 6 aa, Neisseria
KVREML

SEQ ID NO: 27488 - protein, 5 aa, Neisseria
FDSTG

SEQ ID NO: 27489 - protein, 10 aa, Neisseria
VDGKLPRLKR

SEQ ID NO: 27490 - protein, 7 aa, Neisseria
SAGGRTG

SEQ ID NO: 27491 - protein, 13 aa, Neisseria
RSARDIDWDDMTE

SEQ ID NO: 27492 - protein, 9 aa, Neisseria
LCRRTGDVP

SEQ ID NO: 27493 - protein, 5 aa, Neisseria
MDISK

SEQ ID NO: 27494 - protein, 10 aa, Neisseria
ANGTTVRTEL

SEQ ID NO: 27495 - protein, 6 aa, Neisseria
KVREML

SEQ ID NO: 27496 - protein, 8 aa, Neisseria
GKLPRLKR

SEQ ID NO: 27497 - protein, 5 aa, Neisseria
AGGRT

SEQ ID NO: 27498 - protein, 13 aa, Neisseria
RSARDIDWDDMTE

SEQ ID NO: 27499 - protein, 7 aa, Neisseria
LCRRTGD

SEQ ID NO: 27500 - protein, 9 aa, Neisseria
DQFVGDVAR

SEQ ID NO: 27501 - protein, 8 aa, Neisseria
THHVHRMG

SEQ ID NO: 27502 - protein, 12 aa, Neisseria
QQDAAQAGDQFV

SEQ ID NO: 27503 - protein, 9 aa, Neisseria
NAAEHGHAG

SEQ ID NO: 27504 - protein, 6 aa, Neisseria
RMGMCR

SEQ ID NO: 27505 - protein, 7 aa, Neisseria
NHTDRQA

SEQ ID NO: 27506 - protein, 6 aa, Neisseria
QDAAQA

SEQ ID NO: 27507 - protein, 6 aa, Neisseria
AAEHGH

SEQ ID NO: 27508 - protein, 7 aa, Neisseria
NHTDRQA

SEQ ID NO: 27509 - protein, 9 aa, Neisseria
SMMRLPDIV

SEQ ID NO: 27510 - protein, 9 aa, Neisseria
AFVEFFGEG

SEQ ID NO: 27511 - protein, 9 aa, Neisseria
KLVETYAKT

SEQ ID NO: 27512 - protein, 6 aa, Neisseria
WAGGLK

SEQ ID NO: 27513 - protein, 9 aa, Neisseria
TRNMAGPSN

SEQ ID NO: 27514 - protein, 16 aa, Neisseria
AAKGLAKPYEEPSDGQ

SEQ ID NO: 27515 - protein, 15 aa, Neisseria
AAITSCTNTSNPRNV

SEQ ID NO: 27516 - protein, 6 aa, Neisseria
TCNGMS

SEQ ID NO: 27517 - protein, 8 aa, Neisseria
IDAIVAEY

SEQ ID NO: 27518 - protein, 8 aa, Neisseria
KPQQFRDI

SEQ ID NO: 27519 - protein, 8 aa, Neisseria
PSPLYDWR

SEQ ID NO: 27520 - protein, 5 aa, Neisseria
STYIR

SEQ ID NO: 27521 - protein, 9 aa, Neisseria
RTLRGMRPP

SEQ ID NO: 27522 - protein, 7 aa, Neisseria
DFNSYAT

SEQ ID NO: 27523 - protein, 6 aa, Neisseria
FNEMVR

SEQ ID NO: 27524 - protein, 11 aa, Neisseria
MRMWEAIETYM

SEQ ID NO: 27525 - protein, 8 aa, Neisseria
RLAGVEAI

SEQ ID NO: 27526 - protein, 11 aa, Neisseria
AEGFERIHRTN

SEQ ID NO: 27527 - protein, 5 aa, Neisseria
GTETY

SEQ ID NO: 27528 - protein, 7 aa, Neisseria
LTGKRQA

SEQ ID NO: 27529 - protein, 8 aa, Neisseria
FLRKERVV

SEQ ID NO: 27530 - protein, 6 aa, Neisseria
GEGARS

SEQ ID NO: 27531 - protein, 7 aa, Neisseria
SIGDRAT

SEQ ID NO: 27532 - protein, 5 aa, Neisseria
MTPEF

SEQ ID NO: 27533 - protein, 10 aa, Neisseria
TGRDDAQVKL

SEQ ID NO: 27534 - protein, 13 aa, Neisseria
SVTRNMAGPSNPH

SEQ ID NO: 27535 - protein, 17 aa, Neisseria
GLAKPYEEPSDGQMPDG

SEQ ID NO: 27536 - protein, 10 aa, Neisseria
CTNTSNPRNV

SEQ ID NO: 27537 - protein, 13 aa, Neisseria
NANRLGLKRKPWV

SEQ ID NO: 27538 - protein, 9 aa, Neisseria
SFAPGSKVA

SEQ ID NO: 27539 - protein, 6 aa, Neisseria
PEMEKL

SEQ ID NO: 27540 - protein, 23 aa, Neisseria
TCNGMSGALDPKIQQEIIDRDLY

SEQ ID NO: 27541 - protein, 15 aa, Neisseria
SGNRNFDGRIHPYAK

SEQ ID NO: 27542 - protein, 9 aa, Neisseria
IRFDIENDV

SEQ ID NO: 27543 - protein, 21 aa, Neisseria
GVADGREIRLKDIWPTDEEID

SEQ ID NO: 27544 - protein, 9 aa, Neisseria
YVKPQQFRD

SEQ ID NO: 27545 - protein, 30 aa, Neisseria
MSDTGTAQKAPSPLYDWRPMSTYIRRPPYW

SEQ ID NO: 27546 - protein, 29 aa, Neisseria
LAGERTLRGMRPPAILPDNITTDHISPSN

SEQ ID NO: 27547 - protein, 19 aa, Neisseria
GLPEEDFNSYATHRGDHLT

SEQ ID NO: 27548 - protein, 6 aa, Neisseria
ANPKLF

SEQ ID NO: 27549 - protein, 23 aa, Neisseria
MVRNEDGSVRQGSLARVEPEGQT

SEQ ID NO: 27550 - protein, 7 aa, Neisseria
YMNRKQP

SEQ ID NO: 27551 - protein, 17 aa, Neisseria
ADYGQGSSRDWAAKGVR

SEQ ID NO: 27552 - protein, 11 aa, Neisseria
EGFERIHRTNL

SEQ ID NO: 27553 - protein, 29 aa, Neisseria
FKPGTNRHTLQLDGTETYDVVGERTPRCG

SEQ ID NO: 27554 - protein, 10 aa, Neisseria
IHRKNGETVE

SEQ ID NO: 27555 - protein, 10 aa, Neisseria
VTCRPDTAEE

SEQ ID NO: 27556 - protein, 7 aa, Neisseria
LTGKRQA

SEQ ID NO: 27557 - protein, 8 aa, Neisseria
FLRKERVV

SEQ ID NO: 27558 - protein, 5 aa, Neisseria
GEGAR

SEQ ID NO: 27559 - protein, 7 aa, Neisseria
SIGDRAT

SEQ ID NO: 27560 - protein, 10 aa, Neisseria
TGRDDAQVKL

SEQ ID NO: 27561 - protein, 15 aa, Neisseria
GLAKPYEEPSDGQMP

SEQ ID NO: 27562 - protein, 9 aa, Neisseria
LGLKRKPWV

SEQ ID NO: 27563 - protein, 6 aa, Neisseria
PEMEKL

SEQ ID NO: 27564 - protein, 15 aa, Neisseria
LDPKIQQEIIDRDLY

SEQ ID NO: 27565 - protein, 7 aa, Neisseria
RNFDGRI

SEQ ID NO: 27566 - protein, 9 aa, Neisseria
IRFDIENDV

SEQ ID NO: 27567 - protein, 10 aa, Neisseria
ADGREIRLKD

SEQ ID NO: 27568 - protein, 8 aa, Neisseria
WPTDEEID

SEQ ID NO: 27569 - protein, 9 aa, Neisseria
DTGTAQKAP

SEQ ID NO: 27570 - protein, 11 aa, Neisseria
LAGERTLRGMR

SEQ ID NO: 27571 - protein, 8 aa, Neisseria
GLPEEDFN

SEQ ID NO: 27572 - protein, 5 aa, Neisseria
HRGDH

SEQ ID NO: 27573 - protein, 11 aa, Neisseria
MVRNEDGSVRQ

SEQ ID NO: 27574 - protein, 9 aa, Neisseria
ARVEPEGQT

SEQ ID NO: 27575 - protein, 7 aa, Neisseria
YMNRKQP

SEQ ID NO: 27576 - protein, 15 aa, Neisseria
YGQGSSRDWAAKGVR

SEQ ID NO: 27577 - protein, 8 aa, Neisseria
EGFERIHR

SEQ ID NO: 27578 - protein, 6 aa, Neisseria
PGTNRH

SEQ ID NO: 27579 - protein, 5 aa, Neisseria
DGTET

SEQ ID NO: 27580 - protein, 9 aa, Neisseria
DVVGERTPR

SEQ ID NO: 27581 - protein, 9 aa, Neisseria
HRKNGETVE

SEQ ID NO: 27582 - protein, 8 aa, Neisseria
CRPDTAEE

SEQ ID NO: 27583 - protein, 11 aa, Neisseria
PNPTANLGDGL

SEQ ID NO: 27584 - protein, 20 aa, Neisseria
FDTMVKDLLGRGWNIINGIA

SEQ ID NO: 27585 - protein, 9 aa, Neisseria
TAKGIGSAV

SEQ ID NO: 27586 - protein, 10 aa, Neisseria
LVFFGILAFC

SEQ ID NO: 27587 - protein, 9 aa, Neisseria
LVDRFTGVL

SEQ ID NO: 27588 - protein, 5 aa, Neisseria
GMVLT

SEQ ID NO: 27589 - protein, 10 aa, Neisseria
NVSSLLKYFK

SEQ ID NO: 27590 - protein, 6 aa, Neisseria
KVAKSI

SEQ ID NO: 27591 - protein, 23 aa, Neisseria
LNETLSKFAQTGDMDKILSLFPY

SEQ ID NO: 27592 - protein, 15 aa, Neisseria
LGLFDNIADIFKWND

SEQ ID NO: 27593 - protein, 5 aa, Neisseria
MSGRG

SEQ ID NO: 27594 - protein, 7 aa, Neisseria
FFTAIGA

SEQ ID NO: 27595 - protein, 8 aa, Neisseria
GAGKTYKV

SEQ ID NO: 27596 - protein, 8 aa, Neisseria
MSAKTPSL

SEQ ID NO: 27597 - protein, 11 aa, Neisseria
PNPTANLGDGL

SEQ ID NO: 27598 - protein, 8 aa, Neisseria
THNPRGAS

SEQ ID NO: 27599 - protein, 5 aa, Neisseria
LLGRG

SEQ ID NO: 27600 - protein, 5 aa, Neisseria
GDLTA

SEQ ID NO: 27601 - protein, 5 aa, Neisseria
ADAKP

SEQ ID NO: 27602 - protein, 7 aa, Neisseria
TQAPVGT

SEQ ID NO: 27603 - protein, 10 aa, Neisseria
YFKGDAPKVA

SEQ ID NO: 27604 - protein, 8 aa, Neisseria
SNLPRNEF

SEQ ID NO: 27605 - protein, 6 aa, Neisseria
AAERQL

SEQ ID NO: 27606 - protein, 8 aa, Neisseria
AQTGDMDK

SEQ ID NO: 27607 - protein, 12 aa, Neisseria
KWNDSMSGRGTK

SEQ ID NO: 27608 - protein, 11 aa, Neisseria
SPQKIGAGKTY

SEQ ID NO: 27609 - protein, 5 aa, Neisseria
MSAKT

SEQ ID NO: 27610 - protein, 8 aa, Neisseria
THNPRGAS

SEQ ID NO: 27611 - protein, 5 aa, Neisseria
ADAKP

SEQ ID NO: 27612 - protein, 9 aa, Neisseria
FKGDAPKVA

SEQ ID NO: 27613 - protein, 7 aa, Neisseria
NLPRNEF

SEQ ID NO: 27614 - protein, 6 aa, Neisseria
AAERQL

SEQ ID NO: 27615 - protein, 5 aa, Neisseria
GDMDK

SEQ ID NO: 27616 - protein, 7 aa, Neisseria
MSGRGTK

SEQ ID NO: 27617 - protein, 5 aa, Neisseria
QKIGA

SEQ ID NO: 27618 - protein, 5 aa, Neisseria
WVGLG

SEQ ID NO: 27619 - protein, 6 aa, Neisseria
VTRLLD

SEQ ID NO: 27620 - protein, 13 aa, Neisseria
KVYGSTAELVRAC

SEQ ID NO: 27621 - protein, 14 aa, Neisseria
AAVCDILNGVRDGL

SEQ ID NO: 27622 - protein, 5 aa, Neisseria
TISPT

SEQ ID NO: 27623 - protein, 13 aa, Neisseria
VEAAGGQFAEAPV

SEQ ID NO: 27624 - protein, 11 aa, Neisseria
AVLNPLQKIFS

SEQ ID NO: 27625 - protein, 8 aa, Neisseria
FGDVGKGS

SEQ ID NO: 27626 - protein, 11 aa, Neisseria
NSLLGIFGEAY

SEQ ID NO: 27627 - protein, 9 aa, Neisseria
IVEAIGGSA

SEQ ID NO: 27628 - protein, 12 aa, Neisseria
LEQAGNTLPAVE

SEQ ID NO: 27629 - protein, 10 aa, Neisseria
AASYRKAVEA

SEQ ID NO: 27630 - protein, 7 aa, Neisseria
LLDGGIE

SEQ ID NO: 27631 - protein, 22 aa, Neisseria
VYNRSPDKTAPISAKGAKVYGS

SEQ ID NO: 27632 - protein, 8 aa, Neisseria
NGVRDGLA

SEQ ID NO: 27633 - protein, 10 aa, Neisseria
STISPTENLA

SEQ ID NO: 27634 - protein, 10 aa, Neisseria
PVSGSVGPAT

SEQ ID NO: 27635 - protein, 5 aa, Neisseria
GGSEA

SEQ ID NO: 27636 - protein, 16 aa, Neisseria
VGKKTFHFGDVGKGSG

SEQ ID NO: 27637 - protein, 9 aa, Neisseria
FGIDTDTIV

SEQ ID NO: 27638 - protein, 22 aa, Neisseria
SAMDSPMFQTKKSLWANREFPP

SEQ ID NO: 27639 - protein, 21 aa, Neisseria
HASKDLNLAVKELEQAGNTLP

SEQ ID NO: 27640 - protein, 18 aa, Neisseria
ASYRKAVEAGYGEQDVSG

SEQ ID NO: 27641 - protein, 6 aa, Neisseria
LLDGGI

SEQ ID NO: 27642 - protein, 15 aa, Neisseria
RSPDKTAPISAKGAK

SEQ ID NO: 27643 - protein, 8 aa, Neisseria
NGVRDGLA

SEQ ID NO: 27644 - protein, 7 aa, Neisseria
DVGKGSG

SEQ ID NO: 27645 - protein, 8 aa, Neisseria
FGIDTDTI

SEQ ID NO: 27646 - protein, 8 aa, Neisseria
QTKKSLWA

SEQ ID NO: 27647 - protein, 17 aa, Neisseria
HASKDLNLAVKELEQAG

SEQ ID NO: 27648 - protein, 7 aa, Neisseria
SYRKAVE

SEQ ID NO: 27649 - protein, 7 aa, Neisseria
GYGEQDV

SEQ ID NO: 27650 - protein, 12 aa, Neisseria
GTYRDLHRPASE

SEQ ID NO: 27651 - protein, 10 aa, Neisseria
LIPAMAGTIG

SEQ ID NO: 27652 - protein, 5 aa, Neisseria
GLLMA

SEQ ID NO: 27653 - protein, 7 aa, Neisseria
IMAKLTS

SEQ ID NO: 27654 - protein, 14 aa, Neisseria
GTTGQVKKLFSWAG

SEQ ID NO: 27655 - protein, 14 aa, Neisseria
VMYALLEHWKKRWL

SEQ ID NO: 27656 - protein, 5 aa, Neisseria
VPLGC

SEQ ID NO: 27657 - protein, 7 aa, Neisseria
HQVFQKI

SEQ ID NO: 27658 - protein, 6 aa, Neisseria
VGSILG

SEQ ID NO: 27659 - protein, 6 aa, Neisseria
TSSWGT

SEQ ID NO: 27660 - protein, 18 aa, Neisseria
AVGMLPGIPPFLEQFKSL

SEQ ID NO: 27661 - protein, 16 aa, Neisseria
MEKHNGTYRDLHRPAS

SEQ ID NO: 27662 - protein, 9 aa, Neisseria
FATRDEYLE

SEQ ID NO: 27663 - protein, 19 aa, Neisseria
MQPKRWRPNLPFRDYRFEW

SEQ ID NO: 27664 - protein, 5 aa, Neisseria
LGLPD

SEQ ID NO: 27665 - protein, 9 aa, Neisseria
PGANLPGTH

SEQ ID NO: 27666 - protein, 6 aa, Neisseria
LTSNGV

SEQ ID NO: 27667 - protein, 6 aa, Neisseria
TGQVKK

SEQ ID NO: 27668 - protein, 6 aa, Neisseria
APGLPP

SEQ ID NO: 27669 - protein, 9 aa, Neisseria
  VARIANT 2: Xaa is any amino acid
WXGENSGWH

SEQ ID NO: 27670 - protein, 9 aa, Neisseria
SYPEKTDKV

SEQ ID NO: 27671 - protein, 7 aa, Neisseria
NIDDTMT

SEQ ID NO: 27672 - protein, 5 aa, Neisseria
PIPGG

SEQ ID NO: 27673 - protein, 13 aa, Neisseria
AGMEMTRKGKTTQ

SEQ ID NO: 27674 - protein, 7 aa, Neisseria
GCKERSA

SEQ ID NO: 27675 - protein, 16 aa, Neisseria
MEKHNGTYRDLHRPAS

SEQ ID NO: 27676 - protein, 9 aa, Neisseria
FATRDEYLE

SEQ ID NO: 27677 - protein, 5 aa, Neisseria
KRWRP

SEQ ID NO: 27678 - protein, 7 aa, Neisseria
RDYRFEW

SEQ ID NO: 27679 - protein, 5 aa, Neisseria
GQVKK

SEQ ID NO: 27680 - protein, 9 aa, Neisseria
SYPEKTDKV

SEQ ID NO: 27681 - protein, 6 aa, Neisseria
IDDTMT

SEQ ID NO: 27682 - protein, 13 aa, Neisseria
AGMEMTRKGKTTQ

SEQ ID NO: 27683 - protein, 7 aa, Neisseria
GCKERSA

SEQ ID NO: 27684 - protein, 9 aa, Neisseria
RLPNLIRAL

SEQ ID NO: 27685 - protein, 22 aa, Neisseria
PSPAKIQKRIDDALKEVNRQMS

SEQ ID NO: 27686 - protein, 7 aa, Neisseria
FNQHTAG

SEQ ID NO: 27687 - protein, 7 aa, Neisseria
GPLVNLW

SEQ ID NO: 27688 - protein, 9 aa, Neisseria
IKQAASYTG

SEQ ID NO: 27689 - protein, 5 aa, Neisseria
DYASL

SEQ ID NO: 27690 - protein, 8 aa, Neisseria
LDLSSIAK

SEQ ID NO: 27691 - protein, 7 aa, Neisseria
YLVEIGG

SEQ ID NO: 27692 - protein, 5 aa, Neisseria
ETEAL

SEQ ID NO: 27693 - protein, 5 aa, Neisseria
LAEQE

SEQ ID NO: 27694 - protein, 10 aa, Neisseria
MPSETRLPNL

SEQ ID NO: 27695 - protein, 6 aa, Neisseria
CSEQTA

SEQ ID NO: 27696 - protein, 6 aa, Neisseria
QGETMG

SEQ ID NO: 27697 - protein, 31 aa, Neisseria
YLSNNRDKLPSPAKIQKRIDDALKEVNRQMS

SEQ ID NO: 27698 - protein, 25 aa, Neisseria
YQTDSEISRFNQHTAGKPLRISSDF

SEQ ID NO: 27699 - protein, 7 aa, Neisseria
EAVRLNR

SEQ ID NO: 27700 - protein, 19 aa, Neisseria
GFGPDKSVTREPSPEQIKQ

SEQ ID NO: 27701 - protein, 18 aa, Neisseria
ILQQGKDYASLSKTHPKA

SEQ ID NO: 27702 - protein, 14 aa, Neisseria
FGVDKVAGELEKYG

SEQ ID NO: 27703 - protein, 25 aa, Neisseria
IGGELHGKGKNAHGEPWRIGIEQPN

SEQ ID NO: 27704 - protein, 13 aa, Neisseria
LNNRSLATSGDYR

SEQ ID NO: 27705 - protein, 11 aa, Neisseria
FHVDKNGKRLS

SEQ ID NO: 27706 - protein, 10 aa, Neisseria
INPNNKRPIS

SEQ ID NO: 27707 - protein, 12 aa, Neisseria
VSDSAMTADGLS

SEQ ID NO: 27708 - protein, 12 aa, Neisseria
ETEALRLAEQEK

SEQ ID NO: 27709 - protein, 8 aa, Neisseria
VRDKDGYR

SEQ ID NO: 27710 - protein, 5 aa, Neisseria
MSSEF

SEQ ID NO: 27711 - protein, 7 aa, Neisseria
MPSETRL

SEQ ID NO: 27712 - protein, 6 aa, Neisseria
CSEQTA

SEQ ID NO: 27713 - protein, 9 aa, Neisseria
SNNRDKLPS

SEQ ID NO: 27714 - protein, 17 aa, Neisseria
AKIQKRIDDALKEVNRQ

SEQ ID NO: 27715 - protein, 8 aa, Neisseria
QTDSEISR

SEQ ID NO: 27716 - protein, 7 aa, Neisseria
KPLRISS

SEQ ID NO: 27717 - protein, 7 aa, Neisseria
EAVRLNR

SEQ ID NO: 27718 - protein, 17 aa, Neisseria
GPDKSVTREPSPEQIKQ

SEQ ID NO: 27719 - protein, 7 aa, Neisseria
QGKDYAS

SEQ ID NO: 27720 - protein, 5 aa, Neisseria
SKTHP

SEQ ID NO: 27721 - protein, 14 aa, Neisseria
FGVDKVAGELEKYG

SEQ ID NO: 27722 - protein, 9 aa, Neisseria
LHGKGKNAH

SEQ ID NO: 27723 - protein, 8 aa, Neisseria
DKNGKRLS

SEQ ID NO: 27724 - protein, 7 aa, Neisseria
PNNKRPI

SEQ ID NO: 27725 - protein, 12 aa, Neisseria
ETEALRLAEQEK

SEQ ID NO: 27726 - protein, 8 aa, Neisseria
VRDKDGYR

SEQ ID NO: 27727 - protein, 8 aa, Neisseria
PIQDTQSA

SEQ ID NO: 27728 - protein, 13 aa, Neisseria
LQELREWFDSYCA

SEQ ID NO: 27729 - protein, 7 aa, Neisseria
GEPLPDH

SEQ ID NO: 27730 - protein, 9 aa, Neisseria
QMVDELDLL

SEQ ID NO: 27731 - protein, 14 aa, Neisseria
DAVAATLLADIGRY

SEQ ID NO: 27732 - protein, 27 aa, Neisseria
CNSTVAELVKGVDEVQKLTHFARVDSL

SEQ ID NO: 27733 - protein, 6 aa, Neisseria
KMLLAM

SEQ ID NO: 27734 - protein, 11 aa, Neisseria
FLSNAPDSPEK

SEQ ID NO: 27735 - protein, 6 aa, Neisseria
EPEKYR

SEQ ID NO: 27736 - protein, 13 aa, Neisseria
RLEYIENFLDILR

SEQ ID NO: 27737 - protein, 11 aa, Neisseria
GRPKHIYSIYK

SEQ ID NO: 27738 - protein, 5 aa, Neisseria
LFDIR

SEQ ID NO: 27739 - protein, 32 aa, Neisseria; identical to SEQ ID NO: 1591

SEQ ID NO: 27740 - protein, 7 aa, Neisseria
GYKSLHT

SEQ ID NO: 27741 - protein, 11 aa, Neisseria
DMHQFNEFGVA

SEQ ID NO: 27742 - protein, 5 aa, Neisseria
QLLDW

SEQ ID NO: 27743 - protein, 7 aa, Neisseria
HSSIGDR

SEQ ID NO: 27744 - protein, 13 aa, Neisseria
VKSGKAIGKIRAY

SEQ ID NO: 27745 - protein, 5 aa, Neisseria
QQNAD

SEQ ID NO: 27746 - protein, 5 aa, Neisseria
QLAKL

SEQ ID NO: 27747 - protein, 5 aa, Neisseria
QELAE

SEQ ID NO: 27748 - protein, 10 aa, Neisseria
GYKKPEDLYT

SEQ ID NO: 27749 - protein, 15 aa, Neisseria
NRAIQKACGTLNEPP

SEQ ID NO: 27750 - protein, 6 aa, Neisseria
KIKKGG

SEQ ID NO: 27751 - protein, 18 aa, Neisseria
MTTLAKCCKPAPPDDIAG

SEQ ID NO: 27752 - protein, 16 aa, Neisseria
SFRHLAEHAPEKVLDA

SEQ ID NO: 27753 - protein, 6 aa, Neisseria
RDVSDA

SEQ ID NO: 27754 - protein, 23 aa, Neisseria
QVNDLPRVLAGLGDVKGVLSVTR

SEQ ID NO: 27755 - protein, 10 aa, Neisseria
SPIQDTQSAT

SEQ ID NO: 27756 - protein, 21 aa, Neisseria
QELREWFDSYCAALPDNDKNL

SEQ ID NO: 27757 - protein, 5 aa, Neisseria
EHYPA

SEQ ID NO: 27758 - protein, 13 aa, Neisseria
AATPYGEPLPDHF

SEQ ID NO: 27759 - protein, 9 aa, Neisseria
MVDELDLLP

SEQ ID NO: 27760 - protein, 9 aa, Neisseria
DIGRYVPDW

SEQ ID NO: 27761 - protein, 9 aa, Neisseria
VSERCNSTV

SEQ ID NO: 27762 - protein, 11 aa, Neisseria
ELVKGVDEVQK

SEQ ID NO: 27763 - protein, 20 aa, Neisseria
ARVDSLATPEERAQQAETMR

SEQ ID NO: 27764 - protein, 6 aa, Neisseria
AMRTRT

SEQ ID NO: 27765 - protein, 16 aa, Neisseria
NAPDSPEKRAVAKETL

SEQ ID NO: 27766 - protein, 14 aa, Neisseria
DLGFRHQEPEKYRE

SEQ ID NO: 27767 - protein, 11 aa, Neisseria
LDEKRTERLEY

SEQ ID NO: 27768 - protein, 7 aa, Neisseria
LRTELKK

SEQ ID NO: 27769 - protein, 7 aa, Neisseria
VAGRPKH

SEQ ID NO: 27770 - protein, 9 aa, Neisseria
KMVKKKLSF

SEQ ID NO: 27771 - protein, 6 aa, Neisseria
TVPECY

SEQ ID NO: 27772 - protein, 20 aa, Neisseria
PIPGEFDDYIANPKGNGYKS

SEQ ID NO: 27773 - protein, 15 aa, Neisseria
IVGPEEKGVEVQIRT

SEQ ID NO: 27774 - protein, 16 aa, Neisseria
WRYKEGGKGDSAYEQK

SEQ ID NO: 27775 - protein, 17 aa, Neisseria
LDWRENMAESGKEDLAA

SEQ ID NO: 27776 - protein, 5 aa, Neisseria
TPHGK

SEQ ID NO: 27777 - protein, 15 aa, Neisseria
HSSIGDRCRGAKVEG

SEQ ID NO: 27778 - protein, 22 aa, Neisseria
TPLENGQRVEIITAKEGHPSVN

SEQ ID NO: 27779 - protein, 11 aa, Neisseria
GWVKSGKAIGK

SEQ ID NO: 27780 - protein, 22 aa, Neisseria
IRQQNADTVREEGRVQLDKQLA

SEQ ID NO: 27781 - protein, 12 aa, Neisseria
LTPKPNLQELAE

SEQ ID NO: 27782 - protein, 9 aa, Neisseria
LGYKKPEDL

SEQ ID NO: 27783 - protein, 23 aa, Neisseria
GQGEISNRAIQKACGTLNEPPPV

SEQ ID NO: 27784 - protein, 11 aa, Neisseria
KQSKIKKGGKT

SEQ ID NO: 27785 - protein, 7 aa, Neisseria
IDGEDGL

SEQ ID NO: 27786 - protein, 12 aa, Neisseria
KCCKPAPPDDIA

SEQ ID NO: 27787 - protein, 17 aa, Neisseria
VTRERGISVHRKTCPSF

SEQ ID NO: 27788 - protein, 8 aa, Neisseria
HAPEKVLD

SEQ ID NO: 27789 - protein, 24 aa, Neisseria
IEIRAQDRSGLLRDVSDALARHKL

SEQ ID NO: 27790 - protein, 11 aa, Neisseria
QTQSRDLEASM

SEQ ID NO: 27791 - protein, 11 aa, Neisseria
LEVKQVNDLPR

SEQ ID NO: 27792 - protein, 5 aa, Neisseria
GDVKG

SEQ ID NO: 27793 - protein, 5 aa, Neisseria
QDTQS

SEQ ID NO: 27794 - protein, 7 aa, Neisseria
QELREWF

SEQ ID NO: 27795 - protein, 7 aa, Neisseria
PDNDKNL

SEQ ID NO: 27796 - protein, 9 aa, Neisseria
MVDELDLLP

SEQ ID NO: 27797 - protein, 8 aa, Neisseria
VSERCNST

SEQ ID NO: 27798 - protein, 11 aa, Neisseria
ELVKGVDEVQK

SEQ ID NO: 27799 - protein, 5 aa, Neisseria
ARVDS

SEQ ID NO: 27800 - protein, 14 aa, Neisseria
ATPEERAQQAETMR

SEQ ID NO: 27801 - protein, 6 aa, Neisseria
AMRTRT

SEQ ID NO: 27802 - protein, 15 aa, Neisseria
APDSPEKRAVAKETL

SEQ ID NO: 27803 - protein, 14 aa, Neisseria
DLGFRHQEPEKYRE

SEQ ID NO: 27804 - protein, 11 aa, Neisseria
LDEKRTERLEY

SEQ ID NO: 27805 - protein, 7 aa, Neisseria
LRTELKK

SEQ ID NO: 27806 - protein, 7 aa, Neisseria
VAGRPKH

SEQ ID NO: 27807 - protein, 9 aa, Neisseria
KMVKKKLSF

SEQ ID NO: 27808 - protein, 5 aa, Neisseria
GEFDD

SEQ ID NO: 27809 - protein, 5 aa, Neisseria
PKGNG

SEQ ID NO: 27810 - protein, 13 aa, Neisseria
GPEEKGVEVQIRT

SEQ ID NO: 27811 - protein, 14 aa, Neisseria
RYKEGGKGDSAYEQ

SEQ ID NO: 27812 - protein, 17 aa, Neisseria
LDWRENMAESGKEDLAA

SEQ ID NO: 27813 - protein, 12 aa, Neisseria
IGDRCRGAKVEG

SEQ ID NO: 27814 - protein, 17 aa, Neisseria
LENGQRVEIITAKEGHP

SEQ ID NO: 27815 - protein, 9 aa, Neisseria
VKSGKAIGK

SEQ ID NO: 27816 - protein, 19 aa, Neisseria
QNADTVREEGRVQLDKQLA

SEQ ID NO: 27817 - protein, 9 aa, Neisseria
LGYKKPEDL

SEQ ID NO: 27818 - protein, 5 aa, Neisseria
GEISN

SEQ ID NO: 27819 - protein, 10 aa, Neisseria
KQSKIKKGGK

SEQ ID NO: 27820 - protein, 7 aa, Neisseria
IDGEDGL

SEQ ID NO: 27821 - protein, 11 aa, Neisseria
KCCKPAPPDDI

SEQ ID NO: 27822 - protein, 15 aa, Neisseria
VTRERGISVHRKTCP

SEQ ID NO: 27823 - protein, 7 aa, Neisseria
HAPEKVL

SEQ ID NO: 27824 - protein, 24 aa, Neisseria
IEIRAQDRSGLLRDVSDALARHKL

SEQ ID NO: 27825 - protein, 10 aa, Neisseria
TQSRDLEASM

SEQ ID NO: 27826 - protein, 11 aa, Neisseria
LEVKQVNDLPR

SEQ ID NO: 27827 - protein, 5 aa, Neisseria
GDVKG

SEQ ID NO: 27828 - protein, 5 aa, Neisseria
GKWYD

SEQ ID NO: 27829 - protein, 5 aa, Neisseria
IPRDI

SEQ ID NO: 27830 - protein, 12 aa, Neisseria
IGTIIDFLMVPN

SEQ ID NO: 27831 - protein, 13 aa, Neisseria
IHERYERFTTMLR

SEQ ID NO: 27832 - protein, 12 aa, Neisseria
CEFKDFRRNIPC

SEQ ID NO: 27833 - protein, 8 aa, Neisseria
EEYDENSF

SEQ ID NO: 27834 - protein, 38 aa, Neisseria
GKWYDDGVWDDEEYWKLENDLIEVRRKYPYPMDIPRDI

SEQ ID NO: 27835 - protein, 15 aa, Neisseria
PWLPDSVGIHERYER

SEQ ID NO: 27836 - protein, 7 aa, Neisseria
FTEKDIV

SEQ ID NO: 27837 - protein, 7 aa, Neisseria
FDYYNKK

SEQ ID NO: 27838 - protein, 12 aa, Neisseria
CEFKDFRRNIPC

SEQ ID NO: 27839 - protein, 5 aa, Neisseria
EEYDE

SEQ ID NO: 27840 - protein, 24 aa, Neisseria
GVWDDEEYWKLENDLIEVRRKYPY

SEQ ID NO: 27841 - protein, 5 aa, Neisseria
ERYER

SEQ ID NO: 27842 - protein, 7 aa, Neisseria
FTEKDIV

SEQ ID NO: 27843 - protein, 5 aa, Neisseria
YYNKK

SEQ ID NO: 27844 - protein, 6 aa, Neisseria
KNIFSA

SEQ ID NO: 27845 - protein, 12 aa, Neisseria
SGNAYKIVSTIK

SEQ ID NO: 27846 - protein, 13 aa, Neisseria
NTLHPAYYKDIRR

SEQ ID NO: 27847 - protein, 17 aa, Neisseria
ITNGKKLYSVGGLNKAG

SEQ ID NO: 27848 - protein, 9 aa, Neisseria
APSLNNIPA

SEQ ID NO: 27849 - protein, 5 aa, Neisseria
SGSYG

SEQ ID NO: 27850 - protein, 10 aa, Neisseria
TFERSGNAYK

SEQ ID NO: 27851 - protein, 8 aa, Neisseria
FESGGTVV

SEQ ID NO: 27852 - protein, 12 aa, Neisseria
YYKDIRRGKLYA

SEQ ID NO: 27853 - protein, 23 aa, Neisseria
KFADGSVTYGKAGESKTEQSPKA

SEQ ID NO: 27854 - protein, 20 aa, Neisseria
ANDAKLPPGLKITNGKKLYS

SEQ ID NO: 27855 - protein, 31 aa, Neisseria
GLNKAGTGKYSIGGVETEVVKYRVRRGDDTV

SEQ ID NO: 27856 - protein, 9 aa, Neisseria
GYTDDGKTY

SEQ ID NO: 27857 - protein, 6 aa, Neisseria
GQAAKP

SEQ ID NO: 27858 - protein, 7 aa, Neisseria
TFERSGN

SEQ ID NO: 27859 - protein, 10 aa, Neisseria
KDIRRGKLYA

SEQ ID NO: 27860 - protein, 13 aa, Neisseria
KAGESKTEQSPKA

SEQ ID NO: 27861 - protein, 6 aa, Neisseria
ANDAKL

SEQ ID NO: 27862 - protein, 7 aa, Neisseria
TNGKKLY

SEQ ID NO: 27863 - protein, 6 aa, Neisseria
NKAGTG

SEQ ID NO: 27864 - protein, 16 aa, Neisseria
VETEVVKYRVRRGDDT

SEQ ID NO: 27865 - protein, 8 aa, Neisseria
YTDDGKTY

SEQ ID NO: 27866 - protein, 5 aa, Neisseria
QAAKP

SEQ ID NO: 27867 - protein, 10 aa, Neisseria
PYPDRLRRKL

SEQ ID NO: 27868 - protein, 10 aa, Neisseria
QELSRLYAQT

SEQ ID NO: 27869 - protein, 6 aa, Neisseria
TVRHAP

SEQ ID NO: 27870 - protein, 14 aa, Neisseria
LPLLAELTRIFTVG

SEQ ID NO: 27871 - protein, 5 aa, Neisseria
PAFHE

SEQ ID NO: 27872 - protein, 9 aa, Neisseria
IGGIANISV

SEQ ID NO: 27873 - protein, 10 aa, Neisseria
PGNMLMDAWT

SEQ ID NO: 27874 - protein, 15 aa, Neisseria
GNILPQLLGRLLAHP

SEQ ID NO: 27875 - protein, 6 aa, Neisseria
HPKSTG

SEQ ID NO: 27876 - protein, 5 aa, Neisseria
ETYLD

SEQ ID NO: 27877 - protein, 20 aa, Neisseria
DVLRTLSRFTAQTVWDAVSH

SEQ ID NO: 27878 - protein, 7 aa, Neisseria
ADLAECF

SEQ ID NO: 27879 - protein, 8 aa, Neisseria
INRIPGSP

SEQ ID NO: 27880 - protein, 7 aa, Neisseria
TSMDGAD

SEQ ID NO: 27881 - protein, 10 aa, Neisseria
VRMDGGKWLG

SEQ ID NO: 27882 - protein, 28 aa, Neisseria
PYPDRLRRKLLDLQDTGTDELHRSRMLS

SEQ ID NO: 27883 - protein, 7 aa, Neisseria
QNLAPCD

SEQ ID NO: 27884 - protein, 15 aa, Neisseria
CHGQTVRHAPEHGYS

SEQ ID NO: 27885 - protein, 16 aa, Neisseria
TVGDFRSRDLAAGGQG

SEQ ID NO: 27886 - protein, 10 aa, Neisseria
LFRDDRETRV

SEQ ID NO: 27887 - protein, 7 aa, Neisseria
DTGPGNM

SEQ ID NO: 27888 - protein, 13 aa, Neisseria
PYDKNGAKAAQGN

SEQ ID NO: 27889 - protein, 9 aa, Neisseria
PHPKSTGRE

SEQ ID NO: 27890 - protein, 16 aa, Neisseria
YLDGGENRYDVLRTLS

SEQ ID NO: 27891 - protein, 6 aa, Neisseria
AADARQ

SEQ ID NO: 27892 - protein, 9 aa, Neisseria
GGGIRNPVL

SEQ ID NO: 27893 - protein, 16 aa, Neisseria
IPGSPHKATGASKPCI

SEQ ID NO: 27894 - protein, 7 aa, Neisseria
TSMDGAD

SEQ ID NO: 27895 - protein, 27 aa, Neisseria
YPDRLRRKLLDLQDTGTDELHRSRMLS

SEQ ID NO: 27896 - protein, 6 aa, Neisseria
TVRHAP

SEQ ID NO: 27897 - protein, 9 aa, Neisseria
DFRSRDLAA

SEQ ID NO: 27898 - protein, 10 aa, Neisseria
LFRDDRETRV

SEQ ID NO: 27899 - protein, 10 aa, Neisseria
YDKNGAKAAQ

SEQ ID NO: 27900 - protein, 9 aa, Neisseria
PHPKSTGRE

SEQ ID NO: 27901 - protein, 10 aa, Neisseria
LDGGENRYDV

SEQ ID NO: 27902 - protein, 6 aa, Neisseria
AADARQ

SEQ ID NO: 27903 - protein, 12 aa, Neisseria
PGSPHKATGASK

SEQ ID NO: 27904 - protein, 6 aa, Neisseria
NIHKTF

SEQ ID NO: 27905 - protein, 13 aa, Neisseria
TFLRCLNALEMPE

SEQ ID NO: 27906 - protein, 6 aa, Neisseria
LENVME

SEQ ID NO: 27907 - protein, 5 aa, Neisseria
KLLEK

SEQ ID NO: 27908 - protein, 18 aa, Neisseria
PELVQDVLDAMKELAREG

SEQ ID NO: 27909 - protein, 11 aa, Neisseria
PKELFDHLKHE

SEQ ID NO: 27910 - protein, 12 aa, Neisseria
RNIHKTFGENTI

SEQ ID NO: 27911 - protein, 9 aa, Neisseria
IDLDVGKGQ

SEQ ID NO: 27912 - protein, 9 aa, Neisseria
GPSGSGKTT

SEQ ID NO: 27913 - protein, 28 aa, Neisseria
EMPEDGQIEFDNARPLRIDFSKKTSKHD

SEQ ID NO: 27914 - protein, 8 aa, Neisseria
ALRRKSGM

SEQ ID NO: 27915 - protein, 7 aa, Neisseria
FPHKTVL

SEQ ID NO: 27916 - protein, 16 aa, Neisseria
GKPAAQAREEALKLLE

SEQ ID NO: 27917 - protein, 10 aa, Neisseria
VGLGDKVDLY

SEQ ID NO: 27918 - protein, 13 aa, Neisseria
YQLSGGQQQRVGI

SEQ ID NO: 27919 - protein, 12 aa, Neisseria
DEPTSALDPELV

SEQ ID NO: 27920 - protein, 13 aa, Neisseria
VLDAMKELAREGW

SEQ ID NO: 27921 - protein, 5 aa, Neisseria
MDGGV

SEQ ID NO: 27922 - protein, 12 aa, Neisseria
VEQGLSPKELFD

SEQ ID NO: 27923 - protein, 10 aa, Neisseria
LKHERTRRFL

SEQ ID NO: 27924 - protein, 7 aa, Neisseria
IDLDVGK

SEQ ID NO: 27925 - protein, 28 aa, Neisseria
EMPEDGQIEFDNARPLRIDFSKKTSKHD

SEQ ID NO: 27926 - protein, 7 aa, Neisseria
ALRRKSG

SEQ ID NO: 27927 - protein, 16 aa, Neisseria
GKPAAQAREEALKLLE

SEQ ID NO: 27928 - protein, 8 aa, Neisseria
VGLGDKVD

SEQ ID NO: 27929 - protein, 12 aa, Neisseria
DEPTSALDPELV

SEQ ID NO: 27930 - protein, 10 aa, Neisseria
VLDAMKELAR

SEQ ID NO: 27931 - protein, 9 aa, Neisseria
QGSPKELFD

SEQ ID NO: 27932 - protein, 10 aa, Neisseria
LKHERTRRFL

SEQ ID NO: 27933 - protein, 6 aa, Neisseria
LKQSVR

SEQ ID NO: 27934 - protein, 8 aa, Neisseria
GCQSVQEA

SEQ ID NO: 27935 - protein, 6 aa, Neisseria
FQLVEA

SEQ ID NO: 27936 - protein, 6 aa, Neisseria
LDAGCQ

SEQ ID NO: 27937 - protein, 15 aa, Neisseria
LMPWAAPIGTGLGAV

SEQ ID NO: 27938 - protein, 11 aa, Neisseria
SGDPVNMARAF

SEQ ID NO: 27939 - protein, 7 aa, Neisseria
ETFPSRL

SEQ ID NO: 27940 - protein, 11 aa, Neisseria
EILKQSVRTAR

SEQ ID NO: 27941 - protein, 16 aa, Neisseria
SLRRTGCGGEAHGQGF

SEQ ID NO: 27942 - protein, 8 aa, Neisseria
QMAREVFE

SEQ ID NO: 27943 - protein, 10 aa, Neisseria
ELIGDDDTLQ

SEQ ID NO: 27944 - protein, 9 aa, Neisseria
LIKDGFKVL

SEQ ID NO: 27945 - protein, 7 aa, Neisseria
RLLDAGC

SEQ ID NO: 27946 - protein, 11 aa, Neisseria
ILRERLPDTPL

SEQ ID NO: 27947 - protein, 10 aa, Neisseria
AVSRSGDPVN

SEQ ID NO: 27948 - protein, 7 aa, Neisseria
ESGRLAF

SEQ ID NO: 27949 - protein, 17 aa, Neisseria
GPVEARHRKAQASTPTV

SEQ ID NO: 27950 - protein, 11 aa, Neisseria
EILKQSVRTAR

SEQ ID NO: 27951 - protein, 12 aa, Neisseria
SLRRTGCGGEAH

SEQ ID NO: 27952 - protein, 8 aa, Neisseria
QMAREVFE

SEQ ID NO: 27953 - protein, 9 aa, Neisseria
LIGDDDTLQ

SEQ ID NO: 27954 - protein, 8 aa, Neisseria
ILRERLPD

SEQ ID NO: 27955 - protein, 7 aa, Neisseria
VSRSGDP

SEQ ID NO: 27956 - protein, 7 aa, Neisseria
ESGRLAF

SEQ ID NO: 27957 - protein, 11 aa, Neisseria
GPVEARTKAQA

SEQ ID NO: 27958 - protein, 7 aa, Neisseria
MLNTWPD

SEQ ID NO: 27959 - protein, 5 aa, Neisseria
ESVAA

SEQ ID NO: 27960 - protein, 7 aa, Neisseria
VGDYIEI

SEQ ID NO: 27961 - protein, 8 aa, Neisseria
INLLNTLM

SEQ ID NO: 27962 - protein, 9 aa, Neisseria
PNPLVGQLA

SEQ ID NO: 27963 - protein, 7 aa, Neisseria
LEPLCAP

SEQ ID NO: 27964 - protein, 12 aa, Neisseria
IPAIQRYLENVQ

SEQ ID NO: 27965 - protein, 10 aa, Neisseria
RIIVRFASPV

SEQ ID NO: 27966 - protein, 9 aa, Neisseria
AVMDEFLRV

SEQ ID NO: 27967 - protein, 9 aa, Neisseria
VPIRAEAAE

SEQ ID NO: 27968 - protein, 18 aa, Neisseria
HFRRHPDFGIESKRRFLV

SEQ ID NO: 27969 - protein, 8 aa, Neisseria
SATQQYSV

SEQ ID NO: 27970 - protein, 9 aa, Neisseria
NGLRGRVVD

SEQ ID NO: 27971 - protein, 9 aa, Neisseria
HPVRRDNIL

SEQ ID NO: 27972 - protein, 9 aa, Neisseria
LDSDEAVCR

SEQ ID NO: 27973 - protein, 16 aa, Neisseria
AARPRVTRVPYDDKAY

SEQ ID NO: 27974 - protein, 9 aa, Neisseria
SPVSKRLEI

SEQ ID NO: 27975 - protein, 9 aa, Neisseria
NHPAGSETL

SEQ ID NO: 27976 - protein, 9 aa, Neisseria
VPIRAEAAE

SEQ ID NO: 27977 - protein, 17 aa, Neisseria
FRRHPDFGIESKRRFLV

SEQ ID NO: 27978 - protein, 8 aa, Neisseria
NGLRGRVV

SEQ ID NO: 27979 - protein, 8 aa, Neisseria
PVRRDNIL

SEQ ID NO: 27980 - protein, 9 aa, Neisseria
LDSDEAVCR

SEQ ID NO: 27981 - protein, 15 aa, Neisseria
ARPRVTRVPYDDKAY

SEQ ID NO: 27982 - protein, 7 aa, Neisseria
VSKRLEI

SEQ ID NO: 27983 - protein, 6 aa, Neisseria
AGSETL

SEQ ID NO: 27984 - protein, 35 aa, Neisseria
AQTHTGWANTVERLTGITERVGRIWGVVSHLNSVV

SEQ ID NO: 27985 - protein, 9 aa, Neisseria
VYNELMPEI

SEQ ID NO: 27986 - protein, 17 aa, Neisseria
QDIELYNRFKTIKNSPE

SEQ ID NO: 27987 - protein, 10 aa, Neisseria
FSQNVLDATD

SEQ ID NO: 27988 - protein, 6 aa, Neisseria
GIPEDA

SEQ ID NO: 27989 - protein, 5 aa, Neisseria
HYLAV

SEQ ID NO: 27990 - protein, 6 aa, Neisseria
LREQIY

SEQ ID NO: 27991 - protein, 35 aa, Neisseria
ELSNDGKFDNTANIDRTLENALKTAKLLGFKNYAE

SEQ ID NO: 27992 - protein, 19 aa, Neisseria
MADTPEQVLNFLHDLARRA

SEQ ID NO: 27993 - protein, 6 aa, Neisseria
AEVKAF

SEQ ID NO: 27994 - protein, 15 aa, Neisseria
KVLAGLFAQIKKLYG

SEQ ID NO: 27995 - protein, 11 aa, Neisseria
LHHLLTQVDEL

SEQ ID NO: 27996 - protein, 6 aa, Neisseria
ELPSQF

SEQ ID NO: 27997 - protein, 11 aa, Neisseria
GEPLPKELFDK

SEQ ID NO: 27998 - protein, 8 aa, Neisseria
WQQVLDSV

SEQ ID NO: 27999 - protein, 20 aa, Neisseria
IQPPEYNRFANSFGHIFAGG

SEQ ID NO: 28000 - protein, 6 aa, Neisseria
SYAWAE

SEQ ID NO: 28001 - protein, 8 aa, Neisseria
AAFEESDD

SEQ ID NO: 28002 - protein, 9 aa, Neisseria
KRFWQEILA

SEQ ID NO: 28003 - protein, 9 aa, Neisseria
AAESFKAFR

SEQ ID NO: 28004 - protein, 19 aa, Neisseria
LGEEPRFNQIKTEDIKPAV

SEQ ID NO: 28005 - protein, 5 aa, Neisseria
AEARG

SEQ ID NO: 28006 - protein, 7 aa, Neisseria
AQTHTGW

SEQ ID NO: 28007 - protein, 16 aa, Neisseria
TVERLTGITERVGRIW

SEQ ID NO: 28008 - protein, 6 aa, Neisseria
VDTPEL

SEQ ID NO: 28009 - protein, 20 aa, Neisseria
IGQDIELYNRFKTIKNSPEF

SEQ ID NO: 28010 - protein, 14 aa, Neisseria
SPAQKTKLDHDLRD

SEQ ID NO: 28011 - protein, 23 aa, Neisseria
SGAELPPERQAELAKLQTEGAQL

SEQ ID NO: 28012 - protein, 6 aa, Neisseria
KFSQNV

SEQ ID NO: 28013 - protein, 5 aa, Neisseria
DATDA

SEQ ID NO: 28014 - protein, 5 aa, Neisseria
IPEDA

SEQ ID NO: 28015 - protein, 10 aa, Neisseria
AQSEGKTGYK

SEQ ID NO: 28016 - protein, 11 aa, Neisseria
YAGNRELREQI

SEQ ID NO: 28017 - protein, 27 aa, Neisseria
RASELSNDGKFDNTANIDRTLENALKT

SEQ ID NO: 28018 - protein, 8 aa, Neisseria
KMADTPEQ

SEQ ID NO: 28019 - protein, 15 aa, Neisseria
LARRAKPYAEKDLAE

SEQ ID NO: 28020 - protein, 18 aa, Neisseria
KAFAREHLGLADPQPWDL

SEQ ID NO: 28021 - protein, 20 aa, Neisseria
YAGEKLREAKYAFSETEVKK

SEQ ID NO: 28022 - protein, 5 aa, Neisseria
FAEKT

SEQ ID NO: 28023 - protein, 15 aa, Neisseria
KDVRYFELQQNGKTI

SEQ ID NO: 28024 - protein, 10 aa, Neisseria
YAREGKRGGA

SEQ ID NO: 28025 - protein, 15 aa, Neisseria
MNDYKGRRRFADGTL

SEQ ID NO: 28026 - protein, 14 aa, Neisseria
PPVGGKEARLSHDE

SEQ ID NO: 28027 - protein, 7 aa, Neisseria
QVDELGV

SEQ ID NO: 28028 - protein, 5 aa, Neisseria
ELPSQ

SEQ ID NO: 28029 - protein, 11 aa, Neisseria
SAHEETGEPLP

SEQ ID NO: 28030 - protein, 10 aa, Neisseria
SESDECRLKN

SEQ ID NO: 28031 - protein, 8 aa, Neisseria
DSVRKEVA

SEQ ID NO: 28032 - protein, 13 aa, Neisseria
QPPEYNRFANSFG

SEQ ID NO: 28033 - protein, 7 aa, Neisseria
SAGYYSY

SEQ ID NO: 28034 - protein, 15 aa, Neisseria
FEESDDVAATGKRFW

SEQ ID NO: 28035 - protein, 20 aa, Neisseria
GGSRSAAESFKAFRGREPSI

SEQ ID NO: 28036 - protein, 10 aa, Neisseria
LRHSGFDNAA

SEQ ID NO: 28037 - protein, 17 aa, Neisseria
LGEEPRFNQIKTEDIKP

SEQ ID NO: 28038 - protein, 5 aa, Neisseria
AEARG

SEQ ID NO: 28039 - protein, 13 aa, Neisseria
TVERLTGITERVG

SEQ ID NO: 28040 - protein, 6 aa, Neisseria
VDTPEL

SEQ ID NO: 28041 - protein, 7 aa, Neisseria
IGQDIEL

SEQ ID NO: 28042 - protein, 8 aa, Neisseria
KTIKNSPE

SEQ ID NO: 28043 - protein, 13 aa, Neisseria
PAQKTKLDHDLRD

SEQ ID NO: 28044 - protein, 20 aa, Neisseria
ELPPERQAELAKLQTEGAQL

SEQ ID NO: 28045 - protein, 5 aa, Neisseria
IPEDA

SEQ ID NO: 28046 - protein, 9 aa, Neisseria
AQSEGKTGY

SEQ ID NO: 28047 - protein, 9 aa, Neisseria
GNRELREQI

SEQ ID NO: 28048 - protein, 13 aa, Neisseria
RASELSNDGKFDN

SEQ ID NO: 28049 - protein, 13 aa, Neisseria
ANIDRTLENALKT

SEQ ID NO: 28050 - protein, 7 aa, Neisseria
KMADTPE

SEQ ID NO: 28051 - protein, 15 aa, Neisseria
LARRAKPYAEKDLAE

SEQ ID NO: 28052 - protein, 9 aa, Neisseria
KAFAREHLG

SEQ ID NO: 28053 - protein, 20 aa, Neisseria
YAGEKLREAKYAFSETEVKK

SEQ ID NO: 28054 - protein, 5 aa, Neisseria
FAEKT

SEQ ID NO: 28055 - protein, 5 aa, Neisseria
KDVRY

SEQ ID NO: 28056 - protein, 5 aa, Neisseria
QNGKT

SEQ ID NO: 28057 - protein, 9 aa, Neisseria
YAREGKRGG

SEQ ID NO: 28058 - protein, 9 aa, Neisseria
YKGRRRFAD

SEQ ID NO: 28059 - protein, 12 aa, Neisseria
VGGKEARLSHDE

SEQ ID NO: 28060 - protein, 6 aa, Neisseria
QVDELG

SEQ ID NO: 28061 - protein, 11 aa, Neisseria
SAHEETGEPLP

SEQ ID NO: 28062 - protein, 10 aa, Neisseria
SESDECRLKN

SEQ ID NO: 28063 - protein, 8 aa, Neisseria
DSVRKEVA

SEQ ID NO: 28064 - protein, 11 aa, Neisseria
FEESDDVAATG

SEQ ID NO: 28065 - protein, 19 aa, Neisseria
GSRSAAESFKAFRGREPSI

SEQ ID NO: 28066 - protein, 6 aa, Neisseria
TLVSGI

SEQ ID NO: 28067 - protein, 6 aa, Neisseria
GSGSFG

SEQ ID NO: 28068 - protein, 6 aa, Neisseria
QPVGQL

SEQ ID NO: 28069 - protein, 6 aa, Neisseria
NVPNAP

SEQ ID NO: 28070 - protein, 17 aa, Neisseria
QGFDTLFQHALNGFNAM

SEQ ID NO: 28071 - protein, 5 aa, Neisseria
TASAP

SEQ ID NO: 28072 - protein, 6 aa, Neisseria
FEATCQ

SEQ ID NO: 28073 - protein, 10 aa, Neisseria
CHGGSIPGIP

SEQ ID NO: 28074 - protein, 5 aa, Neisseria
KGKET

SEQ ID NO: 28075 - protein, 6 aa, Neisseria
EGFNAM

SEQ ID NO: 28076 - protein, 12 aa, Neisseria
MKQLRDNKAQGS

SEQ ID NO: 28077 - protein, 25 aa, Neisseria
AGSGSFGDVDATTEAATQTRIQPVG

SEQ ID NO: 28078 - protein, 13 aa, Neisseria
MGDGIPVGERQGE

SEQ ID NO: 28079 - protein, 19 aa, Neisseria
AADSNVPNAPKLEHNGDWA

SEQ ID NO: 28080 - protein, 5 aa, Neisseria
IAQGF

SEQ ID NO: 28081 - protein, 7 aa, Neisseria
MPAKGGA

SEQ ID NO: 28082 - protein, 9 aa, Neisseria
DLTDQELKR

SEQ ID NO: 28083 - protein, 45 aa, Neisseria; identical to SEQ ID NO: 1904

SEQ ID NO: 28084 - protein, 9 aa, Neisseria
GVDGKKVFE

SEQ ID NO: 28085 - protein, 20 aa, Neisseria
GIGKKDDWAPRIKKGKETLH

SEQ ID NO: 28086 - protein, 16 aa, Neisseria
PAKGGNAGLSDDEVKA

SEQ ID NO: 28087 - protein, 5 aa, Neisseria
QSGAK

SEQ ID NO: 28088 - protein, 11 aa, Neisseria
MKQLRDNKAQG

SEQ ID NO: 28089 - protein, 11 aa, Neisseria
GDVDATTEAAT

SEQ ID NO: 28090 - protein, 8 aa, Neisseria
PVGERQGE

SEQ ID NO: 28091 - protein, 6 aa, Neisseria
AADSNV

SEQ ID NO: 28092 - protein, 7 aa, Neisseria
PKLEHNG

SEQ ID NO: 28093 - protein, 6 aa, Neisseria
PAKGGA

SEQ ID NO: 28094 - protein, 9 aa, Neisseria
DLTDQELKR

SEQ ID NO: 28095 - protein, 13 aa, Neisseria
PNPDEAAPADNAA

SEQ ID NO: 28096 - protein, 19 aa, Neisseria
APADSAAPAEAKAEDKGAA

SEQ ID NO: 28097 - protein, 8 aa, Neisseria
VDGKKVFE

SEQ ID NO: 28098 - protein, 19 aa, Neisseria
IGKKDDWAPRIKKGKETLH

SEQ ID NO: 28099 - protein, 6 aa, Neisseria
PAKGGN

SEQ ID NO: 28100 - protein, 9 aa, Neisseria
GLSDDEVKA

SEQ ID NO: 28101 - protein, 7 aa, Neisseria
IISALAV

SEQ ID NO: 28102 - protein, 7 aa, Neisseria
ATCMAMV

SEQ ID NO: 28103 - protein, 14 aa, Neisseria
IRQTQQAPKPVSNT

SEQ ID NO: 28104 - protein, 8 aa, Neisseria
QHGKGADA

SEQ ID NO: 28105 - protein, 7 aa, Neisseria
GSGSGSA

SEQ ID NO: 28106 - protein, 36 aa, Neisseria
HTTKHGLDFSNIRQTQQAPKPVSNTEPSAPVPQQQK

SEQ ID NO: 28107 - protein, 6 aa, Neisseria
GKGADA

SEQ ID NO: 28108 - protein, 17 aa, Neisseria
RQTQQAPKPVSNTEPSA

SEQ ID NO: 28109 - protein, 7 aa, Neisseria
IQSAGTV

SEQ ID NO: 28110 - protein, 5 aa, Neisseria
GKKTG

SEQ ID NO: 28111 - protein, 10 aa, Neisseria
SDWMDIEKQR

SEQ ID NO: 28112 - protein, 9 aa, Neisseria
VNLLDTPGH

SEQ ID NO: 28113 - protein, 9 aa, Neisseria
DTYRVLTAV

SEQ ID NO: 28114 - protein, 6 aa, Neisseria
AAKGVE

SEQ ID NO: 28115 - protein, 8 aa, Neisseria
IKLLNVCR

SEQ ID NO: 28116 - protein, 6 aa, Neisseria
KYDREV

SEQ ID NO: 28117 - protein, 14 aa, Neisseria
DSLELLDEVEDILQ

SEQ ID NO: 28118 - protein, 10 aa, Neisseria
KNFKGVYHIL

SEQ ID NO: 28119 - protein, 11 aa, Neisseria
HEFDIIKGINN

SEQ ID NO: 28120 - protein, 5 aa, Neisseria
FGSAI

SEQ ID NO: 28121 - protein, 11 aa, Neisseria
EILNSLIDWAP

SEQ ID NO: 28122 - protein, 7 aa, Neisseria
KFERGMK

SEQ ID NO: 28123 - protein, 8 aa, Neisseria
DIIGIPNH

SEQ ID NO: 28124 - protein, 8 aa, Neisseria
LFRSVRIK

SEQ ID NO: 28125 - protein, 6 aa, Neisseria
PLKIKQ

SEQ ID NO: 28126 - protein, 9 aa, Neisseria
QKGLQQLGE

SEQ ID NO: 28127 - protein, 8 aa, Neisseria
VQVFKPMS

SEQ ID NO: 28128 - protein, 7 aa, Neisseria
SRLANEY

SEQ ID NO: 28129 - protein, 7 aa, Neisseria
AEFEKAN

SEQ ID NO: 28130 - protein, 5 aa, Neisseria
RWPDI

SEQ ID NO: 28131 - protein, 12 aa, Neisseria
EILDQVRRRRTF

SEQ ID NO: 28132 - protein, 11 aa, Neisseria
SHPDAGKTTLT

SEQ ID NO: 28133 - protein, 13 aa, Neisseria
GTVKGKKTGKFAT

SEQ ID NO: 28134 - protein, 10 aa, Neisseria
DWMDIEKQRG

SEQ ID NO: 28135 - protein, 8 aa, Neisseria
FDYKDHTV

SEQ ID NO: 28136 - protein, 16 aa, Neisseria
LLDTPGHQDFSEDTYR

SEQ ID NO: 28137 - protein, 7 aa, Neisseria
DAAKGVE

SEQ ID NO: 28138 - protein, 7 aa, Neisseria
CRLRDTP

SEQ ID NO: 28139 - protein, 20 aa, Neisseria
MNKYDREVRDSLELLDEVED

SEQ ID NO: 28140 - protein, 7 aa, Neisseria
GMGKNFK

SEQ ID NO: 28141 - protein, 8 aa, Neisseria
AGGERLPH

SEQ ID NO: 28142 - protein, 14 aa, Neisseria
KGINNPELEQRFPL

SEQ ID NO: 28143 - protein, 9 aa, Neisseria
QQLRDEIEL

SEQ ID NO: 28144 - protein, 7 aa, Neisseria
ASNEFNL

SEQ ID NO: 28145 - protein, 11 aa, Neisseria
APAPKPRDATM

SEQ ID NO: 28146 - protein, 9 aa, Neisseria
MVGPDEPKF

SEQ ID NO: 28147 - protein, 13 aa, Neisseria
QANMDPKHRDRIA

SEQ ID NO: 28148 - protein, 23 aa, Neisseria
RVCSGKFERGMKMKHLRINREIA

SEQ ID NO: 28149 - protein, 12 aa, Neisseria
SHDRELAEEAYA

SEQ ID NO: 28150 - protein, 5 aa, Neisseria
IPNHG

SEQ ID NO: 28151 - protein, 10 aa, Neisseria
IGDSFSEGEQ

SEQ ID NO: 28152 - protein, 24 aa, Neisseria
VRIKNPLKIKQLQKGLQQLGEEGA

SEQ ID NO: 28153 - protein, 8 aa, Neisseria
RLANEYGV

SEQ ID NO: 28154 - protein, 5 aa, Neisseria
AVFDS

SEQ ID NO: 28155 - protein, 16 aa, Neisseria
SCDDKKKLAEFEKANA

SEQ ID NO: 28156 - protein, 7 aa, Neisseria
APNRVNL

SEQ ID NO: 28157 - protein, 10 aa, Neisseria
LTQERWPDIV

SEQ ID NO: 28158 - protein, 7 aa, Neisseria
ETREHSV

SEQ ID NO: 28159 - protein, 11 aa, Neisseria
EILDQVRRRRT

SEQ ID NO: 28160 - protein, 5 aa, Neisseria
PDAGK

SEQ ID NO: 28161 - protein, 10 aa, Neisseria
GTVKGKKTGK

SEQ ID NO: 28162 - protein, 8 aa, Neisseria
MDIEKQRG

SEQ ID NO: 28163 - protein, 6 aa, Neisseria
DYKDHT

SEQ ID NO: 28164 - protein, 8 aa, Neisseria
QDFSEDTY

SEQ ID NO: 28165 - protein, 7 aa, Neisseria
DAAKGVE

SEQ ID NO: 28166 - protein, 7 aa, Neisseria
CRLRDTP

SEQ ID NO: 28167 - protein, 18 aa, Neisseria
KYDREVRDSLELLDEVED

SEQ ID NO: 28168 - protein, 8 aa, Neisseria
AGGERLPH

SEQ ID NO: 28169 - protein, 9 aa, Neisseria
PELEQRFPL

SEQ ID NO: 28170 - protein, 9 aa, Neisseria
QQLRDEIEL

SEQ ID NO: 28171 - protein, 8 aa, Neisseria
PKPRDATM

SEQ ID NO: 28172 - protein, 8 aa, Neisseria
VGPDEPKF

SEQ ID NO: 28173 - protein, 10 aa, Neisseria
MDPKHRDRIA

SEQ ID NO: 28174 - protein, 21 aa, Neisseria
CSGKFERGMKMKHLRINREIA

SEQ ID NO: 28175 - protein, 12 aa, Neisseria
SHDRELAEEAYA

SEQ ID NO: 28176 - protein, 7 aa, Neisseria
SFSEGEQ

SEQ ID NO: 28177 - protein, 13 aa, Neisseria
VRIKNPLKIKQLQ

SEQ ID NO: 28178 - protein, 6 aa, Neisseria
LGEEGA

SEQ ID NO: 28179 - protein, 16 aa, Neisseria
SCDDKKKLAEFEKANA

SEQ ID NO: 28180 - protein, 6 aa, Neisseria
TQERWP

SEQ ID NO: 28181 - protein, 7 aa, Neisseria
ETREHSV

SEQ ID NO: 28182 - protein, 9 aa, Neisseria
TITRQLAAL

SEQ ID NO: 28183 - protein, 6 aa, Neisseria
EYTANL

SEQ ID NO: 28184 - protein, 7 aa, Neisseria
DIDGLYT

SEQ ID NO: 28185 - protein, 8 aa, Neisseria
VRLDKIEH

SEQ ID NO: 28186 - protein, 6 aa, Neisseria
GMLTKI

SEQ ID NO: 28187 - protein, 11 aa, Neisseria
LKPDSLAEAAE

SEQ ID NO: 28188 - protein, 6 aa, Neisseria
AEHALS

SEQ ID NO: 28189 - protein, 6 aa, Neisseria
IAGIEG

SEQ ID NO: 28190 - protein, 9 aa, Neisseria
SRMDTVTVY

SEQ ID NO: 28191 - protein, 6 aa, Neisseria
KATKQP

SEQ ID NO: 28192 - protein, 7 aa, Neisseria
MKYKRIV

SEQ ID NO: 28193 - protein, 17 aa, Neisseria
SITRSDGSLSRGKIQTI

SEQ ID NO: 28194 - protein, 15 aa, Neisseria
GFKKRPVKIADKQAS

SEQ ID NO: 28195 - protein, 6 aa, Neisseria
LSSDGI

SEQ ID NO: 28196 - protein, 14 aa, Neisseria
ADFADKRRYQNAGG

SEQ ID NO: 28197 - protein, 6 aa, Neisseria
LQRRAI

SEQ ID NO: 28198 - protein, 20 aa, Neisseria
INENDTVSVEELKIGDNDTL

SEQ ID NO: 28199 - protein, 19 aa, Neisseria
GNPNSNPDAVRLDKIEHIN

SEQ ID NO: 28200 - protein, 10 aa, Neisseria
GGSGSANGTG

SEQ ID NO: 28201 - protein, 5 aa, Neisseria
TKIKA

SEQ ID NO: 28202 - protein, 5 aa, Neisseria
AESGV

SEQ ID NO: 28203 - protein, 19 aa, Neisseria
CSSLKPDSLAEAAEHQADG

SEQ ID NO: 28204 - protein, 10 aa, Neisseria
RAKGLRTQKQ

SEQ ID NO: 28205 - protein, 26 aa, Neisseria
YSESRGSVYVDEGAEHALSEQGKSLL

SEQ ID NO: 28206 - protein, 8 aa, Neisseria
GHFSRMDT

SEQ ID NO: 28207 - protein, 13 aa, Neisseria
SKATKQPLGKGRV

SEQ ID NO: 28208 - protein, 12 aa, Neisseria
AAEDLLKSRKAK

SEQ ID NO: 28209 - protein, 8 aa, Neisseria
IHRDDWIS

SEQ ID NO: 28210 - protein, 7 aa, Neisseria
MKYKRIV

SEQ ID NO: 28211 - protein, 14 aa, Neisseria
SITRSDGSLSRGKI

SEQ ID NO: 28212 - protein, 15 aa, Neisseria
GFKKRPVKIADKQAS

SEQ ID NO: 28213 - protein, 11 aa, Neisseria
ADFADKRRYQN

SEQ ID NO: 28214 - protein, 6 aa, Neisseria
LQRRAI

SEQ ID NO: 28215 - protein, 19 aa, Neisseria
NENDTVSVEELKIGDNDTL

SEQ ID NO: 28216 - protein, 17 aa, Neisseria
PNSNPDAVRLDKIEHIN

SEQ ID NO: 28217 - protein, 5 aa, Neisseria
TKIKA

SEQ ID NO: 28218 - protein, 15 aa, Neisseria
LKPDSLAEAAEHQAD

SEQ ID NO: 28219 - protein, 9 aa, Neisseria
RAKGLRTQK

SEQ ID NO: 28220 - protein, 5 aa, Neisseria
SESRG

SEQ ID NO: 28221 - protein, 16 aa, Neisseria
VYVDEGAEHALSEQGK

SEQ ID NO: 28222 - protein, 7 aa, Neisseria
HFSRMDT

SEQ ID NO: 28223 - protein, 12 aa, Neisseria
KATKQPLGKGRV

SEQ ID NO: 28224 - protein, 12 aa, Neisseria
AAEDLLKSRKAK

SEQ ID NO: 28225 - protein, 5 aa, Neisseria
HRDDW

SEQ ID NO: 28226 - protein, 20 aa, Neisseria
AVDVCQRVRQFGRKFRQLAF

SEQ ID NO: 28227 - protein, 13 aa, Neisseria
HHGVKQLFKRFII

SEQ ID NO: 28228 - protein, 8 aa, Neisseria
GFKPIGRH

SEQ ID NO: 28229 - protein, 5 aa, Neisseria
RHCQN

SEQ ID NO: 28230 - protein, 6 aa, Neisseria
QHFGQP

SEQ ID NO: 28231 - protein, 6 aa, Neisseria
ERCQFV

SEQ ID NO: 28232 - protein, 5 aa, Neisseria
MEIRF

SEQ ID NO: 28233 - protein, 9 aa, Neisseria
RFVDDRLPV

SEQ ID NO: 28234 - protein, 13 aa, Neisseria
VCQRVRQFGRKFR

SEQ ID NO: 28235 - protein, 5 aa, Neisseria
LQADN

SEQ ID NO: 28236 - protein, 12 aa, Neisseria
GGFKPIGRHNVQ

SEQ ID NO: 28237 - protein, 18 aa, Neisseria
IRHRGGCFHRHCQNQPFD

SEQ ID NO: 28238 - protein, 8 aa, Neisseria
TFGGGKLR

SEQ ID NO: 28239 - protein, 8 aa, Neisseria
HFGQPVER

SEQ ID NO: 28240 - protein, 9 aa, Neisseria
PAQQRRHKT

SEQ ID NO: 28241 - protein, 5 aa, Neisseria
MEIRF

SEQ ID NO: 28242 - protein, 9 aa, Neisseria
RFVDDRLPV

SEQ ID NO: 28243 - protein, 13 aa, Neisseria
VCQRVRQFGRKFR

SEQ ID NO: 28244 - protein, 8 aa, Neisseria
AQQRRHKT

SEQ ID NO: 28245 - protein, 7 aa, Neisseria
LSYILGF

SEQ ID NO: 28246 - protein, 5 aa, Neisseria
TKESL

SEQ ID NO: 28247 - protein, 6 aa, Neisseria
DFLTWG

SEQ ID NO: 28248 - protein, 18 aa, Neisseria
FSDYLAHPLDIFKVWEGG

SEQ ID NO: 28249 - protein, 7 aa, Neisseria
GFLGVVI

SEQ ID NO: 28250 - protein, 13 aa, Neisseria
FLKLMDTVAPLVP

SEQ ID NO: 28251 - protein, 6 aa, Neisseria
RIGNFI

SEQ ID NO: 28252 - protein, 10 aa, Neisseria
WGRITDINAF

SEQ ID NO: 28253 - protein, 10 aa, Neisseria
PLWAEWLQQY

SEQ ID NO: 28254 - protein, 8 aa, Neisseria
LPRHPSQL

SEQ ID NO: 28255 - protein, 19 aa, Neisseria
YGVFRFIAEFARQPDDYLG

SEQ ID NO: 28256 - protein, 8 aa, Neisseria
LGRRRIAQ

SEQ ID NO: 28257 - protein, 8 aa, Neisseria
FTKESLDD

SEQ ID NO: 28258 - protein, 5 aa, Neisseria
WEGGM

SEQ ID NO: 28259 - protein, 6 aa, Neisseria
SRKHGI

SEQ ID NO: 28260 - protein, 5 aa, Neisseria
ASGRI

SEQ ID NO: 28261 - protein, 10 aa, Neisseria
AHYEDAEAAA

SEQ ID NO: 28262 - protein, 7 aa, Neisseria
PRHPSQL

SEQ ID NO: 28263 - protein, 9 aa, Neisseria
SKKPRPTGQ

SEQ ID NO: 28264 - protein, 9 aa, Neisseria
FARQPDDYL

SEQ ID NO: 28265 - protein, 7 aa, Neisseria
FGMKKQH

SEQ ID NO: 28266 - protein, 6 aa, Neisseria
GRRRIA

SEQ ID NO: 28267 - protein, 7 aa, Neisseria
FTKESLD

SEQ ID NO: 28268 - protein, 9 aa, Neisseria
HYEDAEAAA

SEQ ID NO: 28269 - protein, 7 aa, Neisseria
KKPRPTG

SEQ ID NO: 28270 - protein, 8 aa, Neisseria
FARQPDDY

SEQ ID NO: 28271 - protein, 6 aa, Neisseria
GMKKQH

SEQ ID NO: 28272 - protein, 9 aa, Neisseria
PYIRRFSGS

SEQ ID NO: 28273 - protein, 7 aa, Neisseria
NAMLEKV

SEQ ID NO: 28274 - protein, 6 aa, Neisseria
EFVQGM

SEQ ID NO: 28275 - protein, 13 aa, Neisseria
VNKEIVSMINTYG

SEQ ID NO: 28276 - protein, 10 aa, Neisseria
IGQVGTVESI

SEQ ID NO: 28277 - protein, 7 aa, Neisseria
TGLVKGL

SEQ ID NO: 28278 - protein, 7 aa, Neisseria
GKLAEEL

SEQ ID NO: 28279 - protein, 19 aa, Neisseria
MTNIAGVMDKTGNLLTKLT

SEQ ID NO: 28280 - protein, 5 aa, Neisseria
RIDGL

SEQ ID NO: 28281 - protein, 15 aa, Neisseria
GMLPKIASAVEAAVN

SEQ ID NO: 28282 - protein, 10 aa, Neisseria
ALLLEIFTDA

SEQ ID NO: 28283 - protein, 8 aa, Neisseria
AADKARIL

SEQ ID NO: 28284 - protein, 7 aa, Neisseria
IRRFSGS

SEQ ID NO: 28285 - protein, 7 aa, Neisseria
YGGNAMT

SEQ ID NO: 28286 - protein, 8 aa, Neisseria
PALKEGFA

SEQ ID NO: 28287 - protein, 5 aa, Neisseria
GGGPQ

SEQ ID NO: 28288 - protein, 11 aa, Neisseria
MLEKVGKKGEF

SEQ ID NO: 28289 - protein, 9 aa, Neisseria
RVTDKETMD

SEQ ID NO: 28290 - protein, 5 aa, Neisseria
VNKEI

SEQ ID NO: 28291 - protein, 27 aa, Neisseria
SGRDDHFIKAKKLLVDTPEQNSVDIGQ

SEQ ID NO: 28292 - protein, 7 aa, Neisseria
ESIDTGL

SEQ ID NO: 28293 - protein, 7 aa, Neisseria
LIERGCI

SEQ ID NO: 28294 - protein, 8 aa, Neisseria
GVGEKGEA

SEQ ID NO: 28295 - protein, 10 aa, Neisseria
KLAEELNAEK

SEQ ID NO: 28296 - protein, 22 aa, Neisseria
VMDKTGNLLTKLTPKRIDGLIA

SEQ ID NO: 28297 - protein, 6 aa, Neisseria
AVNGVK

SEQ ID NO: 28298 - protein, 8 aa, Neisseria
IDGRLPNA

SEQ ID NO: 28299 - protein, 8 aa, Neisseria
ILGRGEDA

SEQ ID NO: 28300 - protein, 8 aa, Neisseria
AADKARIL

SEQ ID NO: 28301 - protein, 8 aa, Neisseria
PALKEGFA

SEQ ID NO: 28302 - protein, 11 aa, Neisseria
MLEKVGKKGEF

SEQ ID NO: 28303 - protein, 9 aa, Neisseria
RVTDKETMD

SEQ ID NO: 28304 - protein, 5 aa, Neisseria
VNKEI

SEQ ID NO: 28305 - protein, 24 aa, Neisseria
SGRDDHFIKAKKLLVDTPEQNSVD

SEQ ID NO: 28306 - protein, 7 aa, Neisseria
VGEKGEA

SEQ ID NO: 28307 - protein, 10 aa, Neisseria
KLAEELNAEK

SEQ ID NO: 28308 - protein, 6 aa, Neisseria
VMDKTG

SEQ ID NO: 28309 - protein, 10 aa, Neisseria
LTPKRIDGLI

SEQ ID NO: 28310 - protein, 5 aa, Neisseria
IDGRL

SEQ ID NO: 28311 - protein, 6 aa, Neisseria
GRGEDA

SEQ ID NO: 28312 - protein, 5 aa, Neisseria
YLNST

SEQ ID NO: 28313 - protein, 7 aa, Neisseria
FFKNIKT

SEQ ID NO: 28314 - protein, 10 aa, Neisseria
SLDSVEKTAG

SEQ ID NO: 28315 - protein, 7 aa, Neisseria
NAARTAS

SEQ ID NO: 28316 - protein, 11 aa, Neisseria
SATPETVETAV

SEQ ID NO: 28317 - protein, 22 aa, Neisseria
AAAVQHANTADGVRIFNSLAAT

SEQ ID NO: 28318 - protein, 9 aa, Neisseria
LKAVSDGLD

SEQ ID NO: 28319 - protein, 6 aa, Neisseria
LRVIAQ

SEQ ID NO: 28320 - protein, 10 aa, Neisseria
IGYLKGLFSY

SEQ ID NO: 28321 - protein, 6 aa, Neisseria
EYAEGS

SEQ ID NO: 28322 - protein, 5 aa, Neisseria
LGALG

SEQ ID NO: 28323 - protein, 6 aa, Neisseria
GTLVGL

SEQ ID NO: 28324 - protein, 7 aa, Neisseria
GGFTGAA

SEQ ID NO: 28325 - protein, 8 aa, Neisseria
NGWNGLAR

SEQ ID NO: 28326 - protein, 9 aa, Neisseria
MSARGKGAG

SEQ ID NO: 28327 - protein, 7 aa, Neisseria
NSTGRHV

SEQ ID NO: 28328 - protein, 8 aa, Neisseria
KIGQDYSF

SEQ ID NO: 28329 - protein, 9 aa, Neisseria
KNIKTDGGL

SEQ ID NO: 28330 - protein, 15 aa, Neisseria
DSVEKTAGSEGDTPS

SEQ ID NO: 28331 - protein, 12 aa, Neisseria
YVRRGNAARTAS

SEQ ID NO: 28332 - protein, 11 aa, Neisseria
HAVEQGGSNLE

SEQ ID NO: 28333 - protein, 14 aa, Neisseria
LDASESSATPETVE

SEQ ID NO: 28334 - protein, 18 aa, Neisseria
AVADRTDMPGIRLRRTTF

SEQ ID NO: 28335 - protein, 7 aa, Neisseria
NTADGVR

SEQ ID NO: 28336 - protein, 7 aa, Neisseria
YADSAAA

SEQ ID NO: 28337 - protein, 21 aa, Neisseria
DMQGRRLKAVSDGLDHNGTGL

SEQ ID NO: 28338 - protein, 21 aa, Neisseria
TQQDGGTWEQGGVEGKMRGST

SEQ ID NO: 28339 - protein, 9 aa, Neisseria
AAKTGENTT

SEQ ID NO: 28340 - protein, 18 aa, Neisseria
IGRSTWSENSANAKTDSI

SEQ ID NO: 28341 - protein, 7 aa, Neisseria
IRHDVGD

SEQ ID NO: 28342 - protein, 20 aa, Neisseria
SYGRYKNSISRSTGADEYAE

SEQ ID NO: 28343 - protein, 17 aa, Neisseria
ATGDLTVEGGLRHDLLK

SEQ ID NO: 28344 - protein, 21 aa, Neisseria
DAFAEKGSALGWSGNSLTEGT

SEQ ID NO: 28345 - protein, 10 aa, Neisseria
LSQPLSDKAV

SEQ ID NO: 28346 - protein, 13 aa, Neisseria
AGVERDLNGRDYA

SEQ ID NO: 28347 - protein, 17 aa, Neisseria
ATGKTGARNMPHTRRVA

SEQ ID NO: 28348 - protein, 7 aa, Neisseria
VEFGNGW

SEQ ID NO: 28349 - protein, 13 aa, Neisseria
SYTGSKQYGNHSG

SEQ ID NO: 28350 - protein, 7 aa, Neisseria
MSARGKG

SEQ ID NO: 28351 - protein, 5 aa, Neisseria
IKTDG

SEQ ID NO: 28352 - protein, 13 aa, Neisseria
DSVEKTAGSEGDT

SEQ ID NO: 28353 - protein, 12 aa, Neisseria
YVRRGNAARTAS

SEQ ID NO: 28354 - protein, 10 aa, Neisseria
HAVEQGGSNL

SEQ ID NO: 28355 - protein, 14 aa, Neisseria
LDASESSATPETVE

SEQ ID NO: 28356 - protein, 18 aa, Neisseria
AVADRTDMPGIRLRRTTF

SEQ ID NO: 28357 - protein, 5 aa, Neisseria
NTADG

SEQ ID NO: 28358 - protein, 19 aa, Neisseria
DMQGRRLKAVSDGLDHNGT

SEQ ID NO: 28359 - protein, 11 aa, Neisseria
GGVEGKMRGST

SEQ ID NO: 28360 - protein, 7 aa, Neisseria
KTGENTT

SEQ ID NO: 28361 - protein, 9 aa, Neisseria
NSANAKTDS

SEQ ID NO: 28362 - protein, 7 aa, Neisseria
IRHDVGD

SEQ ID NO: 28363 - protein, 17 aa, Neisseria
RYKNSISRSTGADEYAE

SEQ ID NO: 28364 - protein, 9 aa, Neisseria
GGLRHDLLK

SEQ ID NO: 28365 - protein, 8 aa, Neisseria
DAFAEKGS

SEQ ID NO: 28366 - protein, 8 aa, Neisseria
QPLSDKAV

SEQ ID NO: 28367 - protein, 13 aa, Neisseria
AGVERDLNGRDYA

SEQ ID NO: 28368 - protein, 17 aa, Neisseria
ATGKTGARNMPHTRRVA

SEQ ID NO: 28369 - protein, 10 aa, Neisseria
SSTMRPIGEI

SEQ ID NO: 28370 - protein, 5 aa, Neisseria
IEPYG

SEQ ID NO: 28371 - protein, 8 aa, Neisseria
PAEAFKLP

SEQ ID NO: 28372 - protein, 7 aa, Neisseria
ADALRHI

SEQ ID NO: 28373 - protein, 6 aa, Neisseria
FHAIGA

SEQ ID NO: 28374 - protein, 9 aa, Neisseria
NLLAAMLDN

SEQ ID NO: 28375 - protein, 19 aa, Neisseria
QLRNIIDGMGKPVDGVMRP

SEQ ID NO: 28376 - protein, 10 aa, Neisseria
DISDLKERFG

SEQ ID NO: 28377 - protein, 14 aa, Neisseria
AMAALLKDAIKPNL

SEQ ID NO: 28378 - protein, 7 aa, Neisseria
QTIEGTP

SEQ ID NO: 28379 - protein, 25 aa, Neisseria
PFANIAHGCNSVTATRLAKHLADYA

SEQ ID NO: 28380 - protein, 5 aa, Neisseria
ATVRA

SEQ ID NO: 28381 - protein, 23 aa, Neisseria
LEALAKGLPNLLKHISNLKNVFG

SEQ ID NO: 28382 - protein, 8 aa, Neisseria
SLTEVWGK

SEQ ID NO: 28383 - protein, 13 aa, Neisseria
DLARKVVNAIDNQ

SEQ ID NO: 28384 - protein, 6 aa, Neisseria
IASLEK

SEQ ID NO: 28385 - protein, 6 aa, Neisseria
LGCPEG

SEQ ID NO: 28386 - protein, 19 aa, Neisseria
VALCGNMMKMPGLPKVPAA

SEQ ID NO: 28387 - protein, 17 aa, Neisseria
FKTDAETAQSSTMRPIG

SEQ ID NO: 28388 - protein, 10 aa, Neisseria
LNVDNIEPYG

SEQ ID NO: 28389 - protein, 19 aa, Neisseria
YKAKINPAEAFKLPQKQGR

SEQ ID NO: 28390 - protein, 11 aa, Neisseria
NPTPAGEGKTT

SEQ ID NO: 28391 - protein, 21 aa, Neisseria
DALRHIGKDSVIALREPSLGP

SEQ ID NO: 28392 - protein, 9 aa, Neisseria
VKGGAAGGG

SEQ ID NO: 28393 - protein, 14 aa, Neisseria
QGNELNIDPKRVLW

SEQ ID NO: 28394 - protein, 32 aa, Neisseria; identical to SEQ ID NO: 2294

SEQ ID NO: 28395 - protein, 11 aa, Neisseria
KDISDLKERFG

SEQ ID NO: 28396 - protein, 9 aa, Neisseria
YAKDGSPVY

SEQ ID NO: 28397 - protein, 5 aa, Neisseria
KDLKA

SEQ ID NO: 28398 - protein, 7 aa, Neisseria
DAIKPNL

SEQ ID NO: 28399 - protein, 7 aa, Neisseria
RLAKHLA

SEQ ID NO: 28400 - protein, 20 aa, Neisseria
LGAEKFCDIKCRLAGLKPDA

SEQ ID NO: 28401 - protein, 21 aa, Neisseria
LKYNGGVERANLGEENLEALA

SEQ ID NO: 28402 - protein, 17 aa, Neisseria
FVSDSDAELAMIEKACA

SEQ ID NO: 28403 - protein, 17 aa, Neisseria
WGKGGAGGADLARKVVN

SEQ ID NO: 28404 - protein, 8 aa, Neisseria
IDNQPNNF

SEQ ID NO: 28405 - protein, 11 aa, Neisseria
LGIKDKIRAIA

SEQ ID NO: 28406 - protein, 10 aa, Neisseria
YGAEDVDFSA

SEQ ID NO: 28407 - protein, 12 aa, Neisseria
ASLEKLGLDKMP

SEQ ID NO: 28408 - protein, 8 aa, Neisseria
SLSDNAKL

SEQ ID NO: 28409 - protein, 6 aa, Neisseria
GCPEGF

SEQ ID NO: 28410 - protein, 5 aa, Neisseria
MPGLP

SEQ ID NO: 28411 - protein, 12 aa, Neisseria
PAAEKIDVDEHG

SEQ ID NO: 28412 - protein, 9 aa, Neisseria
FKTDAETAQ

SEQ ID NO: 28413 - protein, 7 aa, Neisseria
YKAKINP

SEQ ID NO: 28414 - protein, 11 aa, Neisseria
EAFKLPQKQGR

SEQ ID NO: 28415 - protein, 7 aa, Neisseria
PAGEGKT

SEQ ID NO: 28416 - protein, 18 aa, Neisseria
DALRHIGKDSVIALREPS

SEQ ID NO: 28417 - protein, 10 aa, Neisseria
LNIDPKRVLW

SEQ ID NO: 28418 - protein, 14 aa, Neisseria
RVVDMNDRQLRNII

SEQ ID NO: 28419 - protein, 15 aa, Neisseria
GMGKPVDGVMRPDGF

SEQ ID NO: 28420 - protein, 11 aa, Neisseria
KDISDLKERFG

SEQ ID NO: 28421 - protein, 5 aa, Neisseria
AKDGS

SEQ ID NO: 28422 - protein, 5 aa, Neisseria
KDLKA

SEQ ID NO: 28423 - protein, 7 aa, Neisseria
RLAKHLA

SEQ ID NO: 28424 - protein, 20 aa, Neisseria
LGAEKFCDIKCRLAGLKPDA

SEQ ID NO: 28425 - protein, 17 aa, Neisseria
GGVERANLGEENLEALA

SEQ ID NO: 28426 - protein, 17 aa, Neisseria
FVSDSDAELAMIEKACA

SEQ ID NO: 28427 - protein, 8 aa, Neisseria
DLARKVVN

SEQ ID NO: 28428 - protein, 11 aa, Neisseria
LGIKDKIRAIA

SEQ ID NO: 28429 - protein, 10 aa, Neisseria
YGAEDVDFSA

SEQ ID NO: 28430 - protein, 12 aa, Neisseria
ASLEKLGLDKMP

SEQ ID NO: 28431 - protein, 12 aa, Neisseria
PAAEKIDVDEHG

SEQ ID NO: 28432 - protein, 11 aa, Neisseria
RFAAMPNMVGK

SEQ ID NO: 28433 - protein, 7 aa, Neisseria
GQPGKMF

SEQ ID NO: 28434 - protein, 6 aa, Neisseria
AVTPCR

SEQ ID NO: 28435 - protein, 7 aa, Neisseria
VCRDDMN

SEQ ID NO: 28436 - protein, 24 aa, Neisseria
GCHRITERSLKSFLQIRHFSPLNR

SEQ ID NO: 28437 - protein, 13 aa, Neisseria
PLFGRQAGQPGKM

SEQ ID NO: 28438 - protein, 19 aa, Neisseria
HIDAEAAVFRQDRNDSRTP

SEQ ID NO: 28439 - protein, 46 aa, Neisseria
HHGRRLVGNRRNRRHCNAVTPCRTVCRDDMNACRTGCHRITERSLK

SEQ ID NO: 28440 - protein, 18 aa, Neisseria
SPLNRPLYKNAAHKASPH

SEQ ID NO: 28441 - protein, 5 aa, Neisseria
QAGQP

SEQ ID NO: 28442 - protein, 18 aa, Neisseria
HIDAEAAVFRQDRNDSRT

SEQ ID NO: 28443 - protein, 15 aa, Neisseria
HGRRLVGNRRNRRHC

SEQ ID NO: 28444 - protein, 11 aa, Neisseria
TVCRDDMNACR

SEQ ID NO: 28445 - protein, 8 aa, Neisseria
RITERSLK

SEQ ID NO: 28446 - protein, 7 aa, Neisseria
AAHKASP

SEQ ID NO: 28447 - protein, 8 aa, Neisseria
LGGIVQEF

SEQ ID NO: 28448 - protein, 6 aa, Neisseria
VLADGV

SEQ ID NO: 28449 - protein, 6 aa, Neisseria
FDDAAS

SEQ ID NO: 28450 - protein, 11 aa, Neisseria
INKQIGRVAGR

SEQ ID NO: 28451 - protein, 7 aa, Neisseria
YRYLSRH

SEQ ID NO: 28452 - protein, 12 aa, Neisseria
GPARCGSAYSAG

SEQ ID NO: 28453 - protein, 18 aa, Neisseria
SGRCRKTARLNGFRRPRS

SEQ ID NO: 28454 - protein, 17 aa, Neisseria
MSDTPATRDFGLIDGRA

SEQ ID NO: 28455 - protein, 7 aa, Neisseria
LSNRRGT

SEQ ID NO: 28456 - protein, 8 aa, Neisseria
ADGVRENP

SEQ ID NO: 28457 - protein, 20 aa, Neisseria
SFDDAASYADNPFQINKQIG

SEQ ID NO: 28458 - protein, 9 aa, Neisseria
VAGRIRGAA

SEQ ID NO: 28459 - protein, 23 aa, Neisseria
DINGRTYRVEANEGRNALHGGSH

SEQ ID NO: 28460 - protein, 11 aa, Neisseria
VAADGRRLSQR

SEQ ID NO: 28461 - protein, 9 aa, Neisseria
PLGRGRPAY

SEQ ID NO: 28462 - protein, 18 aa, Neisseria
YLSRHRARRHGVRPDAAH

SEQ ID NO: 28463 - protein, 10 aa, Neisseria
AGRGPARCGS

SEQ ID NO: 28464 - protein, 25 aa, Neisseria
SAGRTYSGRCRKTARLNGFRRPRSI

SEQ ID NO: 28465 - protein, 9 aa, Neisseria
MSDTPATRD

SEQ ID NO: 28466 - protein, 6 aa, Neisseria
SNRRGT

SEQ ID NO: 28467 - protein, 7 aa, Neisseria
DGVRENP

SEQ ID NO: 28468 - protein, 7 aa, Neisseria
SFDDAAS

SEQ ID NO: 28469 - protein, 9 aa, Neisseria
VAGRIRGAA

SEQ ID NO: 28470 - protein, 17 aa, Neisseria
INGRTYRVEANEGRNAL

SEQ ID NO: 28471 - protein, 9 aa, Neisseria
AADGRRLSQ

SEQ ID NO: 28472 - protein, 6 aa, Neisseria
GRGRPA

SEQ ID NO: 28473 - protein, 14 aa, Neisseria
SRHRARRHGVRPDA

SEQ ID NO: 28474 - protein, 7 aa, Neisseria
GRGPARC

SEQ ID NO: 28475 - protein, 12 aa, Neisseria
RTYSGRCRKTAR

SEQ ID NO: 28476 - protein, 9 aa, Neisseria
NGFRRPRSI

SEQ ID NO: 28477 - protein, 10 aa, Neisseria
QYGLFDFMPC

SEQ ID NO: 28478 - protein, 8 aa, Neisseria
PLDNFPTV

SEQ ID NO: 28479 - protein, 7 aa, Neisseria
LRACAVI

SEQ ID NO: 28480 - protein, 5 aa, Neisseria
ARRMR

SEQ ID NO: 28481 - protein, 8 aa, Neisseria
RHQRGFAR

SEQ ID NO: 28482 - protein, 8 aa, Neisseria
IDHDKVEQ

SEQ ID NO: 28483 - protein, 9 aa, Neisseria
CLRQPPLDN

SEQ ID NO: 28484 - protein, 36 aa, Neisseria
VRPAPFEARGKHVERRRQDKDTDSFRQRVANLRRAL

SEQ ID NO: 28485 - protein, 9 aa, Neisseria
ACRRQRIHA

SEQ ID NO: 28486 - protein, 8 aa, Neisseria
SLLRDKRF

SEQ ID NO: 28487 - protein, 11 aa, Neisseria
RRARRMRHGNA

SEQ ID NO: 28488 - protein, 10 aa, Neisseria
QQPRHQRGFA

SEQ ID NO: 28489 - protein, 14 aa, Neisseria
AGSGRNDKDVAFSI

SEQ ID NO: 28490 - protein, 5 aa, Neisseria
VSQRT

SEQ ID NO: 28491 - protein, 8 aa, Neisseria
IDHDKVEQ

SEQ ID NO: 28492 - protein, 33 aa, Neisseria
APFEARGKHVERRRQDKDTDSFRQRVANLRRAL

SEQ ID NO: 28493 - protein, 9 aa, Neisseria
ACRRQRIHA

SEQ ID NO: 28494 - protein, 8 aa, Neisseria
SLLRDKRF

SEQ ID NO: 28495 - protein, 10 aa, Neisseria
RRARRMRHGN

SEQ ID NO: 28496 - protein, 9 aa, Neisseria
QPRHQRGFA

SEQ ID NO: 28497 - protein, 10 aa, Neisseria
GSGRNDKDVA

SEQ ID NO: 28498 - protein, 11 aa, Neisseria
ADKIRKIENWP

SEQ ID NO: 28499 - protein, 12 aa, Neisseria
QSAEYFRLLVDL

SEQ ID NO: 28500 - protein, 13 aa, Neisseria
AGLELIRKLGGEI

SEQ ID NO: 28501 - protein, 17 aa, Neisseria
AAAILEFTDLQGGKNIR

SEQ ID NO: 28502 - protein, 5 aa, Neisseria
KTSNL

SEQ ID NO: 28503 - protein, 15 aa, Neisseria
LADKIRKIENWPQKG

SEQ ID NO: 28504 - protein, 7 aa, Neisseria
MDQKIDI

SEQ ID NO: 28505 - protein, 5 aa, Neisseria
LDARG

SEQ ID NO: 28506 - protein, 9 aa, Neisseria
PIRKKGKLP

SEQ ID NO: 28507 - protein, 6 aa, Neisseria
YGEAAV

SEQ ID NO: 28508 - protein, 11 aa, Neisseria
IHTDAVKPGSR

SEQ ID NO: 28509 - protein, 12 aa, Neisseria
ELIRKLGGEIVE

SEQ ID NO: 28510 - protein, 15 aa, Neisseria
TDLQGGKNIRASGAP

SEQ ID NO: 28511 - protein, 8 aa, Neisseria
QNEGCMKG

SEQ ID NO: 28512 - protein, 12 aa, Neisseria
LADKIRKIENWP

SEQ ID NO: 28513 - protein, 7 aa, Neisseria
MDQKIDI

SEQ ID NO: 28514 - protein, 9 aa, Neisseria
PIRKKGKLP

SEQ ID NO: 28515 - protein, 6 aa, Neisseria
YGEAAV

SEQ ID NO: 28516 - protein, 10 aa, Neisseria
IHTDAVKPGS

SEQ ID NO: 28517 - protein, 12 aa, Neisseria
ELIRKLGGEIVE

SEQ ID NO: 28518 - protein, 7 aa, Neisseria
KNIRASG

SEQ ID NO: 28519 - protein, 5 aa, Neisseria
GCMKG

SEQ ID NO: 28520 - protein, 12 aa, Neisseria
NLGDALDGVPGI

SEQ ID NO: 28521 - protein, 17 aa, Neisseria
TGRRIKVLNHHGETGDM

SEQ ID NO: 28522 - protein, 10 aa, Neisseria
QVEILRGPVT

SEQ ID NO: 28523 - protein, 6 aa, Neisseria
VAGLVD

SEQ ID NO: 28524 - protein, 7 aa, Neisseria
PEKMPEN

SEQ ID NO: 28525 - protein, 5 aa, Neisseria
NLEKL

SEQ ID NO: 28526 - protein, 11 aa, Neisseria
YRNLKRLPDSH

SEQ ID NO: 28527 - protein, 5 aa, Neisseria
FPGFE

SEQ ID NO: 28528 - protein, 11 aa, Neisseria
AGDAVENFFNN

SEQ ID NO: 28529 - protein, 6 aa, Neisseria
PIGRLK

SEQ ID NO: 28530 - protein, 6 aa, Neisseria
AIPETV

SEQ ID NO: 28531 - protein, 8 aa, Neisseria
QPLPDLGA

SEQ ID NO: 28532 - protein, 9 aa, Neisseria
RFGNYIYAQ

SEQ ID NO: 28533 - protein, 11 aa, Neisseria
NDGRGPKSIED

SEQ ID NO: 28534 - protein, 9 aa, Neisseria
RGRLKNLPS

SEQ ID NO: 28535 - protein, 5 aa, Neisseria
LTDRI

SEQ ID NO: 28536 - protein, 5 aa, Neisseria
HETEQ

SEQ ID NO: 28537 - protein, 10 aa, Neisseria
GKSRPRATSG

SEQ ID NO: 28538 - protein, 16 aa, Neisseria
TASDKIISGDTLRQKA

SEQ ID NO: 28539 - protein, 11 aa, Neisseria
IRGQTGRRIKV

SEQ ID NO: 28540 - protein, 16 aa, Neisseria
NHHGETGDMADFSPDH

SEQ ID NO: 28541 - protein, 6 aa, Neisseria
EILRGP

SEQ ID NO: 28542 - protein, 22 aa, Neisseria
DVADGKIPEKMPENGVSGEAGL

SEQ ID NO: 28543 - protein, 11 aa, Neisseria
LSSGNLEKLTS

SEQ ID NO: 28544 - protein, 30 aa, Neisseria; identical to SEQ ID NO: 2474

SEQ ID NO: 28545 - protein, 5 aa, Neisseria
GEKGF

SEQ ID NO: 28546 - protein, 23 aa, Neisseria
AYSDRRDRYGLPAHSHEYDDCHA

SEQ ID NO: 28547 - protein, 8 aa, Neisseria
SLINKRYL

SEQ ID NO: 28548 - protein, 13 aa, Neisseria
LTEEDIDYDNPGL

SEQ ID NO: 28549 - protein, 10 aa, Neisseria
CGFHDGDGAH

SEQ ID NO: 28550 - protein, 28 aa, Neisseria
HTHNGKPWIDLRNKRYELRAEWKQPFPG

SEQ ID NO: 28551 - protein, 17 aa, Neisseria
HLNRNDYHHDEKAGDAV

SEQ ID NO: 28552 - protein, 24 aa, Neisseria
FNNKTHNARIELRHQPIGRLKGSW

SEQ ID NO: 28553 - protein, 7 aa, Neisseria
LGQKSSA

SEQ ID NO: 28554 - protein, 5 aa, Neisseria
PETVQ

SEQ ID NO: 28555 - protein, 7 aa, Neisseria
LIDNNVR

SEQ ID NO: 28556 - protein, 40 aa, Neisseria
ANWDNFTLEGGVRVEKQKASIRYDKALIDRENYYNQPLPD

SEQ ID NO: 28557 - protein, 16 aa, Neisseria
SHQERLPSTQELYAHG

SEQ ID NO: 28558 - protein, 14 aa, Neisseria
VGNKHLNKERSNNI

SEQ ID NO: 28559 - protein, 8 aa, Neisseria
GYEGDRWQ

SEQ ID NO: 28560 - protein, 7 aa, Neisseria
YRNRFGN

SEQ ID NO: 28561 - protein, 19 aa, Neisseria
TLNDGRGPKSIEDDSEMKL

SEQ ID NO: 28562 - protein, 14 aa, Neisseria
RYNQSGADFYGAEG

SEQ ID NO: 28563 - protein, 11 aa, Neisseria
IYFKPTPRYRI

SEQ ID NO: 28564 - protein, 28 aa, Neisseria
VSGDYVRGRLKNLPSLPGREDPYGKRPF

SEQ ID NO: 28565 - protein, 11 aa, Neisseria
QADQNAPRIPA

SEQ ID NO: 28566 - protein, 13 aa, Neisseria
TSLTDRIDANLDY

SEQ ID NO: 28567 - protein, 13 aa, Neisseria
NKLARYETRTPGH

SEQ ID NO: 28568 - protein, 13 aa, Neisseria
GANYRRNTRYGEW

SEQ ID NO: 28569 - protein, 5 aa, Neisseria
ADNLL

SEQ ID NO: 28570 - protein, 16 aa, Neisseria
FLSDTPQMGRSFTGGV

SEQ ID NO: 28571 - protein, 5 aa, Neisseria
HETEQ

SEQ ID NO: 28572 - protein, 8 aa, Neisseria
GKSRPRAT

SEQ ID NO: 28573 - protein, 8 aa, Neisseria
TASDKIIS

SEQ ID NO: 28574 - protein, 7 aa, Neisseria
DTLRQKA

SEQ ID NO: 28575 - protein, 8 aa, Neisseria
QTGRRIKV

SEQ ID NO: 28576 - protein, 11 aa, Neisseria
GETGDMADFSP

SEQ ID NO: 28577 - protein, 18 aa, Neisseria
DVADGKIPEKMPENGVSG

SEQ ID NO: 28578 - protein, 9 aa, Neisseria
SSGNLEKLT

SEQ ID NO: 28579 - protein, 8 aa, Neisseria
GLYRKSGD

SEQ ID NO: 28580 - protein, 17 aa, Neisseria
RYRNLKRLPDSHADSQT

SEQ ID NO: 28581 - protein, 9 aa, Neisseria
YSDRRDRYG

SEQ ID NO: 28582 - protein, 8 aa, Neisseria
HEYDDCHA

SEQ ID NO: 28583 - protein, 10 aa, Neisseria
LTEEDIDYDN

SEQ ID NO: 28584 - protein, 7 aa, Neisseria
HDGDGAH

SEQ ID NO: 28585 - protein, 12 aa, Neisseria
LRNKRYELRAEW

SEQ ID NO: 28586 - protein, 17 aa, Neisseria
HLNRNDYHHDEKAGDAV

SEQ ID NO: 28587 - protein, 11 aa, Neisseria
KTHNARIELRH

SEQ ID NO: 28588 - protein, 5 aa, Neisseria
GRLKG

SEQ ID NO: 28589 - protein, 24 aa, Neisseria
GGVRVEKQKASIRYDKALIDRENY

SEQ ID NO: 28590 - protein, 8 aa, Neisseria
SHQERLPS

SEQ ID NO: 28591 - protein, 9 aa, Neisseria
HLNKERSNN

SEQ ID NO: 28592 - protein, 6 aa, Neisseria
YEGDRW

SEQ ID NO: 28593 - protein, 5 aa, Neisseria
YRNRF

SEQ ID NO: 28594 - protein, 18 aa, Neisseria
LNDGRGPKSIEDDSEMKL

SEQ ID NO: 28595 - protein, 5 aa, Neisseria
YGAEG

SEQ ID NO: 28596 - protein, 7 aa, Neisseria
PTPRYRI

SEQ ID NO: 28597 - protein, 9 aa, Neisseria
DYVRGRLKN

SEQ ID NO: 28598 - protein, 9 aa, Neisseria
PGREDPYGK

SEQ ID NO: 28599 - protein, 7 aa, Neisseria
ADQNAPR

SEQ ID NO: 28600 - protein, 8 aa, Neisseria
SLTDRIDA

SEQ ID NO: 28601 - protein, 11 aa, Neisseria
KLARYETRTPG

SEQ ID NO: 28602 - protein, 9 aa, Neisseria
NYRRNTRYG

SEQ ID NO: 28603 - protein, 7 aa, Neisseria
GEILDLL

SEQ ID NO: 28604 - protein, 6 aa, Neisseria
LLSHFE

SEQ ID NO: 28605 - protein, 6 aa, Neisseria
FVKGYA

SEQ ID NO: 28606 - protein, 14 aa, Neisseria
IAGVLHRFPAKLTA

SEQ ID NO: 28607 - protein, 10 aa, Neisseria
QFAGLLRPLA

SEQ ID NO: 28608 - protein, 6 aa, Neisseria
GVAPFR

SEQ ID NO: 28609 - protein, 8 aa, Neisseria
TEWQQFAK

SEQ ID NO: 28610 - protein, 5 aa, Neisseria
IREQA

SEQ ID NO: 28611 - protein, 18 aa, Neisseria
AAKMAKEVEAALLDVIIG

SEQ ID NO: 28612 - protein, 8 aa, Neisseria
YCKADPFP

SEQ ID NO: 28613 - protein, 24 aa, Neisseria
QKITARQSDKDVRHIEIDLSGSDL

SEQ ID NO: 28614 - protein, 5 aa, Neisseria
LPGDA

SEQ ID NO: 28615 - protein, 8 aa, Neisseria
FDNDPALV

SEQ ID NO: 28616 - protein, 13 aa, Neisseria
NPATEIQAGGKTL

SEQ ID NO: 28617 - protein, 8 aa, Neisseria
LTQNTPAF

SEQ ID NO: 28618 - protein, 11 aa, Neisseria
ADNDELDRIAA

SEQ ID NO: 28619 - protein, 12 aa, Neisseria
SSSQAEAGDEVH

SEQ ID NO: 28620 - protein, 17 aa, Neisseria
RFEHEGRARAGGASGFF

SEQ ID NO: 28621 - protein, 9 aa, Neisseria
DRLEEDGTV

SEQ ID NO: 28622 - protein, 17 aa, Neisseria
FAERNDGFRLPEDSRKP

SEQ ID NO: 28623 - protein, 5 aa, Neisseria
GSGTG

SEQ ID NO: 28624 - protein, 11 aa, Neisseria
QRAAENAEGRN

SEQ ID NO: 28625 - protein, 25 aa, Neisseria
QFAKDGFLHRYDFAWSRDQEEKIYV

SEQ ID NO: 28626 - protein, 8 aa, Neisseria
DKIREQAE

SEQ ID NO: 28627 - protein, 10 aa, Neisseria
DAAKMAKEVE

SEQ ID NO: 28628 - protein, 12 aa, Neisseria
AGHSDEDGAEGY

SEQ ID NO: 28629 - protein, 13 aa, Neisseria
MLREEKRYQRDVY

SEQ ID NO: 28630 - protein, 20 aa, Neisseria
KITARQSDKDVRHIEIDLSG

SEQ ID NO: 28631 - protein, 8 aa, Neisseria
TEIQAGGK

SEQ ID NO: 28632 - protein, 11 aa, Neisseria
ADNDELDRIAA

SEQ ID NO: 28633 - protein, 10 aa, Neisseria
SQAEAGDEVH

SEQ ID NO: 28634 - protein, 12 aa, Neisseria
RFEHEGRARAGG

SEQ ID NO: 28635 - protein, 9 aa, Neisseria
DRLEEDGTV

SEQ ID NO: 28636 - protein, 17 aa, Neisseria
FAERNDGFRLPEDSRKP

SEQ ID NO: 28637 - protein, 9 aa, Neisseria
RAAENAEGR

SEQ ID NO: 28638 - protein, 11 aa, Neisseria
WSRDQEEKIYV

SEQ ID NO: 28639 - protein, 8 aa, Neisseria
DKIREQAE

SEQ ID NO: 28640 - protein, 10 aa, Neisseria
DAAKMAKEVE

SEQ ID NO: 28641 - protein, 11 aa, Neisseria
GHSDEDGAEGY

SEQ ID NO: 28642 - protein, 13 aa, Neisseria
MLREEKRYQRDVY

SEQ ID NO: 28643 - protein, 6 aa, Neisseria
NIAIIA

SEQ ID NO: 28644 - protein, 5 aa, Neisseria
DQLLR

SEQ ID NO: 28645 - protein, 5 aa, Neisseria
DTPGH

SEQ ID NO: 28646 - protein, 14 aa, Neisseria
GGEVERVLGMVDCV

SEQ ID NO: 28647 - protein, 5 aa, Neisseria
KIDKP

SEQ ID NO: 28648 - protein, 10 aa, Neisseria
FELFDNLGAT

SEQ ID NO: 28649 - protein, 14 aa, Neisseria
SGLSGFAKLEETDE

SEQ ID NO: 28650 - protein, 12 aa, Neisseria
MRPLFDTILKYT

SEQ ID NO: 28651 - protein, 15 aa, Neisseria
GRINQLLGFKGLERV

SEQ ID NO: 28652 - protein, 7 aa, Neisseria
VIISGIE

SEQ ID NO: 28653 - protein, 9 aa, Neisseria
IRDRLQKEL

SEQ ID NO: 28654 - protein, 5 aa, Neisseria
DTADA

SEQ ID NO: 28655 - protein, 10 aa, Neisseria
CEPYENLTVD

SEQ ID NO: 28656 - protein, 6 aa, Neisseria
LTRGVG

SEQ ID NO: 28657 - protein, 6 aa, Neisseria
MSHVFD

SEQ ID NO: 28658 - protein, 8 aa, Neisseria
KGKKLTNI

SEQ ID NO: 28659 - protein, 7 aa, Neisseria
EAVRLTT

SEQ ID NO: 28660 - protein, 5 aa, Neisseria
MKQIR

SEQ ID NO: 28661 - protein, 8 aa, Neisseria
VDHGKTTL

SEQ ID NO: 28662 - protein, 30 aa, Neisseria; identical to SEQ ID NO: 2616

SEQ ID NO: 28663 - protein, 10 aa, Neisseria
NTAIDYEGCH

SEQ ID NO: 28664 - protein, 15 aa, Neisseria
VDTPGHADFGGEVER

SEQ ID NO: 28665 - protein, 14 aa, Neisseria
DAQEGPMPQTRFVT

SEQ ID NO: 28666 - protein, 11 aa, Neisseria
KIDKPSARPSW

SEQ ID NO: 28667 - protein, 8 aa, Neisseria
GATDEQLD

SEQ ID NO: 28668 - protein, 15 aa, Neisseria
AKLEETDESSDMRPL

SEQ ID NO: 28669 - protein, 12 aa, Neisseria
TPAPSGSADEPL

SEQ ID NO: 28670 - protein, 8 aa, Neisseria
LDYDNYTG

SEQ ID NO: 28671 - protein, 9 aa, Neisseria
LNGRIKPGQ

SEQ ID NO: 28672 - protein, 6 aa, Neisseria
HEQQIA

SEQ ID NO: 28673 - protein, 15 aa, Neisseria
KGLERVPLEEAEAGD

SEQ ID NO: 28674 - protein, 6 aa, Neisseria
GIEDIG

SEQ ID NO: 28675 - protein, 11 aa, Neisseria
ITDKDNPKGLP

SEQ ID NO: 28676 - protein, 7 aa, Neisseria
SVDEPTL

SEQ ID NO: 28677 - protein, 26 aa, Neisseria
TSPLAGTEGKFVTSRQIRDRLQKELL

SEQ ID NO: 28678 - protein, 20 aa, Neisseria
LRVEDTADADVFRVSGRGEL

SEQ ID NO: 28679 - protein, 7 aa, Neisseria
NMRREGY

SEQ ID NO: 28680 - protein, 60 aa, Neisseria; identical to SEQ ID NO: 2634

SEQ ID NO: 28681 - protein, 18 aa, Neisseria
VFDDYAPVKPDMPGRHNG

SEQ ID NO: 28682 - protein, 5 aa, Neisseria
QEQGE

SEQ ID NO: 28683 - protein, 17 aa, Neisseria
NLEDRGRMFVSPNDKIY

SEQ ID NO: 28684 - protein, 8 aa, Neisseria
IHSRDNDL

SEQ ID NO: 28685 - protein, 20 aa, Neisseria
PLKGKKLTNIRASGTDEAVR

SEQ ID NO: 28686 - protein, 9 aa, Neisseria
FIDDDELVE

SEQ ID NO: 28687 - protein, 9 aa, Neisseria
TPQSIRLRM

SEQ ID NO: 28688 - protein, 13 aa, Neisseria
SELERRRHFKKLD

SEQ ID NO: 28689 - protein, 5 aa, Neisseria
MKQIR

SEQ ID NO: 28690 - protein, 5 aa, Neisseria
GTFRA

SEQ ID NO: 28691 - protein, 19 aa, Neisseria
QQVDERVMDSNDLEKERGI

SEQ ID NO: 28692 - protein, 7 aa, Neisseria
TAIDYEG

SEQ ID NO: 28693 - protein, 7 aa, Neisseria
FGGEVER

SEQ ID NO: 28694 - protein, 8 aa, Neisseria
DAQEGPMP

SEQ ID NO: 28695 - protein, 7 aa, Neisseria
KIDKPSA

SEQ ID NO: 28696 - protein, 8 aa, Neisseria
GATDEQLD

SEQ ID NO: 28697 - protein, 15 aa, Neisseria
AKLEETDESSDMRPL

SEQ ID NO: 28698 - protein, 7 aa, Neisseria
GSADEPL

SEQ ID NO: 28699 - protein, 7 aa, Neisseria
LNGRIKP

SEQ ID NO: 28700 - protein, 6 aa, Neisseria
HEQQIA

SEQ ID NO: 28701 - protein, 14 aa, Neisseria
GLERVPLEEAEAGD

SEQ ID NO: 28702 - protein, 6 aa, Neisseria
GIEDIG

SEQ ID NO: 28703 - protein, 9 aa, Neisseria
ITDKDNPKG

SEQ ID NO: 28704 - protein, 7 aa, Neisseria
SVDEPTL

SEQ ID NO: 28705 - protein, 9 aa, Neisseria
AGTEGKFVT

SEQ ID NO: 28706 - protein, 12 aa, Neisseria
RQIRDRLQKELL

SEQ ID NO: 28707 - protein, 20 aa, Neisseria
LRVEDTADADVFRVSGRGEL

SEQ ID NO: 28708 - protein, 7 aa, Neisseria
NMRREGY

SEQ ID NO: 28709 - protein, 20 aa, Neisseria
VGKPRVVYRDIDGQKCEPYE

SEQ ID NO: 28710 - protein, 34 aa, Neisseria; identical to SEQ ID NO: 2662

SEQ ID NO: 28711 - protein, 11 aa, Neisseria
APVKPDMPGRH

SEQ ID NO: 28712 - protein, 5 aa, Neisseria
QEQGE

SEQ ID NO: 28713 - protein, 7 aa, Neisseria
LEDRGRM

SEQ ID NO: 28714 - protein, 6 aa, Neisseria
PNDKIY

SEQ ID NO: 28715 - protein, 7 aa, Neisseria
HSRDNDL

SEQ ID NO: 28716 - protein, 8 aa, Neisseria
LKGKKLTN

SEQ ID NO: 28717 - protein, 10 aa, Neisseria
RASGTDEAVR

SEQ ID NO: 28718 - protein, 9 aa, Neisseria
FIDDDELVE

SEQ ID NO: 28719 - protein, 5 aa, Neisseria
IRLRM

SEQ ID NO: 28720 - protein, 13 aa, Neisseria
SELERRRHFKKLD

SEQ ID NO: 28721 - protein, 6 aa, Neisseria
FPTRLF

SEQ ID NO: 28722 - protein, 31 aa, Neisseria
RFSRFVRGWAGIRGYLKNGIPEHIQPGHNPL

SEQ ID NO: 28723 - protein, 5 aa, Neisseria
ALLAA

SEQ ID NO: 28724 - protein, 12 aa, Neisseria
LNHLVSEHTGSL

SEQ ID NO: 28725 - protein, 18 aa, Neisseria
FKLLAVFSAVHIAAVAAY

SEQ ID NO: 28726 - protein, 5 aa, Neisseria
RPMIT

SEQ ID NO: 28727 - protein, 8 aa, Neisseria
MKNKTKVW

SEQ ID NO: 28728 - protein, 7 aa, Neisseria
SAKAGGD

SEQ ID NO: 28729 - protein, 7 aa, Neisseria
GSDTARF

SEQ ID NO: 28730 - protein, 18 aa, Neisseria
GYLKNGIPEHIQPGHNPL

SEQ ID NO: 28731 - protein, 11 aa, Neisseria
ANENTFSTNGY

SEQ ID NO: 28732 - protein, 7 aa, Neisseria
HTGSLIR

SEQ ID NO: 28733 - protein, 8 aa, Neisseria
IFKKKNLV

SEQ ID NO: 28734 - protein, 7 aa, Neisseria
IEGKTSI

SEQ ID NO: 28735 - protein, 7 aa, Neisseria
MKNKTKV

SEQ ID NO: 28736 - protein, 5 aa, Neisseria
DTARF

SEQ ID NO: 28737 - protein, 8 aa, Neisseria
IFKKKNLV

SEQ ID NO: 28738 - protein, 7 aa, Neisseria
IEGKTSI

SEQ ID NO: 28739 - protein, 16 aa, Neisseria
AASVLSLPEMMRLMVF

SEQ ID NO: 28740 - protein, 13 aa, Neisseria
TLVAYIKLSSVAK

SEQ ID NO: 28741 - protein, 7 aa, Neisseria
VSVPQHW

SEQ ID NO: 28742 - protein, 8 aa, Neisseria
TIFSGIAY

SEQ ID NO: 28743 - protein, 25 aa, Neisseria
AKKLSHLYRITEAVGRWSMIDIFVI

SEQ ID NO: 28744 - protein, 5 aa, Neisseria
IRKQA

SEQ ID NO: 28745 - protein, 5 aa, Neisseria
VRLRQ

SEQ ID NO: 28746 - protein, 7 aa, Neisseria
RLTGNNA

SEQ ID NO: 28747 - protein, 11 aa, Neisseria
QTASEGKTCCS

SEQ ID NO: 28748 - protein, 11 aa, Neisseria
YFRDSAESPCG

SEQ ID NO: 28749 - protein, 10 aa, Neisseria
LYGGRPKSLS

SEQ ID NO: 28750 - protein, 7 aa, Neisseria
SNPAATE

SEQ ID NO: 28751 - protein, 6 aa, Neisseria
DEGDRL

SEQ ID NO: 28752 - protein, 6 aa, Neisseria
AGAKKL

SEQ ID NO: 28753 - protein, 12 aa, Neisseria
LLWDKRASDGIA

SEQ ID NO: 28754 - protein, 7 aa, Neisseria
NETEKYD

SEQ ID NO: 28755 - protein, 5 aa, Neisseria
VRLRQ

SEQ ID NO: 28756 - protein, 9 aa, Neisseria
TASEGKTCC

SEQ ID NO: 28757 - protein, 6 aa, Neisseria
DSAESP

SEQ ID NO: 28758 - protein, 9 aa, Neisseria
YGGRPKSLS

SEQ ID NO: 28759 - protein, 6 aa, Neisseria
DEGDRL

SEQ ID NO: 28760 - protein, 5 aa, Neisseria
GAKKL

SEQ ID NO: 28761 - protein, 9 aa, Neisseria
LLWDKRASD

SEQ ID NO: 28762 - protein, 7 aa, Neisseria
NETEKYD

SEQ ID NO: 28763 - protein, 9 aa, Neisseria
GVTGLGTLL

SEQ ID NO: 28764 - protein, 7 aa, Neisseria
QDIPPVT

SEQ ID NO: 28765 - protein, 9 aa, Neisseria
TKNSKNVKS

SEQ ID NO: 28766 - protein, 5 aa, Neisseria
FKQSV

SEQ ID NO: 28767 - protein, 19 aa, Neisseria
SKEHWKQQFQTALNKGLTA

SEQ ID NO: 28768 - protein, 8 aa, Neisseria
GKMIELND

SEQ ID NO: 28769 - protein, 13 aa, Neisseria
KLADLLDKFNNLP

SEQ ID NO: 28770 - protein, 6 aa, Neisseria
VAELNG

SEQ ID NO: 28771 - protein, 23 aa, Neisseria
LSSIDKLVGNPQTQNIPNELNQT

SEQ ID NO: 28772 - protein, 29 aa, Neisseria
IYGDVQNTLQSLDKTLKDVQPVINTLKEK

SEQ ID NO: 28773 - protein, 21 aa, Neisseria
MTDNSPPPNGHAQARVRKNNT

SEQ ID NO: 28774 - protein, 9 aa, Neisseria
KEIRNRGPV

SEQ ID NO: 28775 - protein, 11 aa, Neisseria
DSAEGIEVNNT

SEQ ID NO: 28776 - protein, 18 aa, Neisseria
DVGRVTRIKLRDDQKGVE

SEQ ID NO: 28777 - protein, 11 aa, Neisseria
DVSGLIRSDTQ

SEQ ID NO: 28778 - protein, 9 aa, Neisseria
VKPRIDQSG

SEQ ID NO: 28779 - protein, 13 aa, Neisseria
TPGKSGEAKDVFQ

SEQ ID NO: 28780 - protein, 10 aa, Neisseria
LIGKNDRILN

SEQ ID NO: 28781 - protein, 9 aa, Neisseria
AHFDPSDQS

SEQ ID NO: 28782 - protein, 8 aa, Neisseria
QSPNDKLI

SEQ ID NO: 28783 - protein, 18 aa, Neisseria
LESGINIETTGSGIKLNS

SEQ ID NO: 28784 - protein, 18 aa, Neisseria
SFDSPKTKNSKNVKSEDS

SEQ ID NO: 28785 - protein, 18 aa, Neisseria
TLYDSRSEIANLPDDRSL

SEQ ID NO: 28786 - protein, 6 aa, Neisseria
QSVRGL

SEQ ID NO: 28787 - protein, 8 aa, Neisseria
VEYKGLNV

SEQ ID NO: 28788 - protein, 8 aa, Neisseria
PYFDRNDS

SEQ ID NO: 28789 - protein, 24 aa, Neisseria
IRIEPSRLEINADEQSKEHWKQQF

SEQ ID NO: 28790 - protein, 6 aa, Neisseria
ALNKGL

SEQ ID NO: 28791 - protein, 21 aa, Neisseria
LTGGKMIELNDQPSASPKLRP

SEQ ID NO: 28792 - protein, 15 aa, Neisseria
IATRGGGLDDLQVKL

SEQ ID NO: 28793 - protein, 16 aa, Neisseria
DLLDKFNNLPLDKTVA

SEQ ID NO: 28794 - protein, 15 aa, Neisseria
NGSLAELKSALKSAN

SEQ ID NO: 28795 - protein, 27 aa, Neisseria
SIDKLVGNPQTQNIPNELNQTLKELRI

SEQ ID NO: 28796 - protein, 5 aa, Neisseria
VSPQS

SEQ ID NO: 28797 - protein, 10 aa, Neisseria
SLDKTLKDVQ

SEQ ID NO: 28798 - protein, 8 aa, Neisseria
TLKEKPNA

SEQ ID NO: 28799 - protein, 13 aa, Neisseria
NNSSKDPIPKGSR

SEQ ID NO: 28800 - protein, 8 aa, Neisseria
MTDNSPPP

SEQ ID NO: 28801 - protein, 9 aa, Neisseria
AQARVRKNN

SEQ ID NO: 28802 - protein, 7 aa, Neisseria
KEIRNRG

SEQ ID NO: 28803 - protein, 7 aa, Neisseria
DSAEGIE

SEQ ID NO: 28804 - protein, 18 aa, Neisseria
DVGRVTRIKLRDDQKGVE

SEQ ID NO: 28805 - protein, 5 aa, Neisseria
IRSDT

SEQ ID NO: 28806 - protein, 5 aa, Neisseria
PRIDQ

SEQ ID NO: 28807 - protein, 11 aa, Neisseria
GKSGEAKDVFQ

SEQ ID NO: 28808 - protein, 7 aa, Neisseria
GKNDRIL

SEQ ID NO: 28809 - protein, 8 aa, Neisseria
AHFDPSDQ

SEQ ID NO: 28810 - protein, 6 aa, Neisseria
PNDKLI

SEQ ID NO: 28811 - protein, 16 aa, Neisseria
DSPKTKNSKNVKSEDS

SEQ ID NO: 28812 - protein, 6 aa, Neisseria
DSRSEI

SEQ ID NO: 28813 - protein, 7 aa, Neisseria
NLPDDRS

SEQ ID NO: 28814 - protein, 5 aa, Neisseria
VEYKG

SEQ ID NO: 28815 - protein, 5 aa, Neisseria
DRNDS

SEQ ID NO: 28816 - protein, 21 aa, Neisseria
IRIEPSRLEINADEQSKEHWK

SEQ ID NO: 28817 - protein, 17 aa, Neisseria
KMIELNDQPSASPKLRP

SEQ ID NO: 28818 - protein, 12 aa, Neisseria
RGGGLDDLQVKL

SEQ ID NO: 28819 - protein, 7 aa, Neisseria
DLLDKFN

SEQ ID NO: 28820 - protein, 7 aa, Neisseria
PLDKTVA

SEQ ID NO: 28821 - protein, 11 aa, Neisseria
AELKSALKSAN

SEQ ID NO: 28822 - protein, 7 aa, Neisseria
SIDKLVG

SEQ ID NO: 28823 - protein, 5 aa, Neisseria
IPNEL

SEQ ID NO: 28824 - protein, 8 aa, Neisseria
QTLKELRI

SEQ ID NO: 28825 - protein, 10 aa, Neisseria
SLDKTLKDVQ

SEQ ID NO: 28826 - protein, 7 aa, Neisseria
TLKEKPN

SEQ ID NO: 28827 - protein, 11 aa, Neisseria
SSKDPIPKGSR

SEQ ID NO: 28828 - protein, 5 aa, Neisseria
KLGFE

SEQ ID NO: 28829 - protein, 5 aa, Neisseria
AASLD

SEQ ID NO: 28830 - protein, 6 aa, Neisseria
LRAKKV

SEQ ID NO: 28831 - protein, 38 aa, Neisseria; identical to SEQ ID NO: 2782

SEQ ID NO: 28832 - protein, 20 aa, Neisseria
VAGLAAIGTANSLGAVVRAF

SEQ ID NO: 28833 - protein, 9 aa, Neisseria
AEQIESMGG

SEQ ID NO: 28834 - protein, 7 aa, Neisseria
DGYAKVM

SEQ ID NO: 28835 - protein, 16 aa, Neisseria
KPAPKLITKEMVESMK

SEQ ID NO: 28836 - protein, 6 aa, Neisseria
LTRPGE

SEQ ID NO: 28837 - protein, 16 aa, Neisseria
VKIIGYTDMANRLAGQ

SEQ ID NO: 28838 - protein, 11 aa, Neisseria
TNLVNLTKLLS

SEQ ID NO: 28839 - protein, 7 aa, Neisseria
KLAPAAI

SEQ ID NO: 28840 - protein, 5 aa, Neisseria
NHFIV

SEQ ID NO: 28841 - protein, 16 aa, Neisseria
LHTPLMSVTNAISGIM

SEQ ID NO: 28842 - protein, 5 aa, Neisseria
GALLQ

SEQ ID NO: 28843 - protein, 11 aa, Neisseria
NGFVSLLSFVA

SEQ ID NO: 28844 - protein, 6 aa, Neisseria
INIFGG

SEQ ID NO: 28845 - protein, 13 aa, Neisseria
GIPRESLSGETRV

SEQ ID NO: 28846 - protein, 6 aa, Neisseria
SLDDAA

SEQ ID NO: 28847 - protein, 16 aa, Neisseria
VNAPSEGELPLLKEGQ

SEQ ID NO: 28848 - protein, 8 aa, Neisseria
WPRQNEAL

SEQ ID NO: 28849 - protein, 7 aa, Neisseria
LRAKKVN

SEQ ID NO: 28850 - protein, 7 aa, Neisseria
MVPRISR

SEQ ID NO: 28851 - protein, 8 aa, Neisseria
AAGKVPPA

SEQ ID NO: 28852 - protein, 17 aa, Neisseria
FDTRLEVAEQIESMGGK

SEQ ID NO: 28853 - protein, 13 aa, Neisseria
FLQESGGSGDGYA

SEQ ID NO: 28854 - protein, 10 aa, Neisseria
LFAEQAKEVD

SEQ ID NO: 28855 - protein, 11 aa, Neisseria
IPGKPAPKLIT

SEQ ID NO: 28856 - protein, 10 aa, Neisseria
EMVESMKSGS

SEQ ID NO: 28857 - protein, 14 aa, Neisseria
GGNCELTRPGELSV

SEQ ID NO: 28858 - protein, 6 aa, Neisseria
LAGQSS

SEQ ID NO: 28859 - protein, 10 aa, Neisseria
LLSPNKDGEI

SEQ ID NO: 28860 - protein, 7 aa, Neisseria
LDFEDVI

SEQ ID NO: 28861 - protein, 11 aa, Neisseria
TVTRDGEITFP

SEQ ID NO: 28862 - protein, 22 aa, Neisseria
SARPQQTPSEKAAPAAKPEPKP

SEQ ID NO: 28863 - protein, 13 aa, Neisseria
GIPRESLSGETRV

SEQ ID NO: 28864 - protein, 6 aa, Neisseria
SLDDAA

SEQ ID NO: 28865 - protein, 14 aa, Neisseria
APSEGELPLLKEGQ

SEQ ID NO: 28866 - protein, 6 aa, Neisseria
RQNEAL

SEQ ID NO: 28867 - protein, 7 aa, Neisseria
LRAKKVN

SEQ ID NO: 28868 - protein, 7 aa, Neisseria
MVPRISR

SEQ ID NO: 28869 - protein, 15 aa, Neisseria
FDTRLEVAEQIESMG

SEQ ID NO: 28870 - protein, 9 aa, Neisseria
SGGSGDGYA

SEQ ID NO: 28871 - protein, 10 aa, Neisseria
LFAEQAKEVD

SEQ ID NO: 28872 - protein, 6 aa, Neisseria
PGKPAP

SEQ ID NO: 28873 - protein, 8 aa, Neisseria
EMVESMKS

SEQ ID NO: 28874 - protein, 10 aa, Neisseria
GNCELTRPGE

SEQ ID NO: 28875 - protein, 8 aa, Neisseria
SPNKDGEI

SEQ ID NO: 28876 - protein, 7 aa, Neisseria
LDFEDVI

SEQ ID NO: 28877 - protein, 8 aa, Neisseria
TVTRDGEI

SEQ ID NO: 28878 - protein, 21 aa, Neisseria
ARPQQTPSEKAAPAAKPEPKP

SEQ ID NO: 28879 - protein, 9 aa, Neisseria
NGFEAFAPF

SEQ ID NO: 28880 - protein, 5 aa, Neisseria
ATVNT

SEQ ID NO: 28881 - protein, 18 aa, Neisseria
YAKKAGGFRFKDNHNPRG

SEQ ID NO: 28882 - protein, 5 aa, Neisseria
QGAAA

SEQ ID NO: 28883 - protein, 9 aa, Neisseria
HAAQQNGFE

SEQ ID NO: 28884 - protein, 7 aa, Neisseria
ATGNAGQ

SEQ ID NO: 28885 - protein, 5 aa, Neisseria
DKAAL

SEQ ID NO: 28886 - protein, 16 aa, Neisseria
YAKKAGGFRFKDNHNP

SEQ ID NO: 28887 - protein, 5 aa, Neisseria
DKAAL

SEQ ID NO: 28888 - protein, 7 aa, Neisseria
GRDVRAA

SEQ ID NO: 28889 - protein, 15 aa, Neisseria
AIKINRLLKRYIKRG

SEQ ID NO: 28890 - protein, 10 aa, Neisseria
RLGGFVRAAQ

SEQ ID NO: 28891 - protein, 6 aa, Neisseria
LGQAGG

SEQ ID NO: 28892 - protein, 10 aa, Neisseria
QLVDRLPREA

SEQ ID NO: 28893 - protein, 26 aa, Neisseria
MRNEEKRALRRELRGRRSQMGRDVRA

SEQ ID NO: 28894 - protein, 13 aa, Neisseria
RLLKRYIKRGRKI

SEQ ID NO: 28895 - protein, 7 aa, Neisseria
PMGKELR

SEQ ID NO: 28896 - protein, 9 aa, Neisseria
AAQKRGAKL

SEQ ID NO: 28897 - protein, 9 aa, Neisseria
IEPHTRRMW

SEQ ID NO: 28898 - protein, 19 aa, Neisseria
TPYPERGMERERKRGRAKL

SEQ ID NO: 28899 - protein, 8 aa, Neisseria
FAGRKIRV

SEQ ID NO: 28900 - protein, 11 aa, Neisseria
GIDREGYRLGQ

SEQ ID NO: 28901 - protein, 7 aa, Neisseria
MKYRLQA

SEQ ID NO: 28902 - protein, 14 aa, Neisseria
LVDRLPREAHDLPL

SEQ ID NO: 28903 - protein, 26 aa, Neisseria
MRNEEKRALRRELRGRRSQMGRDVRA

SEQ ID NO: 28904 - protein, 13 aa, Neisseria
RLLKRYIKRGRKI

SEQ ID NO: 28905 - protein, 7 aa, Neisseria
AAQKRGA

SEQ ID NO: 28906 - protein, 17 aa, Neisseria
YPERGMERERKRGRAKL

SEQ ID NO: 28907 - protein, 7 aa, Neisseria
AGRKIRV

SEQ ID NO: 28908 - protein, 8 aa, Neisseria
GIDREGYR

SEQ ID NO: 28909 - protein, 7 aa, Neisseria
MKYRLQA

SEQ ID NO: 28910 - protein, 13 aa, Neisseria
LVDRLPREAHDLP

SEQ ID NO: 28911 - protein, 9 aa, Neisseria
FSRAAEQLE

SEQ ID NO: 28912 - protein, 10 aa, Neisseria
AVSRIVKRLE

SEQ ID NO: 28913 - protein, 13 aa, Neisseria
GVNLLNRTTRQLN

SEQ ID NO: 28914 - protein, 14 aa, Neisseria
GAQYFRRAQRILQE

SEQ ID NO: 28915 - protein, 8 aa, Neisseria
LAVHEVPQ

SEQ ID NO: 28916 - protein, 11 aa, Neisseria
FDSHFRVVASP

SEQ ID NO: 28917 - protein, 8 aa, Neisseria
TPQSAEDL

SEQ ID NO: 28918 - protein, 17 aa, Neisseria
HQCLGFTEPGSLNTWAV

SEQ ID NO: 28919 - protein, 16 aa, Neisseria
DFLVKELGKNMNRTNT

SEQ ID NO: 28920 - protein, 8 aa, Neisseria
MKTNSEEL

SEQ ID NO: 28921 - protein, 16 aa, Neisseria
ESGSFSRAAEQLEMAN

SEQ ID NO: 28922 - protein, 11 aa, Neisseria
RIVKRLEEKLG

SEQ ID NO: 28923 - protein, 27 aa, Neisseria
LLNRTTRQLNLTEEGAQYFRRAQRILQ

SEQ ID NO: 28924 - protein, 7 aa, Neisseria
AAAETEM

SEQ ID NO: 28925 - protein, 5 aa, Neisseria
LRVDS

SEQ ID NO: 28926 - protein, 10 aa, Neisseria
KFNERYPHIR

SEQ ID NO: 28927 - protein, 7 aa, Neisseria
IERKVDI

SEQ ID NO: 28928 - protein, 13 aa, Neisseria
LRAGELDDSGLRA

SEQ ID NO: 28929 - protein, 7 aa, Neisseria
ASPEYLA

SEQ ID NO: 28930 - protein, 11 aa, Neisseria
HGTPQSAEDLA

SEQ ID NO: 28931 - protein, 9 aa, Neisseria
GFTEPGSLN

SEQ ID NO: 28932 - protein, 8 aa, Neisseria
AQGNPYKI

SEQ ID NO: 28933 - protein, 11 aa, Neisseria
PHFTASSGEIL

SEQ ID NO: 28934 - protein, 7 aa, Neisseria
LCLSSCG

SEQ ID NO: 28935 - protein, 11 aa, Neisseria
LVDNDITEGKL

SEQ ID NO: 28936 - protein, 11 aa, Neisseria
AEQTSNKTHPF

SEQ ID NO: 28937 - protein, 8 aa, Neisseria
YSDKAVNL

SEQ ID NO: 28938 - protein, 12 aa, Neisseria
ELGKNMNRTNTK

SEQ ID NO: 28939 - protein, 8 aa, Neisseria
MKTNSEEL

SEQ ID NO: 28940 - protein, 11 aa, Neisseria
SFSRAAEQLEM

SEQ ID NO: 28941 - protein, 11 aa, Neisseria
RIVKRLEEKLG

SEQ ID NO: 28942 - protein, 18 aa, Neisseria
NLTEEGAQYFRRAQRILQ

SEQ ID NO: 28943 - protein, 7 aa, Neisseria
AAAETEM

SEQ ID NO: 28944 - protein, 5 aa, Neisseria
LRVDS

SEQ ID NO: 28945 - protein, 7 aa, Neisseria
KFNERYP

SEQ ID NO: 28946 - protein, 7 aa, Neisseria
IERKVDI

SEQ ID NO: 28947 - protein, 13 aa, Neisseria
LRAGELDDSGLRA

SEQ ID NO: 28948 - protein, 7 aa, Neisseria
QSAEDLA

SEQ ID NO: 28949 - protein, 8 aa, Neisseria
NDITEGKL

SEQ ID NO: 28950 - protein, 7 aa, Neisseria
QTSNKTH

SEQ ID NO: 28951 - protein, 5 aa, Neisseria
KAVNL

SEQ ID NO: 28952 - protein, 12 aa, Neisseria
ELGKNMNRTNTK

SEQ ID NO: 28953 - protein, 10 aa, Neisseria
KLVDLAQLTG

SEQ ID NO: 28954 - protein, 5 aa, Neisseria
WHETL

SEQ ID NO: 28955 - protein, 5 aa, Neisseria
GLGHV

SEQ ID NO: 28956 - protein, 5 aa, Neisseria
KQCGN

SEQ ID NO: 28957 - protein, 10 aa, Neisseria
ADLMNGLPET

SEQ ID NO: 28958 - protein, 11 aa, Neisseria
GTVSVVNALPS

SEQ ID NO: 28959 - protein, 12 aa, Neisseria
LSGVLKGWQDKR

SEQ ID NO: 28960 - protein, 11 aa, Neisseria
HLIQKVIDKPE

SEQ ID NO: 28961 - protein, 5 aa, Neisseria
VAAAN

SEQ ID NO: 28962 - protein, 7 aa, Neisseria
LMRRFKS

SEQ ID NO: 28963 - protein, 8 aa, Neisseria
HAFVNHIR

SEQ ID NO: 28964 - protein, 6 aa, Neisseria
FGKAFK

SEQ ID NO: 28965 - protein, 8 aa, Neisseria
DILDKLVD

SEQ ID NO: 28966 - protein, 7 aa, Neisseria
LTGSADV

SEQ ID NO: 28967 - protein, 7 aa, Neisseria
TLQREGL

SEQ ID NO: 28968 - protein, 14 aa, Neisseria
IDGETSPRPVGTGD

SEQ ID NO: 28969 - protein, 21 aa, Neisseria
LSHDGKYGESLQPDIRQNGTF

SEQ ID NO: 28970 - protein, 6 aa, Neisseria
QCGNGL

SEQ ID NO: 28971 - protein, 7 aa, Neisseria
FRYDTHA

SEQ ID NO: 28972 - protein, 5 aa, Neisseria
LMNGL

SEQ ID NO: 28973 - protein, 7 aa, Neisseria
LESEKPL

SEQ ID NO: 28974 - protein, 9 aa, Neisseria
LEQDKDVEL

SEQ ID NO: 28975 - protein, 8 aa, Neisseria
GWQDKRLG

SEQ ID NO: 28976 - protein, 15 aa, Neisseria
VIDKPEDEWNIDKMV

SEQ ID NO: 28977 - protein, 10 aa, Neisseria
QLMRRFKSQV

SEQ ID NO: 28978 - protein, 11 aa, Neisseria
LLLKKTPDSVL

SEQ ID NO: 28979 - protein, 6 aa, Neisseria
QSETHF

SEQ ID NO: 28980 - protein, 5 aa, Neisseria
KAFKR

SEQ ID NO: 28981 - protein, 12 aa, Neisseria
SPGQYRKEGGQK

SEQ ID NO: 28982 - protein, 8 aa, Neisseria
DILDKLVD

SEQ ID NO: 28983 - protein, 7 aa, Neisseria
TLQREGL

SEQ ID NO: 28984 - protein, 10 aa, Neisseria
DGETSPRPVG

SEQ ID NO: 28985 - protein, 7 aa, Neisseria
HDGKYGE

SEQ ID NO: 28986 - protein, 7 aa, Neisseria
LQPDIRQ

SEQ ID NO: 28987 - protein, 7 aa, Neisseria
LESEKPL

SEQ ID NO: 28988 - protein, 9 aa, Neisseria
LEQDKDVEL

SEQ ID NO: 28989 - protein, 7 aa, Neisseria
WQDKRLG

SEQ ID NO: 28990 - protein, 11 aa, Neisseria
VIDKPEDEWNI

SEQ ID NO: 28991 - protein, 8 aa, Neisseria
QLMRRFKS

SEQ ID NO: 28992 - protein, 8 aa, Neisseria
KKTPDSVL

SEQ ID NO: 28993 - protein, 5 aa, Neisseria
KAFKR

SEQ ID NO: 28994 - protein, 9 aa, Neisseria
QYRKEGGQK

SEQ ID NO: 28995 - protein, 6 aa, Neisseria
SGLGNI

SEQ ID NO: 28996 - protein, 6 aa, Neisseria
LGRDED

SEQ ID NO: 28997 - protein, 11 aa, Neisseria
FGFLSWLAMLF

SEQ ID NO: 28998 - protein, 11 aa, Neisseria
AEPLMHYFSDI

SEQ ID NO: 28999 - protein, 24 aa, Neisseria
ISGRFGDAIDIMALLATFFGIITT

SEQ ID NO: 29000 - protein, 20 aa, Neisseria
MSLAVVSAISGVGKGVKVLS

SEQ ID NO: 29001 - protein, 15 aa, Neisseria
AFGDNIGNYLGNLVR

SEQ ID NO: 29002 - protein, 13 aa, Neisseria
WCSWAPFVGLFIA

SEQ ID NO: 29003 - protein, 7 aa, Neisseria
LFGVLWF

SEQ ID NO: 29004 - protein, 11 aa, Neisseria
AGGMLEKMTSS

SEQ ID NO: 29005 - protein, 22 aa, Neisseria
TLLFKFFNYLPLPELTSIVSLL

SEQ ID NO: 29006 - protein, 7 aa, Neisseria
WGVLMSA

SEQ ID NO: 29007 - protein, 10 aa, Neisseria
GLGNLQSMTL

SEQ ID NO: 29008 - protein, 7 aa, Neisseria
RLVRIMS

SEQ ID NO: 29009 - protein, 12 aa, Neisseria
EQDILKFLKHTA

SEQ ID NO: 29010 - protein, 8 aa, Neisseria
MHELQREL

SEQ ID NO: 29011 - protein, 6 aa, Neisseria
DFMYGI

SEQ ID NO: 29012 - protein, 8 aa, Neisseria
GQDVSDQL

SEQ ID NO: 29013 - protein, 7 aa, Neisseria
ADILKNY

SEQ ID NO: 29014 - protein, 5 aa, Neisseria
DRAKE

SEQ ID NO: 29015 - protein, 10 aa, Neisseria
IRLGRDEDVP

SEQ ID NO: 29016 - protein, 7 aa, Neisseria
APEHRQQ

SEQ ID NO: 29017 - protein, 14 aa, Neisseria
LKEKISGRFGDAID

SEQ ID NO: 29018 - protein, 6 aa, Neisseria
QLGAGL

SEQ ID NO: 29019 - protein, 8 aa, Neisseria
GVGKGVKV

SEQ ID NO: 29020 - protein, 10 aa, Neisseria
AYEREHKPWF

SEQ ID NO: 29021 - protein, 9 aa, Neisseria
RISKGRTIR

SEQ ID NO: 29022 - protein, 10 aa, Neisseria
MLEKMTSSPE

SEQ ID NO: 29023 - protein, 7 aa, Neisseria
TSADSGI

SEQ ID NO: 29024 - protein, 13 aa, Neisseria
ITSRDKGLSAPRW

SEQ ID NO: 29025 - protein, 7 aa, Neisseria
RSGGLGN

SEQ ID NO: 29026 - protein, 16 aa, Neisseria
LSADKKYFETRVNPTS

SEQ ID NO: 29027 - protein, 10 aa, Neisseria
TGGKWKERLV

SEQ ID NO: 29028 - protein, 8 aa, Neisseria
SQTQEQDI

SEQ ID NO: 29029 - protein, 12 aa, Neisseria
ELQRELSEEYGL

SEQ ID NO: 29030 - protein, 13 aa, Neisseria
VRVDKMFHQDEPA

SEQ ID NO: 29031 - protein, 8 aa, Neisseria
VIRKETMR

SEQ ID NO: 29032 - protein, 28 aa, Neisseria
SVGQDVSDQLINDGKLPHIRHQTTYKPY

SEQ ID NO: 29033 - protein, 7 aa, Neisseria
FDGRVGY

SEQ ID NO: 29034 - protein, 8 aa, Neisseria
YMNKDELI

SEQ ID NO: 29035 - protein, 6 aa, Neisseria
ILKNYE

SEQ ID NO: 29036 - protein, 7 aa, Neisseria
EQVELAE

SEQ ID NO: 29037 - protein, 5 aa, Neisseria
DRAKE

SEQ ID NO: 29038 - protein, 9 aa, Neisseria
RLGRDEDVP

SEQ ID NO: 29039 - protein, 7 aa, Neisseria
APEHRQQ

SEQ ID NO: 29040 - protein, 11 aa, Neisseria
LKEKISGRFGD

SEQ ID NO: 29041 - protein, 7 aa, Neisseria
VGKGVKV

SEQ ID NO: 29042 - protein, 8 aa, Neisseria
AYEREHKP

SEQ ID NO: 29043 - protein, 8 aa, Neisseria
ISKGRTIR

SEQ ID NO: 29044 - protein, 9 aa, Neisseria
MLEKMTSSP

SEQ ID NO: 29045 - protein, 8 aa, Neisseria
TSRDKGLS

SEQ ID NO: 29046 - protein, 9 aa, Neisseria
LSADKKYFE

SEQ ID NO: 29047 - protein, 7 aa, Neisseria
KWKERLV

SEQ ID NO: 29048 - protein, 8 aa, Neisseria
SQTQEQDI

SEQ ID NO: 29049 - protein, 12 aa, Neisseria
ELQRELSEEYGL

SEQ ID NO: 29050 - protein, 13 aa, Neisseria
VRVDKMFHQDEPA

SEQ ID NO: 29051 - protein, 8 aa, Neisseria
VIRKETMR

SEQ ID NO: 29052 - protein, 8 aa, Neisseria
SVGQDVSD

SEQ ID NO: 29053 - protein, 9 aa, Neisseria
LINDGKLPH

SEQ ID NO: 29054 - protein, 8 aa, Neisseria
YMNKDELI

SEQ ID NO: 29055 - protein, 7 aa, Neisseria
EQVELAE

SEQ ID NO: 29056 - protein, 6 aa, Neisseria
YILNDC

SEQ ID NO: 29057 - protein, 10 aa, Neisseria
LSKELAGLKA

SEQ ID NO: 29058 - protein, 10 aa, Neisseria
FFENVRRFPE

SEQ ID NO: 29059 - protein, 12 aa, Neisseria
LGRQPRINDLAH

SEQ ID NO: 29060 - protein, 16 aa, Neisseria
YANLFANLNGIERIFK

SEQ ID NO: 29061 - protein, 6 aa, Neisseria
VPAIYT

SEQ ID NO: 29062 - protein, 5 aa, Neisseria
WFNRI

SEQ ID NO: 29063 - protein, 10 aa, Neisseria
AKLLEGYGLS

SEQ ID NO: 29064 - protein, 6 aa, Neisseria
EVGELI

SEQ ID NO: 29065 - protein, 6 aa, Neisseria
MRGYLN

SEQ ID NO: 29066 - protein, 8 aa, Neisseria
TIVNGWLK

SEQ ID NO: 29067 - protein, 9 aa, Neisseria
VYPREIEEE

SEQ ID NO: 29068 - protein, 10 aa, Neisseria
HKLDAVEAAA

SEQ ID NO: 29069 - protein, 8 aa, Neisseria
FVQLKEGM

SEQ ID NO: 29070 - protein, 9 aa, Neisseria
EIRRHLRTV

SEQ ID NO: 29071 - protein, 6 aa, Neisseria
FKIPKQ

SEQ ID NO: 29072 - protein, 18 aa, Neisseria
NATGKVLKRVLKEQFEGN

SEQ ID NO: 29073 - protein, 5 aa, Neisseria
LKNSE

SEQ ID NO: 29074 - protein, 5 aa, Neisseria
NDCKA

SEQ ID NO: 29075 - protein, 8 aa, Neisseria
GLSKELAG

SEQ ID NO: 29076 - protein, 6 aa, Neisseria
AQTPVE

SEQ ID NO: 29077 - protein, 15 aa, Neisseria
IWTDKSRPAGETAEG

SEQ ID NO: 29078 - protein, 19 aa, Neisseria
NVRRFPEKPDLGRQPRIND

SEQ ID NO: 29079 - protein, 11 aa, Neisseria
TSGTTGHPKGA

SEQ ID NO: 29080 - protein, 15 aa, Neisseria
NGIERIFKISKRDRF

SEQ ID NO: 29081 - protein, 8 aa, Neisseria
ISGGAPLA

SEQ ID NO: 29082 - protein, 7 aa, Neisseria
FKAKFPR

SEQ ID NO: 29083 - protein, 9 aa, Neisseria
EGYGLSEAS

SEQ ID NO: 29084 - protein, 10 aa, Neisseria
TPERQKARSV

SEQ ID NO: 29085 - protein, 22 aa, Neisseria
LPGLEAKAVDEELVEVPRGEVG

SEQ ID NO: 29086 - protein, 8 aa, Neisseria
IVRGGSVM

SEQ ID NO: 29087 - protein, 7 aa, Neisseria
AATDETI

SEQ ID NO: 29088 - protein, 7 aa, Neisseria
GWLKTGD

SEQ ID NO: 29089 - protein, 6 aa, Neisseria
TIDEDG

SEQ ID NO: 29090 - protein, 26 aa, Neisseria
VDRKKDLIISKGQNVYPREIEEEIHK

SEQ ID NO: 29091 - protein, 11 aa, Neisseria
GVKDRYADEEI

SEQ ID NO: 29092 - protein, 16 aa, Neisseria
LKEGMDLGEDEIRRHL

SEQ ID NO: 29093 - protein, 28 aa, Neisseria
IHFKDGLPRNATGKVLKRVLKEQFEGNK

SEQ ID NO: 29094 - protein, 8 aa, Neisseria
GLSKELAG

SEQ ID NO: 29095 - protein, 12 aa, Neisseria
DKSRPAGETAEG

SEQ ID NO: 29096 - protein, 19 aa, Neisseria
NVRRFPEKPDLGRQPRIND

SEQ ID NO: 29097 - protein, 14 aa, Neisseria
GIERIFKISKRDRF

SEQ ID NO: 29098 - protein, 7 aa, Neisseria
FKAKFPR

SEQ ID NO: 29099 - protein, 9 aa, Neisseria
TPERQKARS

SEQ ID NO: 29100 - protein, 19 aa, Neisseria
LEAKAVDEELVEVPRGEVG

SEQ ID NO: 29101 - protein, 7 aa, Neisseria
AATDETI

SEQ ID NO: 29102 - protein, 6 aa, Neisseria
TIDEDG

SEQ ID NO: 29103 - protein, 9 aa, Neisseria
VDRKKDLII

SEQ ID NO: 29104 - protein, 11 aa, Neisseria
YPREIEEEIHK

SEQ ID NO: 29105 - protein, 11 aa, Neisseria
GVKDRYADEEI

SEQ ID NO: 29106 - protein, 16 aa, Neisseria
LKEGMDLGEDEIRRHL

SEQ ID NO: 29107 - protein, 8 aa, Neisseria
DGLPRNAT

SEQ ID NO: 29108 - protein, 15 aa, Neisseria
KVLKRVLKEQFEGNK

SEQ ID NO: 29109 - protein, 10 aa, Neisseria
ATLGVLLKEL

SEQ ID NO: 29110 - protein, 8 aa, Neisseria
TLIERLED

SEQ ID NO: 29111 - protein, 10 aa, Neisseria
INPARALNIA

SEQ ID NO: 29112 - protein, 5 aa, Neisseria
QFWAT

SEQ ID NO: 29113 - protein, 5 aa, Neisseria
NAVPH

SEQ ID NO: 29114 - protein, 8 aa, Neisseria
HCRYLQKR

SEQ ID NO: 29115 - protein, 12 aa, Neisseria
DVFKTQKLFENM

SEQ ID NO: 29116 - protein, 12 aa, Neisseria
RLTRQMVKYLQG

SEQ ID NO: 29117 - protein, 13 aa, Neisseria
TEFNRHVEDIKRE

SEQ ID NO: 29118 - protein, 5 aa, Neisseria
KTKEE

SEQ ID NO: 29119 - protein, 10 aa, Neisseria
ASLLEYYPRQ

SEQ ID NO: 29120 - protein, 6 aa, Neisseria
MAEATD

SEQ ID NO: 29121 - protein, 7 aa, Neisseria
KELEPSW

SEQ ID NO: 29122 - protein, 20 aa, Neisseria
ERLEDVALESSNAWNNAGTG

SEQ ID NO: 29123 - protein, 9 aa, Neisseria
AEGKLEDNS

SEQ ID NO: 29124 - protein, 23 aa, Neisseria
MNEDHCRYLQKRYDVFKTQKLFE

SEQ ID NO: 29125 - protein, 12 aa, Neisseria
MEFSTDRNKISD

SEQ ID NO: 29126 - protein, 10 aa, Neisseria
IMRGRDENQP

SEQ ID NO: 29127 - protein, 19 aa, Neisseria
ANYSAEGTDVDFGRLTRQM

SEQ ID NO: 29128 - protein, 23 aa, Neisseria
LQGKGVKTEFNRHVEDIKRESDG

SEQ ID NO: 29129 - protein, 9 aa, Neisseria
TADTRNPDW

SEQ ID NO: 29130 - protein, 13 aa, Neisseria
QKSGIPEGKGYGG

SEQ ID NO: 29131 - protein, 13 aa, Neisseria
FRNSNPETAEQHN

SEQ ID NO: 29132 - protein, 12 aa, Neisseria
LDTRNVDGKRHL

SEQ ID NO: 29133 - protein, 9 aa, Neisseria
NFLKQGSFM

SEQ ID NO: 29134 - protein, 10 aa, Neisseria
ELRKTKEERF

SEQ ID NO: 29135 - protein, 9 aa, Neisseria
EYYPRQTRR

SEQ ID NO: 29136 - protein, 9 aa, Neisseria
  VARIANT 2: Xaa is any amino acid
IXYDSKLRV

SEQ ID NO: 29137 - protein, 17 aa, Neisseria
VPRDARSRILERRGASR

SEQ ID NO: 29138 - protein, 9 aa, Neisseria
ISADDTAPS

SEQ ID NO: 29139 - protein, 6 aa, Neisseria
MAEATD

SEQ ID NO: 29140 - protein, 5 aa, Neisseria
KELEP

SEQ ID NO: 29141 - protein, 10 aa, Neisseria
ERLEDVALES

SEQ ID NO: 29142 - protein, 9 aa, Neisseria
AEGKLEDNS

SEQ ID NO: 29143 - protein, 15 aa, Neisseria
MNEDHCRYLQKRYDV

SEQ ID NO: 29144 - protein, 12 aa, Neisseria
MEFSTDRNKISD

SEQ ID NO: 29145 - protein, 9 aa, Neisseria
MRGRDENQP

SEQ ID NO: 29146 - protein, 9 aa, Neisseria
SAEGTDVDF

SEQ ID NO: 29147 - protein, 6 aa, Neisseria
RLTRQM

SEQ ID NO: 29148 - protein, 20 aa, Neisseria
KGVKTEFNRHVEDIKRESDG

SEQ ID NO: 29149 - protein, 8 aa, Neisseria
TADTRNPD

SEQ ID NO: 29150 - protein, 7 aa, Neisseria
GIPEGKG

SEQ ID NO: 29151 - protein, 10 aa, Neisseria
SNPETAEQHN

SEQ ID NO: 29152 - protein, 10 aa, Neisseria
LDTRNVDGKR

SEQ ID NO: 29153 - protein, 10 aa, Neisseria
ELRKTKEERF

SEQ ID NO: 29154 - protein, 6 aa, Neisseria
PRQTRR

SEQ ID NO: 29155 - protein, 6 aa, Neisseria
YDSKLR

SEQ ID NO: 29156 - protein, 17 aa, Neisseria
VPRDARSRILERRGASR

SEQ ID NO: 29157 - protein, 7 aa, Neisseria
SADDTAP

SEQ ID NO: 29158 - protein, 9 aa, Neisseria
HIASVLHGG

SEQ ID NO: 29159 - protein, 14 aa, Neisseria
QFAAVFGDIAHQFG

SEQ ID NO: 29160 - protein, 8 aa, Neisseria
VVGMLSGQ

SEQ ID NO: 29161 - protein, 11 aa, Neisseria
QAFNRITDLFF

SEQ ID NO: 29162 - protein, 8 aa, Neisseria
RRIVDVFD

SEQ ID NO: 29163 - protein, 17 aa, Neisseria
FRRALCRILRLFRRIFG

SEQ ID NO: 29164 - protein, 5 aa, Neisseria
RAFCA

SEQ ID NO: 29165 - protein, 7 aa, Neisseria
AEIKRPL

SEQ ID NO: 29166 - protein, 9 aa, Neisseria
LQGGMRNQV

SEQ ID NO: 29167 - protein, 5 aa, Neisseria
HQFGK

SEQ ID NO: 29168 - protein, 8 aa, Neisseria
RPARRRVL

SEQ ID NO: 29169 - protein, 7 aa, Neisseria
FADDGFQ

SEQ ID NO: 29170 - protein, 9 aa, Neisseria
LSGQPDGVL

SEQ ID NO: 29171 - protein, 12 aa, Neisseria
SQSQTGNRRIVD

SEQ ID NO: 29172 - protein, 11 aa, Neisseria
FDFENRFRRAL

SEQ ID NO: 29173 - protein, 8 aa, Neisseria
AAGGKQQA

SEQ ID NO: 29174 - protein, 7 aa, Neisseria
QHGKRYF

SEQ ID NO: 29175 - protein, 20 aa, Neisseria
SKCRLKCRLKRGRRRFGRHW

SEQ ID NO: 29176 - protein, 20 aa, Neisseria
FNGRMPTASRTLSNNSRASL

SEQ ID NO: 29177 - protein, 7 aa, Neisseria
AEIKRPL

SEQ ID NO: 29178 - protein, 8 aa, Neisseria
RPARRRVL

SEQ ID NO: 29179 - protein, 5 aa, Neisseria
ADDGF

SEQ ID NO: 29180 - protein, 9 aa, Neisseria
QTGNRRIVD

SEQ ID NO: 29181 - protein, 11 aa, Neisseria
FDFENRFRRAL

SEQ ID NO: 29182 - protein, 5 aa, Neisseria
GKQQA

SEQ ID NO: 29183 - protein, 7 aa, Neisseria
QHGKRYF

SEQ ID NO: 29184 - protein, 17 aa, Neisseria
SKCRLKCRLKRGRRRFG

SEQ ID NO: 29185 - protein, 16 aa, Neisseria
MPTASRTLSNNSRASL

SEQ ID NO: 29186 - protein, 6 aa, Neisseria
FAVLGG

SEQ ID NO: 29187 - protein, 14 aa, Neisseria
SENTAEQPQNAAQS

SEQ ID NO: 29188 - protein, 13 aa, Neisseria
GKHPNDLEAVVGK

SEQ ID NO: 29189 - protein, 17 aa, Neisseria
HTLFAKLVGNIAEDGGK

SEQ ID NO: 29190 - protein, 5 aa, Neisseria
QPYQA

SEQ ID NO: 29191 - protein, 23 aa, Neisseria
CGKSENTAEQPQNAAQSAPKPVF

SEQ ID NO: 29192 - protein, 15 aa, Neisseria
GQSSEGKTNDGKKQI

SEQ ID NO: 29193 - protein, 10 aa, Neisseria
PIKGLPEQNA

SEQ ID NO: 29194 - protein, 13 aa, Neisseria
LTGKHPNDLEAVV

SEQ ID NO: 29195 - protein, 18 aa, Neisseria
KCMETDGKDAPSGWAENG

SEQ ID NO: 29196 - protein, 9 aa, Neisseria
IAEDGGKLT

SEQ ID NO: 29197 - protein, 8 aa, Neisseria
YQAGKSGY

SEQ ID NO: 29198 - protein, 7 aa, Neisseria
IDSEGAF

SEQ ID NO: 29199 - protein, 11 aa, Neisseria
GKSENTAEQPQ

SEQ ID NO: 29200 - protein, 14 aa, Neisseria
QSSEGKTNDGKKQI

SEQ ID NO: 29201 - protein, 13 aa, Neisseria
LTGKHPNDLEAVV

SEQ ID NO: 29202 - protein, 11 aa, Neisseria
KCMETDGKDAP

SEQ ID NO: 29203 - protein, 8 aa, Neisseria
IAEDGGKL

SEQ ID NO: 29204 - protein, 6 aa, Neisseria
QAGKSG

SEQ ID NO: 29205 - protein, 7 aa, Neisseria
IDSEGAF

SEQ ID NO: 29206 - protein, 11 aa, Neisseria
PKQTVRQIQAV

SEQ ID NO: 29207 - protein, 8 aa, Neisseria
ISHIGRTQ

SEQ ID NO: 29208 - protein, 6 aa, Neisseria
CSGMIQ

SEQ ID NO: 29209 - protein, 6 aa, Neisseria
RTARDM

SEQ ID NO: 29210 - protein, 8 aa, Neisseria
SGKTIKTE

SEQ ID NO: 29211 - protein, 7 aa, Neisseria
FSPDKTL

SEQ ID NO: 29212 - protein, 17 aa, Neisseria
GTTSGKHRQPKPKQTVR

SEQ ID NO: 29213 - protein, 9 aa, Neisseria
GRTQGSQEL

SEQ ID NO: 29214 - protein, 10 aa, Neisseria
TPYKWGGSST

SEQ ID NO: 29215 - protein, 24 aa, Neisseria
KLPRTARDMAAASRKIPDSRLKAG

SEQ ID NO: 29216 - protein, 8 aa, Neisseria
TGGAHRYS

SEQ ID NO: 29217 - protein, 15 aa, Neisseria
HAPGSGKTIKTEKLS

SEQ ID NO: 29218 - protein, 14 aa, Neisseria
TSGKHRQPKPKQTV

SEQ ID NO: 29219 - protein, 7 aa, Neisseria
GRTQGSQ

SEQ ID NO: 29220 - protein, 24 aa, Neisseria
KLPRTARDMAAASRKIPDSRLKAG

SEQ ID NO: 29221 - protein, 12 aa, Neisseria
GSGKTIKTEKLS

SEQ ID NO: 29222 - protein, 12 aa, Neisseria
VGNGVDKFGRGA

SEQ ID NO: 29223 - protein, 5 aa, Neisseria
QFERA

SEQ ID NO: 29224 - protein, 9 aa, Neisseria
KGFDEINPA

SEQ ID NO: 29225 - protein, 8 aa, Neisseria
ALAQVIEL

SEQ ID NO: 29226 - protein, 9 aa, Neisseria
DGKRHGKLH

SEQ ID NO: 29227 - protein, 11 aa, Neisseria
NQLGGRNGAAV

SEQ ID NO: 29228 - protein, 18 aa, Neisseria
NGVDKFGRGADNQVEFLE

SEQ ID NO: 29229 - protein, 7 aa, Neisseria
GASGRAA

SEQ ID NO: 29230 - protein, 6 aa, Neisseria
GEDDVV

SEQ ID NO: 29231 - protein, 8 aa, Neisseria
KGFDEINP

SEQ ID NO: 29232 - protein, 26 aa, Neisseria
CPRYHPKLHDGNQDGKRHGKLHDGAY

SEQ ID NO: 29233 - protein, 6 aa, Neisseria
QRQSAG

SEQ ID NO: 29234 - protein, 7 aa, Neisseria
LGGRNGA

SEQ ID NO: 29235 - protein, 17 aa, Neisseria
GVDKFGRGADNQVEFLE

SEQ ID NO: 29236 - protein, 6 aa, Neisseria
GEDDVV

SEQ ID NO: 29237 - protein, 6 aa, Neisseria
GFDEIN

SEQ ID NO: 29238 - protein, 20 aa, Neisseria
YHPKLHDGNQDGKRHGKLHD

SEQ ID NO: 29239 - protein, 9 aa, Neisseria
WDGIPDIRT

SEQ ID NO: 29240 - protein, 9 aa, Neisseria
DQTIRKHAH

SEQ ID NO: 29241 - protein, 5 aa, Neisseria
FQTAQ

SEQ ID NO: 29242 - protein, 13 aa, Neisseria
CLQFDSINLIEHI

SEQ ID NO: 29243 - protein, 7 aa, Neisseria
TRRLHEH

SEQ ID NO: 29244 - protein, 5 aa, Neisseria
ASTAH

SEQ ID NO: 29245 - protein, 5 aa, Neisseria
RLLGH

SEQ ID NO: 29246 - protein, 16 aa, Neisseria
HNHLYRSITSAEAEKI

SEQ ID NO: 29247 - protein, 8 aa, Neisseria
YAEPLCGL

SEQ ID NO: 29248 - protein, 7 aa, Neisseria
SHPLIEL

SEQ ID NO: 29249 - protein, 5 aa, Neisseria
ENTTL

SEQ ID NO: 29250 - protein, 7 aa, Neisseria
WNEAEEA

SEQ ID NO: 29251 - protein, 19 aa, Neisseria
GIPDIRTLDQTIRKHAHPL

SEQ ID NO: 29252 - protein, 27 aa, Neisseria
PDNQIPDFQTAQDASDSECRLKHRLDQ

SEQ ID NO: 29253 - protein, 10 aa, Neisseria
PPSRTRRLHE

SEQ ID NO: 29254 - protein, 13 aa, Neisseria
AIPQTESKSDKPW

SEQ ID NO: 29255 - protein, 10 aa, Neisseria
QTSERKKPEH

SEQ ID NO: 29256 - protein, 8 aa, Neisseria
LEARKAAQ

SEQ ID NO: 29257 - protein, 6 aa, Neisseria
SGNRQG

SEQ ID NO: 29258 - protein, 9 aa, Neisseria
SPHDTGQTE

SEQ ID NO: 29259 - protein, 9 aa, Neisseria
GYGYTKRLL

SEQ ID NO: 29260 - protein, 10 aa, Neisseria
LPDSDTWGGN

SEQ ID NO: 29261 - protein, 15 aa, Neisseria
NYSRTEQQRNHELGL

SEQ ID NO: 29262 - protein, 9 aa, Neisseria
TSAEAEKIA

SEQ ID NO: 29263 - protein, 9 aa, Neisseria
LNTPYAEPL

SEQ ID NO: 29264 - protein, 9 aa, Neisseria
ISHDGEKWI

SEQ ID NO: 29265 - protein, 9 aa, Neisseria
TGAHSPCLP

SEQ ID NO: 29266 - protein, 20 aa, Neisseria
RQIRGQTGLTPSTPFSEQLR

SEQ ID NO: 29267 - protein, 5 aa, Neisseria
PSWHG

SEQ ID NO: 29268 - protein, 18 aa, Neisseria
NSSNTGWNEAEEASNRQA

SEQ ID NO: 29269 - protein, 14 aa, Neisseria
PDIRTLDQTIRKHA

SEQ ID NO: 29270 - protein, 16 aa, Neisseria
QDASDSECRLKHRLDQ

SEQ ID NO: 29271 - protein, 8 aa, Neisseria
SRTRRLHE

SEQ ID NO: 29272 - protein, 11 aa, Neisseria
AIPQTESKSDK

SEQ ID NO: 29273 - protein, 10 aa, Neisseria
QTSERKKPEH

SEQ ID NO: 29274 - protein, 8 aa, Neisseria
LEARKAAQ

SEQ ID NO: 29275 - protein, 7 aa, Neisseria
SPHDTGQ

SEQ ID NO: 29276 - protein, 5 aa, Neisseria
PDSDT

SEQ ID NO: 29277 - protein, 10 aa, Neisseria
SRTEQQRNHE

SEQ ID NO: 29278 - protein, 9 aa, Neisseria
TSAEAEKIA

SEQ ID NO: 29279 - protein, 8 aa, Neisseria
SHDGEKWI

SEQ ID NO: 29280 - protein, 5 aa, Neisseria
RQIRG

SEQ ID NO: 29281 - protein, 11 aa, Neisseria
NEAEEASNRQA

SEQ ID NO: 29282 - protein, 14 aa, Neisseria
PDIRTLDQTIRKHA

SEQ ID NO: 29283 - protein, 16 aa, Neisseria
QDASDSECRLKHRLDQ

SEQ ID NO: 29284 - protein, 8 aa, Neisseria
SRTRRLHE

SEQ ID NO: 29285 - protein, 11 aa, Neisseria
AIPQTESKSDK

SEQ ID NO: 29286 - protein, 10 aa, Neisseria
QTSERKKPEH

SEQ ID NO: 29287 - protein, 8 aa, Neisseria
LEARKAAQ

SEQ ID NO: 29288 - protein, 7 aa, Neisseria
SPHDTGQ

SEQ ID NO: 29289 - protein, 5 aa, Neisseria
PDSDT

SEQ ID NO: 29290 - protein, 10 aa, Neisseria
SRTEQQRNHE

SEQ ID NO: 29291 - protein, 9 aa, Neisseria
TSAEAEKIA

SEQ ID NO: 29292 - protein, 8 aa, Neisseria
SHDGEKWI

SEQ ID NO: 29293 - protein, 5 aa, Neisseria
RQIRG

SEQ ID NO: 29294 - protein, 11 aa, Neisseria
NEAEEASNRQA

SEQ ID NO: 29295 - protein, 30 aa, Neisseria
LQSDSRRPIQIEADQGSLDQANQSTTFSGN

SEQ ID NO: 29296 - protein, 36 aa, Neisseria
RGGKGGESVRAEGSPVRFSQTLDGGKGTVRGQANNV

SEQ ID NO: 29297 - protein, 13 aa, Neisseria
GNAKVQRGGDVAE

SEQ ID NO: 29298 - protein, 6 aa, Neisseria
NTKTEV

SEQ ID NO: 29299 - protein, 16 aa, Neisseria
GSTKSGAKSASKTGRV

SEQ ID NO: 29300 - protein, 8 aa, Neisseria
PSSTQKTE

SEQ ID NO: 29301 - protein, 20 aa, Neisseria
SDSRRPIQIEADQGSLDQAN

SEQ ID NO: 29302 - protein, 15 aa, Neisseria
RGGKGGESVRAEGSP

SEQ ID NO: 29303 - protein, 12 aa, Neisseria
LDGGKGTVRGQA

SEQ ID NO: 29304 - protein, 11 aa, Neisseria
AKVQRGGDVAE

SEQ ID NO: 29305 - protein, 15 aa, Neisseria
GSTKSGAKSASKTGR

SEQ ID NO: 29306 - protein, 6 aa, Neisseria
STQKTE

SEQ ID NO: 29307 - protein, 9 aa, Neisseria
SLSAWLGRI

SEQ ID NO: 29308 - protein, 8 aa, Neisseria
SAKGAKQF

SEQ ID NO: 29309 - protein, 6 aa, Neisseria
VRWRYG

SEQ ID NO: 29310 - protein, 36 aa, Neisseria; identical to SEQ ID NO: 3277

SEQ ID NO: 29311 - protein, 23 aa, Neisseria
HLSAKGAKQFPENSDIHFDSPHL

SEQ ID NO: 29312 - protein, 17 aa, Neisseria
VGSDEAVYHTENKQVLF

SEQ ID NO: 29313 - protein, 32 aa, Neisseria
KTADGRRQAGKVETEKLHVDTESQYAQTDTPV

SEQ ID NO: 29314 - protein, 8 aa, Neisseria
ASHGQAGG

SEQ ID NO: 29315 - protein, 6 aa, Neisseria
YNHKTG

SEQ ID NO: 29316 - protein, 6 aa, Neisseria
FSSKVK

SEQ ID NO: 29317 - protein, 7 aa, Neisseria
IYDTKDM

SEQ ID NO: 29318 - protein, 18 aa, Neisseria
ISEVEIEEVRLNPDEPQY

SEQ ID NO: 29319 - protein, 10 aa, Neisseria
DGLDGRRFDE

SEQ ID NO: 29320 - protein, 18 aa, Neisseria
HLSAKGAKQFPENSDIHF

SEQ ID NO: 29321 - protein, 8 aa, Neisseria
VGSDEAVY

SEQ ID NO: 29322 - protein, 7 aa, Neisseria
TENKQVL

SEQ ID NO: 29323 - protein, 26 aa, Neisseria
KTADGRRQAGKVETEKLHVDTESQYA

SEQ ID NO: 29324 - protein, 7 aa, Neisseria
IYDTKDM

SEQ ID NO: 29325 - protein, 11 aa, Neisseria
AEGLREIAAEL

SEQ ID NO: 29326 - protein, 5 aa, Neisseria
RKMAA

SEQ ID NO: 29327 - protein, 7 aa, Neisseria
LGDALAV

SEQ ID NO: 29328 - protein, 6 aa, Neisseria
VADIMH

SEQ ID NO: 29329 - protein, 18 aa, Neisseria
GDLRRLFQECDNFTGLSI

SEQ ID NO: 29330 - protein, 10 aa, Neisseria
MHTHPKTISA

SEQ ID NO: 29331 - protein, 6 aa, Neisseria
KVMQAN

SEQ ID NO: 29332 - protein, 12 aa, Neisseria
MAENEKYLDWAR

SEQ ID NO: 29333 - protein, 18 aa, Neisseria
VLHTEAEGLREIAAELDE

SEQ ID NO: 29334 - protein, 5 aa, Neisseria
CKGRV

SEQ ID NO: 29335 - protein, 13 aa, Neisseria
GMGKSGHIGRKMA

SEQ ID NO: 29336 - protein, 7 aa, Neisseria
EAAHGDL

SEQ ID NO: 29337 - protein, 5 aa, Neisseria
VDNDV

SEQ ID NO: 29338 - protein, 9 aa, Neisseria
SNSGESDEI

SEQ ID NO: 29339 - protein, 7 aa, Neisseria
ALKRKDI

SEQ ID NO: 29340 - protein, 13 aa, Neisseria
TARPDSTMARHAD

SEQ ID NO: 29341 - protein, 8 aa, Neisseria
VSQEACPL

SEQ ID NO: 29342 - protein, 9 aa, Neisseria
RAFTPDDFA

SEQ ID NO: 29343 - protein, 6 aa, Neisseria
AGSLGK

SEQ ID NO: 29344 - protein, 11 aa, Neisseria
DIMHKGGGLPA

SEQ ID NO: 29345 - protein, 6 aa, Neisseria
MSEKGL

SEQ ID NO: 29346 - protein, 7 aa, Neisseria
TDGQGCL

SEQ ID NO: 29347 - protein, 17 aa, Neisseria
FTDGDLRRLFQECDNFT

SEQ ID NO: 29348 - protein, 16 aa, Neisseria
HPKTISAERLATEALK

SEQ ID NO: 29349 - protein, 12 aa, Neisseria
MAENEKYLDWAR

SEQ ID NO: 29350 - protein, 18 aa, Neisseria
VLHTEAEGLREIAAELDE

SEQ ID NO: 29351 - protein, 5 aa, Neisseria
CKGRV

SEQ ID NO: 29352 - protein, 8 aa, Neisseria
GHIGRKMA

SEQ ID NO: 29353 - protein, 8 aa, Neisseria
NSGESDEI

SEQ ID NO: 29354 - protein, 7 aa, Neisseria
ALKRKDI

SEQ ID NO: 29355 - protein, 12 aa, Neisseria
ARPDSTMARHAD

SEQ ID NO: 29356 - protein, 5 aa, Neisseria
VSQEA

SEQ ID NO: 29357 - protein, 7 aa, Neisseria
RAFTPDD

SEQ ID NO: 29358 - protein, 6 aa, Neisseria
MSEKGL

SEQ ID NO: 29359 - protein, 12 aa, Neisseria
GDLRRLFQECDN

SEQ ID NO: 29360 - protein, 14 aa, Neisseria
KTISAERLATEALK

SEQ ID NO: 29361 - protein, 7 aa, Neisseria
AKVVNTM

SEQ ID NO: 29362 - protein, 8 aa, Neisseria
HTMDEIHG

SEQ ID NO: 29363 - protein, 20 aa, Neisseria
ARSWWRNLHGAFGTWVSLIL

SEQ ID NO: 29364 - protein, 13 aa, Neisseria
WGGKFVQAWNQFP

SEQ ID NO: 29365 - protein, 6 aa, Neisseria
TEPNNI

SEQ ID NO: 29366 - protein, 13 aa, Neisseria
FRAGNRFQRALSV

SEQ ID NO: 29367 - protein, 8 aa, Neisseria
TMPRNQGW

SEQ ID NO: 29368 - protein, 5 aa, Neisseria
DEIHG

SEQ ID NO: 29369 - protein, 7 aa, Neisseria
AKQRGIK

SEQ ID NO: 29370 - protein, 12 aa, Neisseria
LLPPKSRARSWW

SEQ ID NO: 29371 - protein, 5 aa, Neisseria
HGAFG

SEQ ID NO: 29372 - protein, 12 aa, Neisseria
PAGKWGVEPNPV

SEQ ID NO: 29373 - protein, 9 aa, Neisseria
VLNDGKVKE

SEQ ID NO: 29374 - protein, 29 aa, Neisseria
TVGENGINPTEPNNIGNRRPFRAGNRFQR

SEQ ID NO: 29375 - protein, 11 aa, Neisseria
FAQRRGRGMDF

SEQ ID NO: 29376 - protein, 5 aa, Neisseria
DEIHG

SEQ ID NO: 29377 - protein, 5 aa, Neisseria
QRGIK

SEQ ID NO: 29378 - protein, 5 aa, Neisseria
PKSRA

SEQ ID NO: 29379 - protein, 9 aa, Neisseria
VLNDGKVKE

SEQ ID NO: 29380 - protein, 25 aa, Neisseria
NGINPTEPNNIGNRRPFRAGNRFQR

SEQ ID NO: 29381 - protein, 10 aa, Neisseria
FAQRRGRGMD

SEQ ID NO: 29382 - protein, 7 aa, Neisseria
LADELTN

SEQ ID NO: 29383 - protein, 5 aa, Neisseria
ILRQF

SEQ ID NO: 29384 - protein, 9 aa, Neisseria
DKLIGSAMR

SEQ ID NO: 29385 - protein, 7 aa, Neisseria
FMQHIFK

SEQ ID NO: 29386 - protein, 5 aa, Neisseria
TGKNI

SEQ ID NO: 29387 - protein, 7 aa, Neisseria
ALADELT

SEQ ID NO: 29388 - protein, 7 aa, Neisseria
SSREQIL

SEQ ID NO: 29389 - protein, 8 aa, Neisseria
FAEDEQPV

SEQ ID NO: 29390 - protein, 17 aa, Neisseria
PVNRAPARRAGNADELI

SEQ ID NO: 29391 - protein, 17 aa, Neisseria
  VARIANT 6: Xaa is any amino acid
RVNRAXARRAGNADKLI

SEQ ID NO: 29392 - protein, 7 aa, Neisseria
TGFDCSG

SEQ ID NO: 29393 - protein, 11 aa, Neisseria
LPRTSAEQARM

SEQ ID NO: 29394 - protein, 12 aa, Neisseria
APVARSELQPGD

SEQ ID NO: 29395 - protein, 7 aa, Neisseria
LGGSRIS

SEQ ID NO: 29396 - protein, 10 aa, Neisseria
HAPRTGKNIE

SEQ ID NO: 29397 - protein, 10 aa, Neisseria
SLSHKYWSGK

SEQ ID NO: 29398 - protein, 11 aa, Neisseria
RRVKKNDPSRF

SEQ ID NO: 29399 - protein, 7 aa, Neisseria
ALADELT

SEQ ID NO: 29400 - protein, 7 aa, Neisseria
SSREQIL

SEQ ID NO: 29401 - protein, 7 aa, Neisseria
FAEDEQP

SEQ ID NO: 29402 - protein, 14 aa, Neisseria
RAPARRAGNADELI

SEQ ID NO: 29403 - protein, 17 aa, Neisseria
  VARIANT 6: Xaa is any amino acid
RVNRAXARRAGNADKLI

SEQ ID NO: 29404 - protein, 9 aa, Neisseria
RTSAEQARM

SEQ ID NO: 29405 - protein, 8 aa, Neisseria
VARSELQP

SEQ ID NO: 29406 - protein, 7 aa, Neisseria
RTGKNIE

SEQ ID NO: 29407 - protein, 10 aa, Neisseria
RRVKKNDPSR

SEQ ID NO: 29408 - protein, 6 aa, Neisseria
LIAYLK

SEQ ID NO: 29409 - protein, 11 aa, Neisseria
QLAGSVTGIVT

SEQ ID NO: 29410 - protein, 9 aa, Neisseria
TLYARVLPP

SEQ ID NO: 29411 - protein, 5 aa, Neisseria
TLRRF

SEQ ID NO: 29412 - protein, 12 aa, Neisseria
KKLRPFKPLLPV

SEQ ID NO: 29413 - protein, 7 aa, Neisseria
EILRQPS

SEQ ID NO: 29414 - protein, 8 aa, Neisseria
VRTRTGNI

SEQ ID NO: 29415 - protein, 5 aa, Neisseria
FRLKP

SEQ ID NO: 29416 - protein, 7 aa, Neisseria
YQNRRKI

SEQ ID NO: 29417 - protein, 6 aa, Neisseria
GPDTQF

SEQ ID NO: 29418 - protein, 5 aa, Neisseria
FPPRL

SEQ ID NO: 29419 - protein, 14 aa, Neisseria
PPLLPRLGPHTLRR

SEQ ID NO: 29420 - protein, 10 aa, Neisseria
ILPKKLRPFK

SEQ ID NO: 29421 - protein, 5 aa, Neisseria
VRTRT

SEQ ID NO: 29422 - protein, 6 aa, Neisseria
QNRRKI

SEQ ID NO: 29423 - protein, 6 aa, Neisseria
PKKLRP

SEQ ID NO: 29424 - protein, 9 aa, Neisseria
GVLFALLQA

SEQ ID NO: 29425 - protein, 9 aa, Neisseria
WLQQLTDAL

SEQ ID NO: 29426 - protein, 14 aa, Neisseria
VISYLDLIADDWFS

SEQ ID NO: 29427 - protein, 5 aa, Neisseria
EKYRT

SEQ ID NO: 29428 - protein, 6 aa, Neisseria
EHSINN

SEQ ID NO: 29429 - protein, 5 aa, Neisseria
MQNEQ

SEQ ID NO: 29430 - protein, 9 aa, Neisseria
DAVFQSLLQ

SEQ ID NO: 29431 - protein, 6 aa, Neisseria
LKQGAK

SEQ ID NO: 29432 - protein, 6 aa, Neisseria
QIKQMI

SEQ ID NO: 29433 - protein, 6 aa, Neisseria
SHALLS

SEQ ID NO: 29434 - protein, 9 aa, Neisseria
FVEEIRDQF

SEQ ID NO: 29435 - protein, 6 aa, Neisseria
QNLVSL

SEQ ID NO: 29436 - protein, 15 aa, Neisseria
AEQLIRLTQVNRTIR

SEQ ID NO: 29437 - protein, 5 aa, Neisseria
FIAQV

SEQ ID NO: 29438 - protein, 7 aa, Neisseria
DLQKFYN

SEQ ID NO: 29439 - protein, 13 aa, Neisseria
EVKNAFEERVARL

SEQ ID NO: 29440 - protein, 6 aa, Neisseria
VADFNK

SEQ ID NO: 29441 - protein, 13 aa, Neisseria
DDAFNHPSSLAEA

SEQ ID NO: 29442 - protein, 11 aa, Neisseria
SGMPENLINAV

SEQ ID NO: 29443 - protein, 5 aa, Neisseria
LNGGK

SEQ ID NO: 29444 - protein, 6 aa, Neisseria
EAYAEL

SEQ ID NO: 29445 - protein, 8 aa, Neisseria
TPPEDIAA

SEQ ID NO: 29446 - protein, 7 aa, Neisseria
LLIRYFN

SEQ ID NO: 29447 - protein, 9 aa, Neisseria
SIEKYRTPA

SEQ ID NO: 29448 - protein, 6 aa, Neisseria
SHPGAD

SEQ ID NO: 29449 - protein, 11 aa, Neisseria
VGDEKISEHSI

SEQ ID NO: 29450 - protein, 13 aa, Neisseria
MQNEQADGGSPWR

SEQ ID NO: 29451 - protein, 6 aa, Neisseria
YLKQGA

SEQ ID NO: 29452 - protein, 7 aa, Neisseria
VSSEQIK

SEQ ID NO: 29453 - protein, 14 aa, Neisseria
IVDDPNFHDANGKF

SEQ ID NO: 29454 - protein, 17 aa, Neisseria
LSQRHMSEDQFVEEIRD

SEQ ID NO: 29455 - protein, 16 aa, Neisseria
QVNRTIRSHTFNPDEF

SEQ ID NO: 29456 - protein, 7 aa, Neisseria
KASEADL

SEQ ID NO: 29457 - protein, 9 aa, Neisseria
YNANKKDYL

SEQ ID NO: 29458 - protein, 23 aa, Neisseria
DFADKQTVSETEVKNAFEERVAR

SEQ ID NO: 29459 - protein, 78 aa, Neisseria
PAHEAKPSFEQEKAAVENELKMKKAVADFNKAKEKLGDDAFNHPSSLAEAAKNSGLKVETQETWLSRQDAQMSGMPEN

SEQ ID NO: 29460 - protein, 13 aa, Neisseria
FSDDVLKKKHNSE

SEQ ID NO: 29461 - protein, 12 aa, Neisseria
RAKEVREEKNLL

SEQ ID NO: 29462 - protein, 8 aa, Neisseria
EEAKDAVR

SEQ ID NO: 29463 - protein, 19 aa, Neisseria
AYIRTEAAKLAENKAKEVL

SEQ ID NO: 29464 - protein, 7 aa, Neisseria
NGGKAVD

SEQ ID NO: 29465 - protein, 12 aa, Neisseria
QQARQSMPPEAY

SEQ ID NO: 29466 - protein, 11 aa, Neisseria
LKAKPANGKPA

SEQ ID NO: 29467 - protein, 9 aa, Neisseria
AVTPPEDIA

SEQ ID NO: 29468 - protein, 11 aa, Neisseria
ALAQQQSANTF

SEQ ID NO: 29469 - protein, 20 aa, Neisseria
FNGKIKQTKGAQSVDNGDGQ

SEQ ID NO: 29470 - protein, 5 aa, Neisseria
EKYRT

SEQ ID NO: 29471 - protein, 8 aa, Neisseria
VGDEKISE

SEQ ID NO: 29472 - protein, 8 aa, Neisseria
MQNEQADG

SEQ ID NO: 29473 - protein, 7 aa, Neisseria
VSSEQIK

SEQ ID NO: 29474 - protein, 7 aa, Neisseria
IVDDPNF

SEQ ID NO: 29475 - protein, 5 aa, Neisseria
ANGKF

SEQ ID NO: 29476 - protein, 14 aa, Neisseria
RHMSEDQFVEEIRD

SEQ ID NO: 29477 - protein, 7 aa, Neisseria
KASEADL

SEQ ID NO: 29478 - protein, 8 aa, Neisseria
NANKKDYL

SEQ ID NO: 29479 - protein, 23 aa, Neisseria
DFADKQTVSETEVKNAFEERVAR

SEQ ID NO: 29480 - protein, 42 aa, Neisseria
PAHEAKPSFEQEKAAVENELKMKKAVADFNKAKEKLGDDAFN

SEQ ID NO: 29481 - protein, 17 aa, Neisseria
SLAEAAKNSGLKVETQE

SEQ ID NO: 29482 - protein, 9 aa, Neisseria
WLSRQDAQM

SEQ ID NO: 29483 - protein, 9 aa, Neisseria
DVLKKKHNS

SEQ ID NO: 29484 - protein, 12 aa, Neisseria
RAKEVREEKNLL

SEQ ID NO: 29485 - protein, 8 aa, Neisseria
EEAKDAVR

SEQ ID NO: 29486 - protein, 19 aa, Neisseria
AYIRTEAAKLAENKAKEVL

SEQ ID NO: 29487 - protein, 8 aa, Neisseria
QQARQSMP

SEQ ID NO: 29488 - protein, 8 aa, Neisseria
LKAKPANG

SEQ ID NO: 29489 - protein, 7 aa, Neisseria
TPPEDIA

SEQ ID NO: 29490 - protein, 17 aa, Neisseria
KIKQTKGAQSVDNGDGQ

SEQ ID NO: 29491 - protein, 11 aa, Neisseria
INRPYQKPAEL

SEQ ID NO: 29492 - protein, 7 aa, Neisseria
RIFSFPQ

SEQ ID NO: 29493 - protein, 9 aa, Neisseria
YNEFRTLRR

SEQ ID NO: 29494 - protein, 10 aa, Neisseria
AVDDVKGIAV

SEQ ID NO: 29495 - protein, 16 aa, Neisseria
MSKRKSINRPYQKPAE

SEQ ID NO: 29496 - protein, 17 aa, Neisseria
PPLQNNPPFYRKNRRLN

SEQ ID NO: 29497 - protein, 17 aa, Neisseria
ADGGCASPQKCRARGFQ

SEQ ID NO: 29498 - protein, 9 aa, Neisseria
PAVRPRRLR

SEQ ID NO: 29499 - protein, 6 aa, Neisseria
MPRRPV

SEQ ID NO: 29500 - protein, 15 aa, Neisseria
HTYNEFRTLRRRAQV

SEQ ID NO: 29501 - protein, 7 aa, Neisseria
VDIRHPN

SEQ ID NO: 29502 - protein, 7 aa, Neisseria
AVDDVKG

SEQ ID NO: 29503 - protein, 8 aa, Neisseria
MSKRKSIN

SEQ ID NO: 29504 - protein, 7 aa, Neisseria
PYQKPAE

SEQ ID NO: 29505 - protein, 7 aa, Neisseria
FYRKNRR

SEQ ID NO: 29506 - protein, 9 aa, Neisseria
SPQKCRARG

SEQ ID NO: 29507 - protein, 7 aa, Neisseria
VRPRRLR

SEQ ID NO: 29508 - protein, 5 aa, Neisseria
PRRPV

SEQ ID NO: 29509 - protein, 9 aa, Neisseria
RTLRRRAQV

SEQ ID NO: 29510 - protein, 5 aa, Neisseria
VDIRH

SEQ ID NO: 29511 - protein, 7 aa, Neisseria
AVDDVKG

SEQ ID NO: 29512 - protein, 5 aa, Neisseria
AILFG

SEQ ID NO: 29513 - protein, 5 aa, Neisseria
LGTAV

SEQ ID NO: 29514 - protein, 12 aa, Neisseria
VRGTKSLLRETV

SEQ ID NO: 29515 - protein, 6 aa, Neisseria
LPTFTQ

SEQ ID NO: 29516 - protein, 11 aa, Neisseria
VTVGALGSTVC

SEQ ID NO: 29517 - protein, 6 aa, Neisseria
RFEGLN

SEQ ID NO: 29518 - protein, 21 aa, Neisseria
AVMTLIGFFGGFFSVPLYTWL

SEQ ID NO: 29519 - protein, 10 aa, Neisseria
VPAKAADTQI

SEQ ID NO: 29520 - protein, 16 aa, Neisseria
RGTKSLLRETVRHNPV

SEQ ID NO: 29521 - protein, 8 aa, Neisseria
HLGGNDNV

SEQ ID NO: 29522 - protein, 7 aa, Neisseria
KFGRERL

SEQ ID NO: 29523 - protein, 7 aa, Neisseria
HGHRFEG

SEQ ID NO: 29524 - protein, 10 aa, Neisseria
ASSETFRARA

SEQ ID NO: 29525 - protein, 8 aa, Neisseria
IKRERRFL

SEQ ID NO: 29526 - protein, 6 aa, Neisseria
AIRKKP

SEQ ID NO: 29527 - protein, 9 aa, Neisseria
PAKAADTQI

SEQ ID NO: 29528 - protein, 12 aa, Neisseria
RGTKSLLRETVR

SEQ ID NO: 29529 - protein, 7 aa, Neisseria
KFGRERL

SEQ ID NO: 29530 - protein, 5 aa, Neisseria
HRFEG

SEQ ID NO: 29531 - protein, 7 aa, Neisseria
ETFRARA

SEQ ID NO: 29532 - protein, 8 aa, Neisseria
IKRERRFL

SEQ ID NO: 29533 - protein, 6 aa, Neisseria
AIRKKP

SEQ ID NO: 29534 - protein, 5 aa, Neisseria
EHVLG

SEQ ID NO: 29535 - protein, 7 aa, Neisseria
FADKVQT

SEQ ID NO: 29536 - protein, 7 aa, Neisseria
QVRVWKN

SEQ ID NO: 29537 - protein, 9 aa, Neisseria
NGVAKLLET

SEQ ID NO: 29538 - protein, 12 aa, Neisseria
ALARLIEQAGNA

SEQ ID NO: 29539 - protein, 12 aa, Neisseria
VPVADTLKRAES

SEQ ID NO: 29540 - protein, 8 aa, Neisseria
ENLGGITD

SEQ ID NO: 29541 - protein, 6 aa, Neisseria
MKRKNI

SEQ ID NO: 29542 - protein, 19 aa, Neisseria
RFGADKPKQYVEIGSKTVL

SEQ ID NO: 29543 - protein, 7 aa, Neisseria
ERHEAVD

SEQ ID NO: 29544 - protein, 11 aa, Neisseria
SPEDTFADKVQ

SEQ ID NO: 29545 - protein, 16 aa, Neisseria
WKNGGQTRAETVRNGV

SEQ ID NO: 29546 - protein, 5 aa, Neisseria
AETDN

SEQ ID NO: 29547 - protein, 5 aa, Neisseria
DAARC

SEQ ID NO: 29548 - protein, 6 aa, Neisseria
LPSEAL

SEQ ID NO: 29549 - protein, 12 aa, Neisseria
LIEQAGNAAEGG

SEQ ID NO: 29550 - protein, 10 aa, Neisseria
DTLKRAESGQ

SEQ ID NO: 29551 - protein, 7 aa, Neisseria
TVDRSGL

SEQ ID NO: 29552 - protein, 17 aa, Neisseria
NLGGITDEASAVEKLGV

SEQ ID NO: 29553 - protein, 15 aa, Neisseria
GDARNLKLTQPQDAY

SEQ ID NO: 29554 - protein, 6 aa, Neisseria
MKRKNI

SEQ ID NO: 29555 - protein, 10 aa, Neisseria
FGADKPKQYV

SEQ ID NO: 29556 - protein, 7 aa, Neisseria
ERHEAVD

SEQ ID NO: 29557 - protein, 11 aa, Neisseria
SPEDTFADKVQ

SEQ ID NO: 29558 - protein, 9 aa, Neisseria
GQTRAETVR

SEQ ID NO: 29559 - protein, 5 aa, Neisseria
AETDN

SEQ ID NO: 29560 - protein, 6 aa, Neisseria
AGNAAE

SEQ ID NO: 29561 - protein, 10 aa, Neisseria
DTLKRAESGQ

SEQ ID NO: 29562 - protein, 13 aa, Neisseria
ITDEASAVEKLGV

SEQ ID NO: 29563 - protein, 7 aa, Neisseria
GDARNLK

SEQ ID NO: 29564 - protein, 9 aa, Neisseria
RSLEVAKVA

SEQ ID NO: 29565 - protein, 6 aa, Neisseria
DRLGSQ

SEQ ID NO: 29566 - protein, 13 aa, Neisseria
QQTNRFNVLNRTN

SEQ ID NO: 29567 - protein, 6 aa, Neisseria
GDVTEF

SEQ ID NO: 29568 - protein, 12 aa, Neisseria
EAVDNLVQAVDN

SEQ ID NO: 29569 - protein, 12 aa, Neisseria
ATESSRSLEVAK

SEQ ID NO: 29570 - protein, 8 aa, Neisseria
TFDNRSSF

SEQ ID NO: 29571 - protein, 13 aa, Neisseria
IFSDSEDRLGSQA

SEQ ID NO: 29572 - protein, 13 aa, Neisseria
QQTNRFNVLNRTN

SEQ ID NO: 29573 - protein, 19 aa, Neisseria
LKQESGISGKAQNLKGADY

SEQ ID NO: 29574 - protein, 13 aa, Neisseria
GDVTEFGRRDVGD

SEQ ID NO: 29575 - protein, 8 aa, Neisseria
LGRGKSQI

SEQ ID NO: 29576 - protein, 5 aa, Neisseria
QGAGE

SEQ ID NO: 29577 - protein, 7 aa, Neisseria
ALSNREI

SEQ ID NO: 29578 - protein, 15 aa, Neisseria
GGTSGYDATLNGKVL

SEQ ID NO: 29579 - protein, 10 aa, Neisseria
VDNGAWQSNR

SEQ ID NO: 29580 - protein, 12 aa, Neisseria
ATESSRSLEVAK

SEQ ID NO: 29581 - protein, 7 aa, Neisseria
FDNRSSF

SEQ ID NO: 29582 - protein, 13 aa, Neisseria
IFSDSEDRLGSQA

SEQ ID NO: 29583 - protein, 16 aa, Neisseria
LKQESGISGKAQNLKG

SEQ ID NO: 29584 - protein, 12 aa, Neisseria
DVTEFGRRDVGD

SEQ ID NO: 29585 - protein, 5 aa, Neisseria
GRGKS

SEQ ID NO: 29586 - protein, 6 aa, Neisseria
LSNREI

SEQ ID NO: 29587 - protein, 7 aa, Neisseria
LAAVLAL

SEQ ID NO: 29588 - protein, 7 aa, Neisseria
QVRKAPD

SEQ ID NO: 29589 - protein, 5 aa, Neisseria
NAADI

SEQ ID NO: 29590 - protein, 10 aa, Neisseria
VRPEKLHQIF

SEQ ID NO: 29591 - protein, 10 aa, Neisseria
SYQILDSVTT

SEQ ID NO: 29592 - protein, 16 aa, Neisseria
GALVGAVVNQIANSLT

SEQ ID NO: 29593 - protein, 9 aa, Neisseria
SKTAAYNLL

SEQ ID NO: 29594 - protein, 20 aa, Neisseria
CQVRKAPDLDYTSFKESKPA

SEQ ID NO: 29595 - protein, 11 aa, Neisseria
PLNESPDVNGT

SEQ ID NO: 29596 - protein, 8 aa, Neisseria
ETFKENGL

SEQ ID NO: 29597 - protein, 8 aa, Neisseria
HAVRPEKL

SEQ ID NO: 29598 - protein, 31 aa, Neisseria; identical to SEQ ID NO: 3675

SEQ ID NO: 29599 - protein, 13 aa, Neisseria
SLTDRGYQVSKTA

SEQ ID NO: 29600 - protein, 19 aa, Neisseria
PYSRNGILKGPRFVEEQPK

SEQ ID NO: 29601 - protein, 9 aa, Neisseria
QVRKAPDLD

SEQ ID NO: 29602 - protein, 7 aa, Neisseria
SFKESKP

SEQ ID NO: 29603 - protein, 7 aa, Neisseria
LNESPDV

SEQ ID NO: 29604 - protein, 8 aa, Neisseria
ETFKENGL

SEQ ID NO: 29605 - protein, 8 aa, Neisseria
HAVRPEKL

SEQ ID NO: 29606 - protein, 16 aa, Neisseria
SAKARLVDSRNGKELW

SEQ ID NO: 29607 - protein, 10 aa, Neisseria
ASIREGSNNS

SEQ ID NO: 29608 - protein, 7 aa, Neisseria
LTDRGYQ

SEQ ID NO: 29609 - protein, 9 aa, Neisseria
PRFVEEQPK

SEQ ID NO: 29610 - protein, 6 aa, Neisseria
ILRTAF

SEQ ID NO: 29611 - protein, 10 aa, Neisseria
FARFADCRPF

SEQ ID NO: 29612 - protein, 10 aa, Neisseria
DDVPRFFAGE

SEQ ID NO: 29613 - protein, 8 aa, Neisseria
RDVVQGGL

SEQ ID NO: 29614 - protein, 24 aa, Neisseria
GEVEGIARIVTACQTLLQPPRQYQ

SEQ ID NO: 29615 - protein, 14 aa, Neisseria
IRLLHGIFNRIKVA

SEQ ID NO: 29616 - protein, 8 aa, Neisseria
FGNAFEDF

SEQ ID NO: 29617 - protein, 10 aa, Neisseria
VADGFRHFAA

SEQ ID NO: 29618 - protein, 9 aa, Neisseria
FGGNGKFIT

SEQ ID NO: 29619 - protein, 7 aa, Neisseria
RHQQGKA

SEQ ID NO: 29620 - protein, 18 aa, Neisseria
FFRRGNFGFRLQGRTDSF

SEQ ID NO: 29621 - protein, 8 aa, Neisseria
QRLDSGGY

SEQ ID NO: 29622 - protein, 6 aa, Neisseria
ADCRPF

SEQ ID NO: 29623 - protein, 14 aa, Neisseria
VDGRELVPSMEEDA

SEQ ID NO: 29624 - protein, 5 aa, Neisseria
ADDVP

SEQ ID NO: 29625 - protein, 24 aa, Neisseria
FAGEAQNRCNQENQAARDVVQGGL

SEQ ID NO: 29626 - protein, 17 aa, Neisseria
VEVERAQVFRAERNNVF

SEQ ID NO: 29627 - protein, 7 aa, Neisseria
GEVEGIA

SEQ ID NO: 29628 - protein, 7 aa, Neisseria
QPPRQYQ

SEQ ID NO: 29629 - protein, 7 aa, Neisseria
GKQEAQG

SEQ ID NO: 29630 - protein, 13 aa, Neisseria
IGGCRPQAQDVRA

SEQ ID NO: 29631 - protein, 10 aa, Neisseria
FLRRDDVADG

SEQ ID NO: 29632 - protein, 5 aa, Neisseria
CASHG

SEQ ID NO: 29633 - protein, 7 aa, Neisseria
LQGRTDS

SEQ ID NO: 29634 - protein, 5 aa, Neisseria
QRLDS

SEQ ID NO: 29635 - protein, 13 aa, Neisseria
DGRELVPSMEEDA

SEQ ID NO: 29636 - protein, 5 aa, Neisseria
ADDVP

SEQ ID NO: 29637 - protein, 16 aa, Neisseria
AQNRCNQENQAARDVV

SEQ ID NO: 29638 - protein, 15 aa, Neisseria
VEVERAQVFRAERNN

SEQ ID NO: 29639 - protein, 7 aa, Neisseria
GEVEGIA

SEQ ID NO: 29640 - protein, 7 aa, Neisseria
GKQEAQG

SEQ ID NO: 29641 - protein, 10 aa, Neisseria
CRPQAQDVRA

SEQ ID NO: 29642 - protein, 10 aa, Neisseria
FLRRDDVADG

SEQ ID NO: 29643 - protein, 6 aa, Neisseria
VHSPFD

SEQ ID NO: 29644 - protein, 8 aa, Neisseria
TSDFSGGV

SEQ ID NO: 29645 - protein, 8 aa, Neisseria
YQLHRTGS

SEQ ID NO: 29646 - protein, 25 aa, Neisseria
PADGYDGPQGGGYPEPQGARDIYSY

SEQ ID NO: 29647 - protein, 24 aa, Neisseria
NRMDDIRGIVQGAVNPFLTGFQGV

SEQ ID NO: 29648 - protein, 29 aa, Neisseria
IGAITDSAVSPVTDTAAQQTLQGINDLGN

SEQ ID NO: 29649 - protein, 10 aa, Neisseria
INSARQWADA

SEQ ID NO: 29650 - protein, 5 aa, Neisseria
DWVKN

SEQ ID NO: 29651 - protein, 10 aa, Neisseria
KPAARHMQTV

SEQ ID NO: 29652 - protein, 10 aa, Neisseria
GNRPPKSITS

SEQ ID NO: 29653 - protein, 15 aa, Neisseria
ATYPKLVNQLNEQNL

SEQ ID NO: 29654 - protein, 11 aa, Neisseria
EEADRLGKIWV

SEQ ID NO: 29655 - protein, 5 aa, Neisseria
TRQYR

SEQ ID NO: 29656 - protein, 23 aa, Neisseria
HANGLDARLRDDMQAKHYEPGGK

SEQ ID NO: 29657 - protein, 10 aa, Neisseria
NARGSVKNRV

SEQ ID NO: 29658 - protein, 9 aa, Neisseria
THERTGFEG

SEQ ID NO: 29659 - protein, 8 aa, Neisseria
FSGHGHEV

SEQ ID NO: 29660 - protein, 21 aa, Neisseria
SPFDNHDSKSTSDFSGGVDGG

SEQ ID NO: 29661 - protein, 32 aa, Neisseria
LHRTGSEIHPADGYDGPQGGGYPEPQGARDIY

SEQ ID NO: 29662 - protein, 10 aa, Neisseria
IKGTSTKTKI

SEQ ID NO: 29663 - protein, 13 aa, Neisseria
PFSDRWLKENAGA

SEQ ID NO: 29664 - protein, 7 aa, Neisseria
SRADEAG

SEQ ID NO: 29665 - protein, 20 aa, Neisseria
WENDPDKNWRANRMDDIRGI

SEQ ID NO: 29666 - protein, 12 aa, Neisseria
GINDLGNLSPEA

SEQ ID NO: 29667 - protein, 20 aa, Neisseria
FAVKDGINSARQWADAHPNI

SEQ ID NO: 29668 - protein, 28 aa, Neisseria
VWRGKKVELNPTKWDWVKNTGYKKPAAR

SEQ ID NO: 29669 - protein, 24 aa, Neisseria
QTVDGEMAGGNRPPKSITSEGKAN

SEQ ID NO: 29670 - protein, 7 aa, Neisseria
QLNEQNL

SEQ ID NO: 29671 - protein, 7 aa, Neisseria
AAQDPRL

SEQ ID NO: 29672 - protein, 9 aa, Neisseria
IHEGKKNFP

SEQ ID NO: 29673 - protein, 10 aa, Neisseria
ATYEEADRLG

SEQ ID NO: 29674 - protein, 29 aa, Neisseria
EGARQTSGGGWLSRDGTRQYRPPTEKKSQ

SEQ ID NO: 29675 - protein, 14 aa, Neisseria
TIDSNEKRNKIKNG

SEQ ID NO: 29676 - protein, 18 aa, Neisseria
LDARLRDDMQAKHYEPGG

SEQ ID NO: 29677 - protein, 9 aa, Neisseria
ARGSVKNRV

SEQ ID NO: 29678 - protein, 7 aa, Neisseria
THERTGF

SEQ ID NO: 29679 - protein, 12 aa, Neisseria
FDNHDSKSTSDF

SEQ ID NO: 29680 - protein, 8 aa, Neisseria
RTGSEIHP

SEQ ID NO: 29681 - protein, 7 aa, Neisseria
DGYDGPQ

SEQ ID NO: 29682 - protein, 10 aa, Neisseria
GYPEPQGARD

SEQ ID NO: 29683 - protein, 8 aa, Neisseria
GTSTKTKI

SEQ ID NO: 29684 - protein, 8 aa, Neisseria
RWLKENAG

SEQ ID NO: 29685 - protein, 7 aa, Neisseria
SRADEAG

SEQ ID NO: 29686 - protein, 17 aa, Neisseria
NDPDKNWRANRMDDIRG

SEQ ID NO: 29687 - protein, 5 aa, Neisseria
DGINS

SEQ ID NO: 29688 - protein, 11 aa, Neisseria
WRGKKVELNPT

SEQ ID NO: 29689 - protein, 9 aa, Neisseria
TGYKKPAAR

SEQ ID NO: 29690 - protein, 22 aa, Neisseria
VDGEMAGGNRPPKSITSEGKAN

SEQ ID NO: 29691 - protein, 6 aa, Neisseria
LNEQNL

SEQ ID NO: 29692 - protein, 7 aa, Neisseria
AAQDPRL

SEQ ID NO: 29693 - protein, 7 aa, Neisseria
HEGKKNF

SEQ ID NO: 29694 - protein, 9 aa, Neisseria
TYEEADRLG

SEQ ID NO: 29695 - protein, 7 aa, Neisseria
EGARQTS

SEQ ID NO: 29696 - protein, 18 aa, Neisseria
LSRDGTRQYRPPTEKKSQ

SEQ ID NO: 29697 - protein, 11 aa, Neisseria
DSNEKRNKIKN

SEQ ID NO: 29698 - protein, 7 aa, Neisseria
FRLVQSC

SEQ ID NO: 29699 - protein, 6 aa, Neisseria
NAHRKQ

SEQ ID NO: 29700 - protein, 10 aa, Neisseria
PGFNALPTIF

SEQ ID NO: 29701 - protein, 5 aa, Neisseria
EYFLT

SEQ ID NO: 29702 - protein, 5 aa, Neisseria
SSNEW

SEQ ID NO: 29703 - protein, 10 aa, Neisseria
FCATICASLR

SEQ ID NO: 29704 - protein, 9 aa, Neisseria
GIARNRRME

SEQ ID NO: 29705 - protein, 8 aa, Neisseria
CRRPDRFV

SEQ ID NO: 29706 - protein, 6 aa, Neisseria
RQTRLL

SEQ ID NO: 29707 - protein, 7 aa, Neisseria
QSCEVEP

SEQ ID NO: 29708 - protein, 17 aa, Neisseria
HNGKSGNAHRKQQKEIR

SEQ ID NO: 29709 - protein, 7 aa, Neisseria
VHCRSDV

SEQ ID NO: 29710 - protein, 11 aa, Neisseria
PAVRSATRKTA

SEQ ID NO: 29711 - protein, 10 aa, Neisseria
FRGGSGKSAS

SEQ ID NO: 29712 - protein, 9 aa, Neisseria
LGRGSCCEY

SEQ ID NO: 29713 - protein, 7 aa, Neisseria
RSSNEWK

SEQ ID NO: 29714 - protein, 28 aa, Neisseria
TAKRPPSFRRHMTCGNTAPTSSSSRLIK

SEQ ID NO: 29715 - protein, 12 aa, Neisseria
VAGSCPRSRVRT

SEQ ID NO: 29716 - protein, 8 aa, Neisseria
WRLNRSSP

SEQ ID NO: 29717 - protein, 9 aa, Neisseria
GIARNRRME

SEQ ID NO: 29718 - protein, 7 aa, Neisseria
RRPDRFV

SEQ ID NO: 29719 - protein, 16 aa, Neisseria
NGKSGNAHRKQQKEIR

SEQ ID NO: 29720 - protein, 9 aa, Neisseria
VRSATRKTA

SEQ ID NO: 29721 - protein, 7 aa, Neisseria
GSGKSAS

SEQ ID NO: 29722 - protein, 6 aa, Neisseria
SSNEWK

SEQ ID NO: 29723 - protein, 12 aa, Neisseria
TAKRPPSFRRHM

SEQ ID NO: 29724 - protein, 8 aa, Neisseria
SSSSRLIK

SEQ ID NO: 29725 - protein, 10 aa, Neisseria
GSCPRSRVRT

SEQ ID NO: 29726 - protein, 5 aa, Neisseria
NRSSP

SEQ ID NO: 29727 - protein, 8 aa, Neisseria
ADVGRFLH

SEQ ID NO: 29728 - protein, 7 aa, Neisseria
IQCLRNH

SEQ ID NO: 29729 - protein, 5 aa, Neisseria
APLFA

SEQ ID NO: 29730 - protein, 13 aa, Neisseria
QGEDFPRAGIQNH

SEQ ID NO: 29731 - protein, 6 aa, Neisseria
VQAVHN

SEQ ID NO: 29732 - protein, 8 aa, Neisseria
NFRAVFAI

SEQ ID NO: 29733 - protein, 6 aa, Neisseria
FKRKFQ

SEQ ID NO: 29734 - protein, 8 aa, Neisseria
AETRRQFA

SEQ ID NO: 29735 - protein, 10 aa, Neisseria
AHGRRSDFIR

SEQ ID NO: 29736 - protein, 13 aa, Neisseria
RNHERFDCRTRFD

SEQ ID NO: 29737 - protein, 23 aa, Neisseria
VGGRIGQGEDFPRAGIQNHHRSG

SEQ ID NO: 29738 - protein, 13 aa, Neisseria
QGLNPLIEGKDDV

SEQ ID NO: 29739 - protein, 5 aa, Neisseria
FKRKF

SEQ ID NO: 29740 - protein, 10 aa, Neisseria
NIGKSDDVCK

SEQ ID NO: 29741 - protein, 8 aa, Neisseria
AETRRQFA

SEQ ID NO: 29742 - protein, 9 aa, Neisseria
HGRRSDFIR

SEQ ID NO: 29743 - protein, 13 aa, Neisseria
RNHERFDCRTRFD

SEQ ID NO: 29744 - protein, 9 aa, Neisseria
IGQGEDFPR

SEQ ID NO: 29745 - protein, 7 aa, Neisseria
IEGKDDV

SEQ ID NO: 29746 - protein, 5 aa, Neisseria
FKRKF

SEQ ID NO: 29747 - protein, 8 aa, Neisseria
GKSDDVCK

SEQ ID NO: 29748 - protein, 7 aa, Neisseria
TRAANPP

SEQ ID NO: 29749 - protein, 10 aa, Neisseria
THTPHEPASS

SEQ ID NO: 29750 - protein, 15 aa, Neisseria
FLIGCIAHAFNRSFK

SEQ ID NO: 29751 - protein, 10 aa, Neisseria
FHACQRMVAV

SEQ ID NO: 29752 - protein, 13 aa, Neisseria
HFDRIAGILTVLN

SEQ ID NO: 29753 - protein, 12 aa, Neisseria
GFIQKLIVGIIH

SEQ ID NO: 29754 - protein, 14 aa, Neisseria
MPTRPTRAANPPTP

SEQ ID NO: 29755 - protein, 41 aa, Neisseria
YCPRPPYRPPSVQTHTPHEPASSTCAAKSANRRENSHNAQP

SEQ ID NO: 29756 - protein, 26 aa, Neisseria
PSNKMPSETEQTLFRRHQIPPSCRQS

SEQ ID NO: 29757 - protein, 6 aa, Neisseria
NRSFKA

SEQ ID NO: 29758 - protein, 7 aa, Neisseria
TIDDNIA

SEQ ID NO: 29759 - protein, 21 aa, Neisseria
KHHTDLDFNRERARIFNTDQL

SEQ ID NO: 29760 - protein, 11 aa, Neisseria
RIVGRKRHFDR

SEQ ID NO: 29761 - protein, 7 aa, Neisseria
FHQRENA

SEQ ID NO: 29762 - protein, 10 aa, Neisseria
RNHGIFCNSH

SEQ ID NO: 29763 - protein, 9 aa, Neisseria
CPFRNSRLI

SEQ ID NO: 29764 - protein, 10 aa, Neisseria
MPTRPTRAAN

SEQ ID NO: 29765 - protein, 7 aa, Neisseria
TPHEPAS

SEQ ID NO: 29766 - protein, 13 aa, Neisseria
CAAKSANRRENSH

SEQ ID NO: 29767 - protein, 13 aa, Neisseria
NKMPSETEQTLFR

SEQ ID NO: 29768 - protein, 5 aa, Neisseria
RSFKA

SEQ ID NO: 29769 - protein, 17 aa, Neisseria
KHHTDLDFNRERARIFN

SEQ ID NO: 29770 - protein, 11 aa, Neisseria
RIVGRKRHFDR

SEQ ID NO: 29771 - protein, 7 aa, Neisseria
FHQRENA

SEQ ID NO: 29772 - protein, 11 aa, Neisseria
VAAQFVDFVEQ

SEQ ID NO: 29773 - protein, 5 aa, Neisseria
HILQN

SEQ ID NO: 29774 - protein, 5 aa, Neisseria
ADQTQ

SEQ ID NO: 29775 - protein, 11 aa, Neisseria
NPFFDFFQAVV

SEQ ID NO: 29776 - protein, 9 aa, Neisseria
HQSGFGDVF

SEQ ID NO: 29777 - protein, 5 aa, Neisseria
FGHTR

SEQ ID NO: 29778 - protein, 5 aa, Neisseria
FDACL

SEQ ID NO: 29779 - protein, 15 aa, Neisseria
HPFADFGNLQNLLAL

SEQ ID NO: 29780 - protein, 9 aa, Neisseria
FKQRAGGIA

SEQ ID NO: 29781 - protein, 8 aa, Neisseria
VEQEQRVS

SEQ ID NO: 29782 - protein, 11 aa, Neisseria
HRADIGTAVPA

SEQ ID NO: 29783 - protein, 36 aa, Neisseria
AQGHTDIFPPRCFGDGFAQRGFAHARRADQTQNRTF

SEQ ID NO: 29784 - protein, 5 aa, Neisseria
HQSGF

SEQ ID NO: 29785 - protein, 9 aa, Neisseria
LPRQSEQGV

SEQ ID NO: 29786 - protein, 13 aa, Neisseria
AYDGGFGRHRRHH

SEQ ID NO: 29787 - protein, 7 aa, Neisseria
MRCDRIG

SEQ ID NO: 29788 - protein, 8 aa, Neisseria
FKQRAGGI

SEQ ID NO: 29789 - protein, 7 aa, Neisseria
VEQEQRV

SEQ ID NO: 29790 - protein, 5 aa, Neisseria
HRADI

SEQ ID NO: 29791 - protein, 14 aa, Neisseria
AHARRADQTQNRTF

SEQ ID NO: 29792 - protein, 7 aa, Neisseria
RQSEQGV

SEQ ID NO: 29793 - protein, 9 aa, Neisseria
GFGRHRRHH

SEQ ID NO: 29794 - protein, 7 aa, Neisseria
MRCDRIG

SEQ ID NO: 29795 - protein, 21 aa, Neisseria
MTRLARKAVQRLTASHIQRFL

SEQ ID NO: 29796 - protein, 9 aa, Neisseria
DSSRITSTI

SEQ ID NO: 29797 - protein, 5 aa, Neisseria
PSNAP

SEQ ID NO: 29798 - protein, 8 aa, Neisseria
RLARKAVQ

SEQ ID NO: 29799 - protein, 17 aa, Neisseria
LTESKTGANRSSSSCKP

SEQ ID NO: 29800 - protein, 8 aa, Neisseria
SASDSSRI

SEQ ID NO: 29801 - protein, 9 aa, Neisseria
STTGAVTKS

SEQ ID NO: 29802 - protein, 8 aa, Neisseria
RLARKAVQ

SEQ ID NO: 29803 - protein, 16 aa, Neisseria
LTESKTGANRSSSSCK

SEQ ID NO: 29804 - protein, 7 aa, Neisseria
ASDSSRI

SEQ ID NO: 29805 - protein, 6 aa, Neisseria
IAALLR

SEQ ID NO: 29806 - protein, 13 aa, Neisseria
NALQEINQIIPQT

SEQ ID NO: 29807 - protein, 5 aa, Neisseria
RLHRL

SEQ ID NO: 29808 - protein, 18 aa, Neisseria
LRGIKRLLQLIQSHLHTH

SEQ ID NO: 29809 - protein, 5 aa, Neisseria
RIGNF

SEQ ID NO: 29810 - protein, 9 aa, Neisseria
CLDGFHRLH

SEQ ID NO: 29811 - protein, 5 aa, Neisseria
NRFFT

SEQ ID NO: 29812 - protein, 10 aa, Neisseria
IRTFSRNFKQ

SEQ ID NO: 29813 - protein, 12 aa, Neisseria
MPPEARPAGSDG

SEQ ID NO: 29814 - protein, 6 aa, Neisseria
VYTQNA

SEQ ID NO: 29815 - protein, 5 aa, Neisseria
QTPSG

SEQ ID NO: 29816 - protein, 10 aa, Neisseria
CHRNHSRAQH

SEQ ID NO: 29817 - protein, 5 aa, Neisseria
MDIRI

SEQ ID NO: 29818 - protein, 7 aa, Neisseria
FRIDFLD

SEQ ID NO: 29819 - protein, 5 aa, Neisseria
RGIKR

SEQ ID NO: 29820 - protein, 5 aa, Neisseria
IQKRH

SEQ ID NO: 29821 - protein, 17 aa, Neisseria
LDRQHFHGKLLSGELVR

SEQ ID NO: 29822 - protein, 8 aa, Neisseria
FQLGNPRL

SEQ ID NO: 29823 - protein, 5 aa, Neisseria
RLGGS

SEQ ID NO: 29824 - protein, 44 aa, Neisseria
LKTNWKSKSGYYPSKIRTFSRNFKQRQEISHPPPNTLPQKPYKR

SEQ ID NO: 29825 - protein, 12 aa, Neisseria
MPPEARPAGSDG

SEQ ID NO: 29826 - protein, 8 aa, Neisseria
RNHSRAQH

SEQ ID NO: 29827 - protein, 5 aa, Neisseria
MDIRI

SEQ ID NO: 29828 - protein, 7 aa, Neisseria
FRIDFLD

SEQ ID NO: 29829 - protein, 5 aa, Neisseria
RGIKR

SEQ ID NO: 29830 - protein, 7 aa, Neisseria
TNWKSKS

SEQ ID NO: 29831 - protein, 17 aa, Neisseria
KIRTFSRNFKQRQEISH

SEQ ID NO: 29832 - protein, 5 aa, Neisseria
KPYKR

SEQ ID NO: 29833 - protein, 5 aa, Neisseria
AVNIA

SEQ ID NO: 29834 - protein, 20 aa, Neisseria
HVVCKRCAEVLVEQFADLFF

SEQ ID NO: 29835 - protein, 5 aa, Neisseria
DMGRF

SEQ ID NO: 29836 - protein, 19 aa, Neisseria
FGCDDVVDNLAGFGRGFRP

SEQ ID NO: 29837 - protein, 9 aa, Neisseria
MYGRNGSTQ

SEQ ID NO: 29838 - protein, 13 aa, Neisseria
DQTQRARFGNGEV

SEQ ID NO: 29839 - protein, 7 aa, Neisseria
FAGESGQ

SEQ ID NO: 29840 - protein, 6 aa, Neisseria
VCKRCA

SEQ ID NO: 29841 - protein, 9 aa, Neisseria
DCGHHDMGR

SEQ ID NO: 29842 - protein, 6 aa, Neisseria
LDDKLA

SEQ ID NO: 29843 - protein, 7 aa, Neisseria
GCDDVVD

SEQ ID NO: 29844 - protein, 9 aa, Neisseria
GFGRGFRPV

SEQ ID NO: 29845 - protein, 5 aa, Neisseria
LQQRG

SEQ ID NO: 29846 - protein, 9 aa, Neisseria
QTQRARFGN

SEQ ID NO: 29847 - protein, 5 aa, Neisseria
AGESG

SEQ ID NO: 29848 - protein, 6 aa, Neisseria
VCKRCA

SEQ ID NO: 29849 - protein, 6 aa, Neisseria
LDDKLA

SEQ ID NO: 29850 - protein, 6 aa, Neisseria
GFIQRL

SEQ ID NO: 29851 - protein, 20 aa, Neisseria
VVSSCSKIAKPGKKISTLQE

SEQ ID NO: 29852 - protein, 8 aa, Neisseria
YAVGRFGN

SEQ ID NO: 29853 - protein, 10 aa, Neisseria
RYTNKFDKSK

SEQ ID NO: 29854 - protein, 21 aa, Neisseria
PGAKQENPLFSLKRSGMDKQL

SEQ ID NO: 29855 - protein, 7 aa, Neisseria
ESIDIKY

SEQ ID NO: 29856 - protein, 8 aa, Neisseria
IDDLDASA

SEQ ID NO: 29857 - protein, 20 aa, Neisseria
SCSKIAKPGKKISTLQEAKS

SEQ ID NO: 29858 - protein, 16 aa, Neisseria
ITNDDKQNGNITRQKH

SEQ ID NO: 29859 - protein, 9 aa, Neisseria
RFGNNEESL

SEQ ID NO: 29860 - protein, 11 aa, Neisseria
FQLDDKGKWGN

SEQ ID NO: 29861 - protein, 8 aa, Neisseria
KKVKRMDV

SEQ ID NO: 29862 - protein, 29 aa, Neisseria
SGCPEDEDAGKEEKFRYTNKFDKSKNAVT

SEQ ID NO: 29863 - protein, 8 aa, Neisseria
IAASSDNS

SEQ ID NO: 29864 - protein, 12 aa, Neisseria
IRGGNVCANRTL

SEQ ID NO: 29865 - protein, 7 aa, Neisseria
PGAKQEN

SEQ ID NO: 29866 - protein, 11 aa, Neisseria
SLKRSGMDKQL

SEQ ID NO: 29867 - protein, 6 aa, Neisseria
ESIDIK

SEQ ID NO: 29868 - protein, 8 aa, Neisseria
IDDLDASA

SEQ ID NO: 29869 - protein, 12 aa, Neisseria
SKIAKPGKKIST

SEQ ID NO: 29870 - protein, 5 aa, Neisseria
QEAKS

SEQ ID NO: 29871 - protein, 15 aa, Neisseria
TNDDKQNGNITRQKH

SEQ ID NO: 29872 - protein, 7 aa, Neisseria
GNNEESL

SEQ ID NO: 29873 - protein, 9 aa, Neisseria
QLDDKGKWG

SEQ ID NO: 29874 - protein, 8 aa, Neisseria
KKVKRMDV

SEQ ID NO: 29875 - protein, 15 aa, Neisseria
CPEDEDAGKEEKFRY

SEQ ID NO: 29876 - protein, 10 aa, Neisseria
NKFDKSKNAV

SEQ ID NO: 29877 - protein, 7 aa, Neisseria
IAASSDN

SEQ ID NO: 29878 - protein, 8 aa, Neisseria
SENCEKGL

SEQ ID NO: 29879 - protein, 5 aa, Neisseria
EAFGN

SEQ ID NO: 29880 - protein, 6 aa, Neisseria
VEAVKR

SEQ ID NO: 29881 - protein, 13 aa, Neisseria
AAGVSKMPRYIIE

SEQ ID NO: 29882 - protein, 14 aa, Neisseria
QNVYRVTAKAWGKN

SEQ ID NO: 29883 - protein, 8 aa, Neisseria
MRKQNTLT

SEQ ID NO: 29884 - protein, 9 aa, Neisseria
PTSDGQRGS

SEQ ID NO: 29885 - protein, 19 aa, Neisseria
QSYNTEQRISANESDRKLA

SEQ ID NO: 29886 - protein, 9 aa, Neisseria
AALREGEFQ

SEQ ID NO: 29887 - protein, 17 aa, Neisseria
YAADSKVTFSENCEKGL

SEQ ID NO: 29888 - protein, 11 aa, Neisseria
RTNNNGSEEAF

SEQ ID NO: 29889 - protein, 21 aa, Neisseria
GKPAVEAVKRSCPAKSGKNST

SEQ ID NO: 29890 - protein, 24 aa, Neisseria
LCIDNKGMEYNKGAAGVSKMPRYI

SEQ ID NO: 29891 - protein, 8 aa, Neisseria
GVKNGQNV

SEQ ID NO: 29892 - protein, 8 aa, Neisseria
AWGKNANT

SEQ ID NO: 29893 - protein, 7 aa, Neisseria
VGNNDEQ

SEQ ID NO: 29894 - protein, 6 aa, Neisseria
MRKQNT

SEQ ID NO: 29895 - protein, 8 aa, Neisseria
PTSDGQRG

SEQ ID NO: 29896 - protein, 17 aa, Neisseria
YNTEQRISANESDRKLA

SEQ ID NO: 29897 - protein, 9 aa, Neisseria
AALREGEFQ

SEQ ID NO: 29898 - protein, 9 aa, Neisseria
YAADSKVTF

SEQ ID NO: 29899 - protein, 7 aa, Neisseria
ENCEKGL

SEQ ID NO: 29900 - protein, 11 aa, Neisseria
RTNNNGSEEAF

SEQ ID NO: 29901 - protein, 19 aa, Neisseria
PAVEAVKRSCPAKSGKNST

SEQ ID NO: 29902 - protein, 12 aa, Neisseria
LCIDNKGMEYNK

SEQ ID NO: 29903 - protein, 5 aa, Neisseria
NNDEQ

SEQ ID NO: 29904 - protein, 5 aa, Neisseria
CLRLK

SEQ ID NO: 29905 - protein, 9 aa, Neisseria
GMALIEVLV

SEQ ID NO: 29906 - protein, 8 aa, Neisseria
TVASVREA

SEQ ID NO: 29907 - protein, 14 aa, Neisseria
TIVSQITQNLMEGM

SEQ ID NO: 29908 - protein, 14 aa, Neisseria
EQLKRFSHELKNAL

SEQ ID NO: 29909 - protein, 15 aa, Neisseria
MKNNDCLRLKNPQSG

SEQ ID NO: 29910 - protein, 8 aa, Neisseria
ASVREAET

SEQ ID NO: 29911 - protein, 12 aa, Neisseria
PTIDLDSNKKNY

SEQ ID NO: 29912 - protein, 5 aa, Neisseria
MGKQT

SEQ ID NO: 29913 - protein, 5 aa, Neisseria
VDGEF

SEQ ID NO: 29914 - protein, 26 aa, Neisseria
LDAEKSKAQLAEEQLKRFSHELKNAL

SEQ ID NO: 29915 - protein, 31 aa, Neisseria
VCKDSSGDAPTLSDSGAFSSNCDNKANGDTL

SEQ ID NO: 29916 - protein, 19 aa, Neisseria
DSAGDSDISRTNLEVSGDN

SEQ ID NO: 29917 - protein, 7 aa, Neisseria
ARVGGRE

SEQ ID NO: 29918 - protein, 13 aa, Neisseria
MKNNDCLRLKNPQ

SEQ ID NO: 29919 - protein, 8 aa, Neisseria
ASVREAET

SEQ ID NO: 29920 - protein, 10 aa, Neisseria
IDLDSNKKNY

SEQ ID NO: 29921 - protein, 26 aa, Neisseria
LDAEKSKAQLAEEQLKRFSHELKNAL

SEQ ID NO: 29922 - protein, 14 aa, Neisseria
VCKDSSGDAPTLSD

SEQ ID NO: 29923 - protein, 8 aa, Neisseria
NCDNKANG

SEQ ID NO: 29924 - protein, 12 aa, Neisseria
SAGDSDISRTNL

SEQ ID NO: 29925 - protein, 5 aa, Neisseria
VGGRE

SEQ ID NO: 29926 - protein, 8 aa, Neisseria
EFIRGIKE

SEQ ID NO: 29927 - protein, 6 aa, Neisseria
FAGGSE

SEQ ID NO: 29928 - protein, 9 aa, Neisseria
ATVNLWAEP

SEQ ID NO: 29929 - protein, 18 aa, Neisseria
HTASPRDEFIRGIKESSP

SEQ ID NO: 29930 - protein, 11 aa, Neisseria
MQGGQKGMGRL

SEQ ID NO: 29931 - protein, 6 aa, Neisseria
FAGGSE

SEQ ID NO: 29932 - protein, 10 aa, Neisseria
NSRHILMGGG

SEQ ID NO: 29933 - protein, 14 aa, Neisseria
HAHERNTAEKSRAR

SEQ ID NO: 29934 - protein, 15 aa, Neisseria
ASPRDEFIRGIKESS

SEQ ID NO: 29935 - protein, 8 aa, Neisseria
GGQKGMGR

SEQ ID NO: 29936 - protein, 14 aa, Neisseria
HAHERNTAEKSRAR

SEQ ID NO: 29937 - protein, 10 aa, Neisseria
VADFGGIEGF

SEQ ID NO: 29938 - protein, 13 aa, Neisseria
RTVGGTVRLLKMI

SEQ ID NO: 29939 - protein, 10 aa, Neisseria
ARTVFRAHLR

SEQ ID NO: 29940 - protein, 8 aa, Neisseria
AARVFAVA

SEQ ID NO: 29941 - protein, 6 aa, Neisseria
LGQECR

SEQ ID NO: 29942 - protein, 16 aa, Neisseria
RHIARVESLLRAFEYA

SEQ ID NO: 29943 - protein, 7 aa, Neisseria
LRGRFQR

SEQ ID NO: 29944 - protein, 7 aa, Neisseria
VVTEVDA

SEQ ID NO: 29945 - protein, 5 aa, Neisseria
RLVGT

SEQ ID NO: 29946 - protein, 8 aa, Neisseria
PVVREAGI

SEQ ID NO: 29947 - protein, 8 aa, Neisseria
VKHARTVF

SEQ ID NO: 29948 - protein, 20 aa, Neisseria
IKNRLGQECRNRHIARVESL

SEQ ID NO: 29949 - protein, 12 aa, Neisseria
KTKTRAEQPRPA

SEQ ID NO: 29950 - protein, 5 aa, Neisseria
GRFQR

SEQ ID NO: 29951 - protein, 7 aa, Neisseria
VVTEVDA

SEQ ID NO: 29952 - protein, 8 aa, Neisseria
PVVREAGI

SEQ ID NO: 29953 - protein, 8 aa, Neisseria
VKHARTVF

SEQ ID NO: 29954 - protein, 18 aa, Neisseria
NRLGQECRNRHIARVESL

SEQ ID NO: 29955 - protein, 9 aa, Neisseria
TKTRAEQPR

SEQ ID NO: 29956 - protein, 7 aa, Neisseria
RFNTYSH

SEQ ID NO: 29957 - protein, 7 aa, Neisseria
GHGDGYR

SEQ ID NO: 29958 - protein, 7 aa, Neisseria
KLKSILK

SEQ ID NO: 29959 - protein, 11 aa, Neisseria
VLAVMKSLTAS

SEQ ID NO: 29960 - protein, 7 aa, Neisseria
ERFNTYS

SEQ ID NO: 29961 - protein, 7 aa, Neisseria
GHGDGYR

SEQ ID NO: 29962 - protein, 12 aa, Neisseria
GKLKSILKKTDH

SEQ ID NO: 29963 - protein, 7 aa, Neisseria
SLRNGPG

SEQ ID NO: 29964 - protein, 11 aa, Neisseria
TIGRKSEKRLL

SEQ ID NO: 29965 - protein, 10 aa, Neisseria
NDEKIRHGHG

SEQ ID NO: 29966 - protein, 12 aa, Neisseria
GKLKSILKKTDH

SEQ ID NO: 29967 - protein, 11 aa, Neisseria
TIGRKSEKRLL

SEQ ID NO: 29968 - protein, 7 aa, Neisseria
NDEKIRH

SEQ ID NO: 29969 - protein, 18 aa, Neisseria
VKTCADFHAFDGVDAHHR

SEQ ID NO: 29970 - protein, 7 aa, Neisseria
GIQGFAH

SEQ ID NO: 29971 - protein, 30 aa, Neisseria
DGVDAHHRVGDFGIEAVENGFAQTDGDVGG

SEQ ID NO: 29972 - protein, 8 aa, Neisseria
FRADGIQG

SEQ ID NO: 29973 - protein, 8 aa, Neisseria
VGGKKRIL

SEQ ID NO: 29974 - protein, 9 aa, Neisseria
GNVGGDFRA

SEQ ID NO: 29975 - protein, 11 aa, Neisseria
FFGNGSGGNAG

SEQ ID NO: 29976 - protein, 5 aa, Neisseria
GGTPA

SEQ ID NO: 29977 - protein, 9 aa, Neisseria
SGAEGGGDV

SEQ ID NO: 29978 - protein, 13 aa, Neisseria
DGVDAHHRVGDFG

SEQ ID NO: 29979 - protein, 7 aa, Neisseria
TDGDVGG

SEQ ID NO: 29980 - protein, 5 aa, Neisseria
FRADG

SEQ ID NO: 29981 - protein, 7 aa, Neisseria
GGKKRIL

SEQ ID NO: 29982 - protein, 5 aa, Neisseria
GDFRA

SEQ ID NO: 29983 - protein, 6 aa, Neisseria
GAEGGG

SEQ ID NO: 29984 - protein, 7 aa, Neisseria
AKFLQHP

SEQ ID NO: 29985 - protein, 9 aa, Neisseria
HFRSCGGVA

SEQ ID NO: 29986 - protein, 8 aa, Neisseria
RYREIYAV

SEQ ID NO: 29987 - protein, 9 aa, Neisseria
APAKYLGEQ

SEQ ID NO: 29988 - protein, 6 aa, Neisseria
GITRLL

SEQ ID NO: 29989 - protein, 9 aa, Neisseria
RSLQGFQTA

SEQ ID NO: 29990 - protein, 20 aa, Neisseria
AAGCKTLGEFDDRFTAPLHG

SEQ ID NO: 29991 - protein, 15 aa, Neisseria
YYRQTSCKPLLKHVA

SEQ ID NO: 29992 - protein, 7 aa, Neisseria
TPPDTPF

SEQ ID NO: 29993 - protein, 10 aa, Neisseria
LRNGNADTIA

SEQ ID NO: 29994 - protein, 22 aa, Neisseria
HPAPAYRREMLPDSTGKTKTAY

SEQ ID NO: 29995 - protein, 10 aa, Neisseria
SAGGISPDAP

SEQ ID NO: 29996 - protein, 9 aa, Neisseria
LEGSSRSHY

SEQ ID NO: 29997 - protein, 7 aa, Neisseria
VRNRGWH

SEQ ID NO: 29998 - protein, 7 aa, Neisseria
SCGGVAN

SEQ ID NO: 29999 - protein, 5 aa, Neisseria
GDTAE

SEQ ID NO: 30000 - protein, 7 aa, Neisseria
LTARYRE

SEQ ID NO: 30001 - protein, 18 aa, Neisseria
GGNAPAKYLGEQGKKALP

SEQ ID NO: 30002 - protein, 14 aa, Neisseria
VDAEAAGSRFDSGI

SEQ ID NO: 30003 - protein, 9 aa, Neisseria
LIPKARSLQ

SEQ ID NO: 30004 - protein, 10 aa, Neisseria
TLGEFDDRFT

SEQ ID NO: 30005 - protein, 17 aa, Neisseria
FADRHDYYRQTSCKPLL

SEQ ID NO: 30006 - protein, 17 aa, Neisseria
DPFLPPEALPRADEASE

SEQ ID NO: 30007 - protein, 5 aa, Neisseria
AHGGH

SEQ ID NO: 30008 - protein, 7 aa, Neisseria
SSTGGRL

SEQ ID NO: 30009 - protein, 8 aa, Neisseria
DSFRTNRR

SEQ ID NO: 30010 - protein, 8 aa, Neisseria
AYRREMLP

SEQ ID NO: 30011 - protein, 7 aa, Neisseria
STGKTKT

SEQ ID NO: 30012 - protein, 6 aa, Neisseria
EGSSRS

SEQ ID NO: 30013 - protein, 5 aa, Neisseria
VRNRG

SEQ ID NO: 30014 - protein, 7 aa, Neisseria
LTARYRE

SEQ ID NO: 30015 - protein, 11 aa, Neisseria
YLGEQGKKALP

SEQ ID NO: 30016 - protein, 14 aa, Neisseria
VDAEAAGSRFDSGI

SEQ ID NO: 30017 - protein, 7 aa, Neisseria
LIPKARS

SEQ ID NO: 30018 - protein, 10 aa, Neisseria
TLGEFDDRFT

SEQ ID NO: 30019 - protein, 9 aa, Neisseria
FADRHDYYR

SEQ ID NO: 30020 - protein, 10 aa, Neisseria
ALPRADEASE

SEQ ID NO: 30021 - protein, 6 aa, Neisseria
FRTNRR

SEQ ID NO: 30022 - protein, 5 aa, Neisseria
SFLPN

SEQ ID NO: 30023 - protein, 17 aa, Neisseria
DLVNKVLAEVARLEKMF

SEQ ID NO: 30024 - protein, 17 aa, Neisseria
SPPADFLELLSLAAIFT

SEQ ID NO: 30025 - protein, 11 aa, Neisseria
MGRHFGRRRFL

SEQ ID NO: 30026 - protein, 15 aa, Neisseria
AGGEKRNMDKKRDEN

SEQ ID NO: 30027 - protein, 5 aa, Neisseria
GSGAE

SEQ ID NO: 30028 - protein, 8 aa, Neisseria
GVDDRQAA

SEQ ID NO: 30029 - protein, 5 aa, Neisseria
ARLEK

SEQ ID NO: 30030 - protein, 23 aa, Neisseria
YREDSLISRLNRDGYLTSPPADF

SEQ ID NO: 30031 - protein, 8 aa, Neisseria
HFGRRRFL

SEQ ID NO: 30032 - protein, 14 aa, Neisseria
GGEKRNMDKKRDEN

SEQ ID NO: 30033 - protein, 8 aa, Neisseria
GVDDRQAA

SEQ ID NO: 30034 - protein, 5 aa, Neisseria
ARLEK

SEQ ID NO: 30035 - protein, 7 aa, Neisseria
YREDSLI

SEQ ID NO: 30036 - protein, 7 aa, Neisseria
RLNRDGY

SEQ ID NO: 30037 - protein, 9 aa, Neisseria
KAYTEELPP

SEQ ID NO: 30038 - protein, 17 aa, Neisseria
VRSKAKAEKFYREKMIQ

SEQ ID NO: 30039 - protein, 5 aa, Neisseria
LEHKP

SEQ ID NO: 30040 - protein, 15 aa, Neisseria
KNHGKGMAEQVRFKA

SEQ ID NO: 30041 - protein, 12 aa, Neisseria
VLPDDEDARTIA

SEQ ID NO: 30042 - protein, 14 aa, Neisseria
GTDAVASGETYGRV

SEQ ID NO: 30043 - protein, 7 aa, Neisseria
AYTEELP

SEQ ID NO: 30044 - protein, 17 aa, Neisseria
VRSKAKAEKFYREKMIQ

SEQ ID NO: 30045 - protein, 5 aa, Neisseria
LEHKP

SEQ ID NO: 30046 - protein, 14 aa, Neisseria
NHGKGMAEQVRFKA

SEQ ID NO: 30047 - protein, 12 aa, Neisseria
VLPDDEDARTIA

SEQ ID NO: 30048 - protein, 11 aa, Neisseria
PFFSLFRALFE

SEQ ID NO: 30049 - protein, 16 aa, Neisseria
FIDSVGQITARFFQAF

SEQ ID NO: 30050 - protein, 18 aa, Neisseria
QYLARINQVGIVDLIPVR

SEQ ID NO: 30051 - protein, 16 aa, Neisseria
TGCTGICPKYPTGCRP

SEQ ID NO: 30052 - protein, 7 aa, Neisseria
GAHDAAE

SEQ ID NO: 30053 - protein, 14 aa, Neisseria
PAFRAREQARRGSG

SEQ ID NO: 30054 - protein, 22 aa, Neisseria
GNDLRVLHKDAVEVDIDGGNTV

SEQ ID NO: 30055 - protein, 8 aa, Neisseria
TDFDDGDA

SEQ ID NO: 30056 - protein, 5 aa, Neisseria
AEARF

SEQ ID NO: 30057 - protein, 10 aa, Neisseria
PVRAPQGGTI

SEQ ID NO: 30058 - protein, 11 aa, Neisseria
CPKYPTGCRPV

SEQ ID NO: 30059 - protein, 7 aa, Neisseria
GAHDAAE

SEQ ID NO: 30060 - protein, 11 aa, Neisseria
FRAREQARRGS

SEQ ID NO: 30061 - protein, 17 aa, Neisseria
NDLRVLHKDAVEVDIDG

SEQ ID NO: 30062 - protein, 8 aa, Neisseria
TDFDDGDA

SEQ ID NO: 30063 - protein, 5 aa, Neisseria
AEARF

SEQ ID NO: 30064 - protein, 5 aa, Neisseria
FTFQT

SEQ ID NO: 30065 - protein, 9 aa, Neisseria
DTARAFAAA

SEQ ID NO: 30066 - protein, 6 aa, Neisseria
GLFADV

SEQ ID NO: 30067 - protein, 14 aa, Neisseria
VHKGIGNAVVGGFD

SEQ ID NO: 30068 - protein, 6 aa, Neisseria
GVVRNL

SEQ ID NO: 30069 - protein, 11 aa, Neisseria
EGDGLDVFAPV

SEQ ID NO: 30070 - protein, 7 aa, Neisseria
CLNQAGG

SEQ ID NO: 30071 - protein, 5 aa, Neisseria
ARSDG

SEQ ID NO: 30072 - protein, 6 aa, Neisseria
TFRQPA

SEQ ID NO: 30073 - protein, 6 aa, Neisseria
AADDTL

SEQ ID NO: 30074 - protein, 9 aa, Neisseria
VRQRPRLRL

SEQ ID NO: 30075 - protein, 7 aa, Neisseria
HQRRVDL

SEQ ID NO: 30076 - protein, 14 aa, Neisseria
RQIKGNVHGFDEHA

SEQ ID NO: 30077 - protein, 9 aa, Neisseria
AHARDDVPD

SEQ ID NO: 30078 - protein, 17 aa, Neisseria
PFGKNGGVKQEKRVTPV

SEQ ID NO: 30079 - protein, 11 aa, Neisseria
GFDGGGFDGGG

SEQ ID NO: 30080 - protein, 9 aa, Neisseria
QILRDPLCA

SEQ ID NO: 30081 - protein, 8 aa, Neisseria
VSEGDGLD

SEQ ID NO: 30082 - protein, 17 aa, Neisseria
NQAGGRILTAREDDQGF

SEQ ID NO: 30083 - protein, 5 aa, Neisseria
ARSDG

SEQ ID NO: 30084 - protein, 6 aa, Neisseria
AADDTL

SEQ ID NO: 30085 - protein, 9 aa, Neisseria
VRQRPRLRL

SEQ ID NO: 30086 - protein, 7 aa, Neisseria
HQRRVDL

SEQ ID NO: 30087 - protein, 6 aa, Neisseria
GFDEHA

SEQ ID NO: 30088 - protein, 8 aa, Neisseria
HARDDVPD

SEQ ID NO: 30089 - protein, 11 aa, Neisseria
GGVKQEKRVTP

SEQ ID NO: 30090 - protein, 6 aa, Neisseria
SEGDGL

SEQ ID NO: 30091 - protein, 9 aa, Neisseria
LTAREDDQG

SEQ ID NO: 30092 - protein, 9 aa, Neisseria
NLIGVLANA

SEQ ID NO: 30093 - protein, 19 aa, Neisseria
EALAFYQEVGKLNAANSLT

SEQ ID NO: 30094 - protein, 5 aa, Neisseria
EVIRI

SEQ ID NO: 30095 - protein, 7 aa, Neisseria
KLATLKK

SEQ ID NO: 30096 - protein, 6 aa, Neisseria
NAARAL

SEQ ID NO: 30097 - protein, 9 aa, Neisseria
LGALAAFTQ

SEQ ID NO: 30098 - protein, 7 aa, Neisseria
LNAFLEA

SEQ ID NO: 30099 - protein, 14 aa, Neisseria
VALATLCNYANNLA

SEQ ID NO: 30100 - protein, 20 aa, Neisseria
ETAPEAAKPRVEAVPKNNGF

SEQ ID NO: 30101 - protein, 5 aa, Neisseria
GEVEV

SEQ ID NO: 30102 - protein, 6 aa, Neisseria
RTNQCS

SEQ ID NO: 30103 - protein, 5 aa, Neisseria
QSLNA

SEQ ID NO: 30104 - protein, 8 aa, Neisseria
GKSDDAKL

SEQ ID NO: 30105 - protein, 12 aa, Neisseria
MAKKGAVSDDEL

SEQ ID NO: 30106 - protein, 7 aa, Neisseria
GYNRQQA

SEQ ID NO: 30107 - protein, 7 aa, Neisseria
TEINPKL

SEQ ID NO: 30108 - protein, 15 aa, Neisseria
TAPEAAKPRVEAVPK

SEQ ID NO: 30109 - protein, 5 aa, Neisseria
GEVEV

SEQ ID NO: 30110 - protein, 5 aa, Neisseria
QSLNA

SEQ ID NO: 30111 - protein, 8 aa, Neisseria
GKSDDAKL

SEQ ID NO: 30112 - protein, 12 aa, Neisseria
MAKKGAVSDDEL

SEQ ID NO: 30113 - protein, 6 aa, Neisseria
VVKPEK

SEQ ID NO: 30114 - protein, 12 aa, Neisseria
RSYKVAEFTQTG

SEQ ID NO: 30115 - protein, 7 aa, Neisseria
IPSHVRV

SEQ ID NO: 30116 - protein, 7 aa, Neisseria
NRIIDVS

SEQ ID NO: 30117 - protein, 8 aa, Neisseria
LNQAAQNF

SEQ ID NO: 30118 - protein, 17 aa, Neisseria
AVVKPEKLHASANRSYK

SEQ ID NO: 30119 - protein, 8 aa, Neisseria
TQTGNASW

SEQ ID NO: 30120 - protein, 16 aa, Neisseria
GGRFHGRKTSGGDRYD

SEQ ID NO: 30121 - protein, 10 aa, Neisseria
VTNTKNGKSV

SEQ ID NO: 30122 - protein, 21 aa, Neisseria
RVNDRGPFHGNRIIDVSKAAA

SEQ ID NO: 30123 - protein, 16 aa, Neisseria
VPGQSAPVAENKDIFI

SEQ ID NO: 30124 - protein, 10 aa, Neisseria
LKSFGTEHEA

SEQ ID NO: 30125 - protein, 17 aa, Neisseria
ASSSSPNLSVEKRRYEY

SEQ ID NO: 30126 - protein, 13 aa, Neisseria
ASQERAAEAEAQA

SEQ ID NO: 30127 - protein, 17 aa, Neisseria
AVVKPEKLHASANRSYK

SEQ ID NO: 30128 - protein, 13 aa, Neisseria
FHGRKTSGGDRYD

SEQ ID NO: 30129 - protein, 7 aa, Neisseria
TNTKNGK

SEQ ID NO: 30130 - protein, 8 aa, Neisseria
VNDRGPFH

SEQ ID NO: 30131 - protein, 10 aa, Neisseria
RIIDVSKAAA

SEQ ID NO: 30132 - protein, 10 aa, Neisseria
PVAENKDIFI

SEQ ID NO: 30133 - protein, 9 aa, Neisseria
KSFGTEHEA

SEQ ID NO: 30134 - protein, 10 aa, Neisseria
LSVEKRRYEY

SEQ ID NO: 30135 - protein, 13 aa, Neisseria
ASQERAAEAEAQA

SEQ ID NO: 30136 - protein, 16 aa, Neisseria
QFRRHRRRQCPNRKPI

SEQ ID NO: 30137 - protein, 7 aa, Neisseria
ALKRKHF

SEQ ID NO: 30138 - protein, 5 aa, Neisseria
SRAGA

SEQ ID NO: 30139 - protein, 7 aa, Neisseria
WHTRNRE

SEQ ID NO: 30140 - protein, 16 aa, Neisseria
QFRRHRRRQCPNRKPI

SEQ ID NO: 30141 - protein, 7 aa, Neisseria
ALKRKHF

SEQ ID NO: 30142 - protein, 5 aa, Neisseria
SRAGA

SEQ ID NO: 30143 - protein, 8 aa, Neisseria
EILVKLVR

SEQ ID NO: 30144 - protein, 6 aa, Neisseria
VKTFDD

SEQ ID NO: 30145 - protein, 8 aa, Neisseria
HIRRMVER

SEQ ID NO: 30146 - protein, 7 aa, Neisseria
VRTTEKT

SEQ ID NO: 30147 - protein, 6 aa, Neisseria
IGNSHK

SEQ ID NO: 30148 - protein, 8 aa, Neisseria
TPDFFEPY

SEQ ID NO: 30149 - protein, 20 aa, Neisseria
FAELSQAHDIIHPLSELVSM

SEQ ID NO: 30150 - protein, 7 aa, Neisseria
IKEPLDK

SEQ ID NO: 30151 - protein, 8 aa, Neisseria
AREAEEAA

SEQ ID NO: 30152 - protein, 9 aa, Neisseria
QEAARVSEW

SEQ ID NO: 30153 - protein, 15 aa, Neisseria
EFEQFWKGLPQTVQN

SEQ ID NO: 30154 - protein, 11 aa, Neisseria
SQKTWKSGMDK

SEQ ID NO: 30155 - protein, 7 aa, Neisseria
ETPNGIK

SEQ ID NO: 30156 - protein, 5 aa, Neisseria
MKKNL

SEQ ID NO: 30157 - protein, 29 aa, Neisseria
LSGCDRLGIGNPFSGKEISCGSEETKEIL

SEQ ID NO: 30158 - protein, 24 aa, Neisseria
LVRDNVEGETVKTFDDDAFKDQAF

SEQ ID NO: 30159 - protein, 7 aa, Neisseria
HIRRMVE

SEQ ID NO: 30160 - protein, 26 aa, Neisseria
LGITVDEVRTTEKTDTSSKLKCEAAL

SEQ ID NO: 30161 - protein, 8 aa, Neisseria
LDVPDDVV

SEQ ID NO: 30162 - protein, 14 aa, Neisseria
QSIGNSHKKTPDFF

SEQ ID NO: 30163 - protein, 8 aa, Neisseria
YYRKEGAY

SEQ ID NO: 30164 - protein, 11 aa, Neisseria
SVQPTDDKSKI

SEQ ID NO: 30165 - protein, 34 aa, Neisseria
LIKEPLDKAKQRNEKLEAAEATAQEAREAEEAAA

SEQ ID NO: 30166 - protein, 25 aa, Neisseria
ALGREQEAARVSEWEERYKLSRSEF

SEQ ID NO: 30167 - protein, 61 aa, Neisseria
VQNKLQASQKTWKSGMDKICANNAKAEGETPNGIKVSELACKTAETEARLEELHNRKKALI

SEQ ID NO: 30168 - protein, 15 aa, Neisseria
EMVREEDKKELPKRL

SEQ ID NO: 30169 - protein, 5 aa, Neisseria
MKKNL

SEQ ID NO: 30170 - protein, 6 aa, Neisseria
GCDRLG

SEQ ID NO: 30171 - protein, 17 aa, Neisseria
FSGKEISCGSEETKEIL

SEQ ID NO: 30172 - protein, 24 aa, Neisseria
LVRDNVEGETVKTFDDDAFKDQAF

SEQ ID NO: 30173 - protein, 7 aa, Neisseria
HIRRMVE

SEQ ID NO: 30174 - protein, 26 aa, Neisseria
LGITVDEVRTTEKTDTSSKLKCEAAL

SEQ ID NO: 30175 - protein, 8 aa, Neisseria
LDVPDDVV

SEQ ID NO: 30176 - protein, 9 aa, Neisseria
NSHKKTPDF

SEQ ID NO: 30177 - protein, 6 aa, Neisseria
YYRKEG

SEQ ID NO: 30178 - protein, 8 aa, Neisseria
PTDDKSKI

SEQ ID NO: 30179 - protein, 34 aa, Neisseria; identical to SEQ ID NO: 30165

SEQ ID NO: 30180 - protein, 25 aa, Neisseria
ALGREQEAARVSEWEERYKLSRSEF

SEQ ID NO: 30181 - protein, 11 aa, Neisseria
KTWKSGMDKIC

SEQ ID NO: 30182 - protein, 10 aa, Neisseria
NAKAEGETPN

SEQ ID NO: 30183 - protein, 28 aa, Neisseria
IKVSELACKTAETEARLEELHNRKKALI

SEQ ID NO: 30184 - protein, 15 aa, Neisseria
EMVREEDKKELPKRL

SEQ ID NO: 30185 - protein, 11 aa, Neisseria
KPCASLDASSA

SEQ ID NO: 30186 - protein, 10 aa, Neisseria
WDFIRNTASP

SEQ ID NO: 30187 - protein, 10 aa, Neisseria
FKTRALGRFS

SEQ ID NO: 30188 - protein, 12 aa, Neisseria
WSRSAFSCKPCA

SEQ ID NO: 30189 - protein, 8 aa, Neisseria
RNTASPKV

SEQ ID NO: 30190 - protein, 11 aa, Neisseria
FKTRALGRFSA

SEQ ID NO: 30191 - protein, 23 aa, Neisseria
LSNRGVKKPLSFKSPSVQVDTSA

SEQ ID NO: 30192 - protein, 5 aa, Neisseria
SLRSS

SEQ ID NO: 30193 - protein, 6 aa, Neisseria
TASPKV

SEQ ID NO: 30194 - protein, 7 aa, Neisseria
FKTRALG

SEQ ID NO: 30195 - protein, 8 aa, Neisseria
RGVKKPLS

SEQ ID NO: 30196 - protein, 8 aa, Neisseria
LLTAFAAF

SEQ ID NO: 30197 - protein, 6 aa, Neisseria
DLTEGC

SEQ ID NO: 30198 - protein, 5 aa, Neisseria
PDGSR

SEQ ID NO: 30199 - protein, 7 aa, Neisseria
MNKNRKL

SEQ ID NO: 30200 - protein, 25 aa, Neisseria
DLTEGCTLPDGSRVRAAAVSTKKPF

SEQ ID NO: 30201 - protein, 7 aa, Neisseria
HAPAGTE

SEQ ID NO: 30202 - protein, 7 aa, Neisseria
KNMDMGF

SEQ ID NO: 30203 - protein, 10 aa, Neisseria
YMFERQPSGT

SEQ ID NO: 30204 - protein, 11 aa, Neisseria
VCVEGRRDFTA

SEQ ID NO: 30205 - protein, 6 aa, Neisseria
IGSRTF

SEQ ID NO: 30206 - protein, 7 aa, Neisseria
MNKNRKL

SEQ ID NO: 30207 - protein, 8 aa, Neisseria
PDGSRVRA

SEQ ID NO: 30208 - protein, 6 aa, Neisseria
STKKPF

SEQ ID NO: 30209 - protein, 5 aa, Neisseria
PAGTE

SEQ ID NO: 30210 - protein, 6 aa, Neisseria
MFERQP

SEQ ID NO: 30211 - protein, 9 aa, Neisseria
VEGRRDFTA

SEQ ID NO: 30212 - protein, 5 aa, Neisseria
MARIW

SEQ ID NO: 30213 - protein, 5 aa, Neisseria
SPCPA

SEQ ID NO: 30214 - protein, 5 aa, Neisseria
PKSPA

SEQ ID NO: 30215 - protein, 7 aa, Neisseria
FSSRMAR

SEQ ID NO: 30216 - protein, 10 aa, Neisseria
LTTKPKSPAK

SEQ ID NO: 30217 - protein, 5 aa, Neisseria
RSNCL

SEQ ID NO: 30218 - protein, 10 aa, Neisseria
SSTTGAPTSR

SEQ ID NO: 30219 - protein, 14 aa, Neisseria
SASINKDTRMPASV

SEQ ID NO: 30220 - protein, 10 aa, Neisseria
CCANTSKPPS

SEQ ID NO: 30221 - protein, 8 aa, Neisseria
TKPKSPAK

SEQ ID NO: 30222 - protein, 8 aa, Neisseria
SINKDTRM

SEQ ID NO: 30223 - protein, 6 aa, Neisseria
NTSKPP

SEQ ID NO: 30224 - protein, 7 aa, Neisseria
ITRITDE

SEQ ID NO: 30225 - protein, 8 aa, Neisseria
AEEFSSTN

SEQ ID NO: 30226 - protein, 6 aa, Neisseria
FRAITS

SEQ ID NO: 30227 - protein, 9 aa, Neisseria
IITIEDPIE

SEQ ID NO: 30228 - protein, 13 aa, Neisseria
NWMAALKNTLRQA

SEQ ID NO: 30229 - protein, 9 aa, Neisseria
NQALDRIIN

SEQ ID NO: 30230 - protein, 11 aa, Neisseria
GNIHEIKEVMK

SEQ ID NO: 30231 - protein, 6 aa, Neisseria
DQHLYQ

SEQ ID NO: 30232 - protein, 9 aa, Neisseria
QDALKNADS

SEQ ID NO: 30233 - protein, 12 aa, Neisseria
FTDENMTAKEEL

SEQ ID NO: 30234 - protein, 9 aa, Neisseria
HMNKNKGSD

SEQ ID NO: 30235 - protein, 21 aa, Neisseria
MKLDGKITRITDEPLTAEKCM

SEQ ID NO: 30236 - protein, 11 aa, Neisseria
KQAEEFSSTNE

SEQ ID NO: 30237 - protein, 9 aa, Neisseria
LPDTSRFRV

SEQ ID NO: 30238 - protein, 12 aa, Neisseria
ITSKIPKFESLN

SEQ ID NO: 30239 - protein, 5 aa, Neisseria
PPALK

SEQ ID NO: 30240 - protein, 7 aa, Neisseria
VALKKRG

SEQ ID NO: 30241 - protein, 9 aa, Neisseria
TGSGKSTSL

SEQ ID NO: 30242 - protein, 10 aa, Neisseria
IDYRNENSFG

SEQ ID NO: 30243 - protein, 5 aa, Neisseria
IEDPI

SEQ ID NO: 30244 - protein, 6 aa, Neisseria
HEHKNC

SEQ ID NO: 30245 - protein, 11 aa, Neisseria
TQREVGVDTEN

SEQ ID NO: 30246 - protein, 10 aa, Neisseria
LKNTLRQAPD

SEQ ID NO: 30247 - protein, 8 aa, Neisseria
EIRDRETM

SEQ ID NO: 30248 - protein, 9 aa, Neisseria
NSTNQALDR

SEQ ID NO: 30249 - protein, 10 aa, Neisseria
FPEERREQLL

SEQ ID NO: 30250 - protein, 13 aa, Neisseria
LVPRDGGKGRVAA

SEQ ID NO: 30251 - protein, 11 aa, Neisseria
HEIKEVMKKST

SEQ ID NO: 30252 - protein, 7 aa, Neisseria
EKGEISL

SEQ ID NO: 30253 - protein, 12 aa, Neisseria
DALKNADSAHDL

SEQ ID NO: 30254 - protein, 15 aa, Neisseria
LRSRRAQSSDPDLEL

SEQ ID NO: 30255 - protein, 12 aa, Neisseria
FTDENMTAKEEL

SEQ ID NO: 30256 - protein, 8 aa, Neisseria
MNKNKGSD

SEQ ID NO: 30257 - protein, 21 aa, Neisseria
MKLDGKITRITDEPLTAEKCM

SEQ ID NO: 30258 - protein, 8 aa, Neisseria
KQAEEFSS

SEQ ID NO: 30259 - protein, 7 aa, Neisseria
DTSRFRV

SEQ ID NO: 30260 - protein, 7 aa, Neisseria
KIPKFES

SEQ ID NO: 30261 - protein, 7 aa, Neisseria
VALKKRG

SEQ ID NO: 30262 - protein, 7 aa, Neisseria
GSGKSTS

SEQ ID NO: 30263 - protein, 7 aa, Neisseria
DYRNENS

SEQ ID NO: 30264 - protein, 5 aa, Neisseria
IEDPI

SEQ ID NO: 30265 - protein, 5 aa, Neisseria
HEHKN

SEQ ID NO: 30266 - protein, 9 aa, Neisseria
TQREVGVDT

SEQ ID NO: 30267 - protein, 7 aa, Neisseria
NTLRQAP

SEQ ID NO: 30268 - protein, 8 aa, Neisseria
EIRDRETM

SEQ ID NO: 30269 - protein, 5 aa, Neisseria
QALDR

SEQ ID NO: 30270 - protein, 9 aa, Neisseria
PEERREQLL

SEQ ID NO: 30271 - protein, 13 aa, Neisseria
LVPRDGGKGRVAA

SEQ ID NO: 30272 - protein, 11 aa, Neisseria
HEIKEVMKKST

SEQ ID NO: 30273 - protein, 7 aa, Neisseria
EKGEISL

SEQ ID NO: 30274 - protein, 12 aa, Neisseria
DALKNADSAHDL

SEQ ID NO: 30275 - protein, 15 aa, Neisseria
LRSRRAQSSDPDLEL

SEQ ID NO: 30276 - protein, 5 aa, Neisseria
YKDGK

SEQ ID NO: 30277 - protein, 5 aa, Neisseria
EAVFK

SEQ ID NO: 30278 - protein, 14 aa, Neisseria
LVTDDYYKDGKHID

SEQ ID NO: 30279 - protein, 13 aa, Neisseria
QLHRDEEAVRRHI

SEQ ID NO: 30280 - protein, 5 aa, Neisseria
PDMNA

SEQ ID NO: 30281 - protein, 8 aa, Neisseria
GEFDGKQP

SEQ ID NO: 30282 - protein, 11 aa, Neisseria
HPTRKADDQTV

SEQ ID NO: 30283 - protein, 12 aa, Neisseria
PVGSAQNGRAEY

SEQ ID NO: 30284 - protein, 7 aa, Neisseria
TLPPANH

SEQ ID NO: 30285 - protein, 7 aa, Neisseria
RVEDAAG

SEQ ID NO: 30286 - protein, 28 aa, Neisseria
VENKWITSQGNAVDLTPMDKLFNNAGSK

SEQ ID NO: 30287 - protein, 10 aa, Neisseria
DYYKDGKHID

SEQ ID NO: 30288 - protein, 13 aa, Neisseria
QLHRDEEAVRRHI

SEQ ID NO: 30289 - protein, 6 aa, Neisseria
EFDGKQ

SEQ ID NO: 30290 - protein, 10 aa, Neisseria
PTRKADDQTV

SEQ ID NO: 30291 - protein, 7 aa, Neisseria
QNGRAEY

SEQ ID NO: 30292 - protein, 7 aa, Neisseria
RVEDAAG

SEQ ID NO: 30293 - protein, 7 aa, Neisseria
TPMDKLF

SEQ ID NO: 30294 - protein, 7 aa, Neisseria
RRWATMM

SEQ ID NO: 30295 - protein, 6 aa, Neisseria
SFKMAR

SEQ ID NO: 30296 - protein, 7 aa, Neisseria
PFDPMGW

SEQ ID NO: 30297 - protein, 9 aa, Neisseria
GRLYRTFSN

SEQ ID NO: 30298 - protein, 8 aa, Neisseria
TKRGRRLT

SEQ ID NO: 30299 - protein, 13 aa, Neisseria
STSTLRKLMRPST

SEQ ID NO: 30300 - protein, 9 aa, Neisseria
MMRSADSTV

SEQ ID NO: 30301 - protein, 18 aa, Neisseria
FSIRRSSACWTRRSDSLS

SEQ ID NO: 30302 - protein, 6 aa, Neisseria
SSNNNI

SEQ ID NO: 30303 - protein, 14 aa, Neisseria
MATRCRCPPDKLLP

SEQ ID NO: 30304 - protein, 5 aa, Neisseria
DPMGW

SEQ ID NO: 30305 - protein, 9 aa, Neisseria
SPSGDASIR

SEQ ID NO: 30306 - protein, 16 aa, Neisseria
WRADRTSASPASGRLY

SEQ ID NO: 30307 - protein, 26 aa, Neisseria
FSNRVSSNRNTSWETRANWARRQSSL

SEQ ID NO: 30308 - protein, 15 aa, Neisseria
LPADGSTKRGRRLTT

SEQ ID NO: 30309 - protein, 15 aa, Neisseria
PLPERPTRATRSPCL

SEQ ID NO: 30310 - protein, 5 aa, Neisseria
LKLSR

SEQ ID NO: 30311 - protein, 24 aa, Neisseria
LMPSERYSTSTLRKLMRPSTRCGA

SEQ ID NO: 30312 - protein, 17 aa, Neisseria
CSGGVSRNAHTPSAARN

SEQ ID NO: 30313 - protein, 7 aa, Neisseria
FSIRRSS

SEQ ID NO: 30314 - protein, 8 aa, Neisseria
WTRRSDSL

SEQ ID NO: 30315 - protein, 11 aa, Neisseria
MATRCRCPPDK

SEQ ID NO: 30316 - protein, 7 aa, Neisseria
SGDASIR

SEQ ID NO: 30317 - protein, 7 aa, Neisseria
RADRTSA

SEQ ID NO: 30318 - protein, 12 aa, Neisseria
RVSSNRNTSWET

SEQ ID NO: 30319 - protein, 9 aa, Neisseria
ANWARRQSS

SEQ ID NO: 30320 - protein, 12 aa, Neisseria
DGSTKRGRRLTT

SEQ ID NO: 30321 - protein, 11 aa, Neisseria
PLPERPTRATR

SEQ ID NO: 30322 - protein, 5 aa, Neisseria
LKLSR

SEQ ID NO: 30323 - protein, 8 aa, Neisseria
LMPSERYS

SEQ ID NO: 30324 - protein, 12 aa, Neisseria
TLRKLMRPSTRC

SEQ ID NO: 30325 - protein, 7 aa, Neisseria
GVSRNAH

SEQ ID NO: 30326 - protein, 16 aa, Neisseria
GIAVFEVVGRLLDFVL

SEQ ID NO: 30327 - protein, 11 aa, Neisseria
NEVIDVFHALQ

SEQ ID NO: 30328 - protein, 30 aa, Neisseria
AFDAVGNFAEYGRAIDTADLLEIGKLGYFH

SEQ ID NO: 30329 - protein, 8 aa, Neisseria
AVGVVAVA

SEQ ID NO: 30330 - protein, 15 aa, Neisseria
  VARIANT 12: Xaa is any amino acid
MPRFEDQLVGRXGKA

SEQ ID NO: 30331 - protein, 7 aa, Neisseria
RFCPNEV

SEQ ID NO: 30332 - protein, 8 aa, Neisseria
EYGRAIDT

SEQ ID NO: 30333 - protein, 15 aa, Neisseria
VEPDFPAQTPRTEGG

SEQ ID NO: 30334 - protein, 7 aa, Neisseria
FDKADVV

SEQ ID NO: 30335 - protein, 11 aa, Neisseria
DIGGGGFEGDL

SEQ ID NO: 30336 - protein, 28 aa, Neisseria
LDVGGKPRLGAERAQAGGGMGCAGTDFH

SEQ ID NO: 30337 - protein, 6 aa, Neisseria
GLDDGA

SEQ ID NO: 30338 - protein, 16 aa, Neisseria
EGLQFEDDLLEGKHGL

SEQ ID NO: 30339 - protein, 8 aa, Neisseria
PRFEDQLV

SEQ ID NO: 30340 - protein, 8 aa, Neisseria
EYGRAIDT

SEQ ID NO: 30341 - protein, 5 aa, Neisseria
VEPDF

SEQ ID NO: 30342 - protein, 6 aa, Neisseria
TPRTEG

SEQ ID NO: 30343 - protein, 7 aa, Neisseria
FDKADVV

SEQ ID NO: 30344 - protein, 6 aa, Neisseria
GFEGDL

SEQ ID NO: 30345 - protein, 14 aa, Neisseria
VGGKPRLGAERAQA

SEQ ID NO: 30346 - protein, 6 aa, Neisseria
GLDDGA

SEQ ID NO: 30347 - protein, 14 aa, Neisseria
LQFEDDLLEGKHGL

SEQ ID NO: 30348 - protein, 9 aa, Neisseria
IGPLPSIGR

SEQ ID NO: 30349 - protein, 5 aa, Neisseria
TGTSK

SEQ ID NO: 30350 - protein, 19 aa, Neisseria
RTIPSVTEITVPRVLTSAF

SEQ ID NO: 30351 - protein, 12 aa, Neisseria
FSILALIRSLIS

SEQ ID NO: 30352 - protein, 17 aa, Neisseria
LYRQIQNLITHFNFYAA

SEQ ID NO: 30353 - protein, 12 aa, Neisseria
ETLIQHLRQLAD

SEQ ID NO: 30354 - protein, 25 aa, Neisseria
SIGRPNASTTRPTNSRPTGTSKIRP

SEQ ID NO: 30355 - protein, 16 aa, Neisseria
SPNTTAPTESRSRFIA

SEQ ID NO: 30356 - protein, 10 aa, Neisseria
PKVLPGNSSI

SEQ ID NO: 30357 - protein, 9 aa, Neisseria
IASDKPWMR

SEQ ID NO: 30358 - protein, 6 aa, Neisseria
FTDRFS

SEQ ID NO: 30359 - protein, 8 aa, Neisseria
RHSRVQST

SEQ ID NO: 30360 - protein, 9 aa, Neisseria
FDFDRDFQL

SEQ ID NO: 30361 - protein, 11 aa, Neisseria
TVNDGRFDMVE

SEQ ID NO: 30362 - protein, 23 aa, Neisseria
GRPNASTTRPTNSRPTGTSKIRP

SEQ ID NO: 30363 - protein, 11 aa, Neisseria
APTESRSRFIA

SEQ ID NO: 30364 - protein, 7 aa, Neisseria
IASDKPW

SEQ ID NO: 30365 - protein, 6 aa, Neisseria
RHSRVQ

SEQ ID NO: 30366 - protein, 7 aa, Neisseria
FDFDRDF

SEQ ID NO: 30367 - protein, 9 aa, Neisseria
NDGRFDMVE

SEQ ID NO: 30368 - protein, 5 aa, Neisseria
GCLIS

SEQ ID NO: 30369 - protein, 6 aa, Neisseria
LPAITT

SEQ ID NO: 30370 - protein, 15 aa, Neisseria
QWEGTDTGSGRARLA

SEQ ID NO: 30371 - protein, 8 aa, Neisseria
CPGELKLT

SEQ ID NO: 30372 - protein, 8 aa, Neisseria
TTSPCADS

SEQ ID NO: 30373 - protein, 8 aa, Neisseria
CSSSKPKM

SEQ ID NO: 30374 - protein, 17 aa, Neisseria
PCGTADCISSARRRTSL

SEQ ID NO: 30375 - protein, 8 aa, Neisseria
ASAKSNAS

SEQ ID NO: 30376 - protein, 5 aa, Neisseria
PPTSK

SEQ ID NO: 30377 - protein, 14 aa, Neisseria
WEGTDTGSGRARLA

SEQ ID NO: 30378 - protein, 5 aa, Neisseria
GELKL

SEQ ID NO: 30379 - protein, 7 aa, Neisseria
SSSKPKM

SEQ ID NO: 30380 - protein, 9 aa, Neisseria
SSARRRTSL

SEQ ID NO: 30381 - protein, 7 aa, Neisseria
ASAKSNA

SEQ ID NO: 30382 - protein, 10 aa, Neisseria
SFSILGDVAK

SEQ ID NO: 30383 - protein, 8 aa, Neisseria
DIKKIRSA

SEQ ID NO: 30384 - protein, 7 aa, Neisseria
DIQRAVK

SEQ ID NO: 30385 - protein, 12 aa, Neisseria
YAEATKGIQPLK

SEQ ID NO: 30386 - protein, 12 aa, Neisseria
DYAQNVAETLIK

SEQ ID NO: 30387 - protein, 9 aa, Neisseria
VAAIIRQIK

SEQ ID NO: 30388 - protein, 9 aa, Neisseria
EGIKAVFTE

SEQ ID NO: 30389 - protein, 13 aa, Neisseria
KDTRMVDRIAKET

SEQ ID NO: 30390 - protein, 15 aa, Neisseria
LYSDALGNAPADTYI

SEQ ID NO: 30391 - protein, 7 aa, Neisseria
IGGERVA

SEQ ID NO: 30392 - protein, 6 aa, Neisseria
ANQDTH

SEQ ID NO: 30393 - protein, 12 aa, Neisseria
TSGDIKKIRSAK

SEQ ID NO: 30394 - protein, 24 aa, Neisseria
EAADIQRAVKQSKVSYAEATKGIQ

SEQ ID NO: 30395 - protein, 41 aa, Neisseria
LKAEEEGGHHHDHHHDHDHDHEGHHHDHGEYDPHVWNDPVL

SEQ ID NO: 30396 - protein, 13 aa, Neisseria
TLIKADPEGKVYY

SEQ ID NO: 30397 - protein, 9 aa, Neisseria
QLKKLHSDA

SEQ ID NO: 30398 - protein, 9 aa, Neisseria
PAAKRKVLT

SEQ ID NO: 30399 - protein, 5 aa, Neisseria
MGNRY

SEQ ID NO: 30400 - protein, 13 aa, Neisseria
QGVSSEAEPSAKQ

SEQ ID NO: 30401 - protein, 8 aa, Neisseria
RQIKREGI

SEQ ID NO: 30402 - protein, 18 aa, Neisseria
ENIKDTRMVDRIAKETGV

SEQ ID NO: 30403 - protein, 7 aa, Neisseria
VSGKLYS

SEQ ID NO: 30404 - protein, 5 aa, Neisseria
APADT

SEQ ID NO: 30405 - protein, 5 aa, Neisseria
YRHNV

SEQ ID NO: 30406 - protein, 7 aa, Neisseria
IGGERVA

SEQ ID NO: 30407 - protein, 10 aa, Neisseria
GDIKKIRSAK

SEQ ID NO: 30408 - protein, 13 aa, Neisseria
EAADIQRAVKQSK

SEQ ID NO: 30409 - protein, 5 aa, Neisseria
EATKG

SEQ ID NO: 30410 - protein, 32 aa, Neisseria
LKAEEEGGHHHDHHHDHDHDHEGHHHDHGEYD

SEQ ID NO: 30411 - protein, 9 aa, Neisseria
TLIKADPEG

SEQ ID NO: 30412 - protein, 9 aa, Neisseria
QLKKLHSDA

SEQ ID NO: 30413 - protein, 9 aa, Neisseria
PAAKRKVLT

SEQ ID NO: 30414 - protein, 11 aa, Neisseria
VSSEAEPSAKQ

SEQ ID NO: 30415 - protein, 8 aa, Neisseria
RQIKREGI

SEQ ID NO: 30416 - protein, 18 aa, Neisseria
ENIKDTRMVDRIAKETGV

SEQ ID NO: 30417 - protein, 16 aa, Neisseria
AAGMLMALLAGLVSRF

SEQ ID NO: 30418 - protein, 11 aa, Neisseria
LQLIAAVSGLT

SEQ ID NO: 30419 - protein, 11 aa, Neisseria
LVSGFQALGIL

SEQ ID NO: 30420 - protein, 13 aa, Neisseria
SVLIALFCGLIGL

SEQ ID NO: 30421 - protein, 5 aa, Neisseria
RRMSL

SEQ ID NO: 30422 - protein, 8 aa, Neisseria
TTLKEDAN

SEQ ID NO: 30423 - protein, 7 aa, Neisseria
SKNGSSV

SEQ ID NO: 30424 - protein, 8 aa, Neisseria
KSVNGKGG

SEQ ID NO: 30425 - protein, 5 aa, Neisseria
IPSGP

SEQ ID NO: 30426 - protein, 7 aa, Neisseria
LGKEGGI

SEQ ID NO: 30427 - protein, 10 aa, Neisseria
WFKNHRHHTT

SEQ ID NO: 30428 - protein, 5 aa, Neisseria
RRMSL

SEQ ID NO: 30429 - protein, 8 aa, Neisseria
TTLKEDAN

SEQ ID NO: 30430 - protein, 5 aa, Neisseria
KNGSS

SEQ ID NO: 30431 - protein, 7 aa, Neisseria
LGKEGGI

SEQ ID NO: 30432 - protein, 5 aa, Neisseria
HRHHT

SEQ ID NO: 30433 - protein, 15 aa, Neisseria
LIVALLVLINPFSAL

SEQ ID NO: 30434 - protein, 15 aa, Neisseria
VFAVIAVFALIGGAL

SEQ ID NO: 30435 - protein, 5 aa, Neisseria
RPARN

SEQ ID NO: 30436 - protein, 5 aa, Neisseria
VSRLL

SEQ ID NO: 30437 - protein, 9 aa, Neisseria
TILNRIMGM

SEQ ID NO: 30438 - protein, 14 aa, Neisseria
TNGHSTKERRKVAR

SEQ ID NO: 30439 - protein, 27 aa, Neisseria
NGNDNPAKQNLGAQPETGQARPARNAG

SEQ ID NO: 30440 - protein, 11 aa, Neisseria
HSTKERRKVAR

SEQ ID NO: 30441 - protein, 11 aa, Neisseria
NGNDNPAKQNL

SEQ ID NO: 30442 - protein, 13 aa, Neisseria
AQPETGQARPARN

SEQ ID NO: 30443 - protein, 13 aa, Neisseria
GGNSYSDVPKQLH

SEQ ID NO: 30444 - protein, 6 aa, Neisseria
SQILNL

SEQ ID NO: 30445 - protein, 22 aa, Neisseria
WKDGGGNSYSDVPKQLHPDQSQ

SEQ ID NO: 30446 - protein, 61 aa, Neisseria
TLQTKPAVKPKPAVDTNADSAKENEKDIAEKNGQLEEEKKKIAETERQNKEENCRISKMNL

SEQ ID NO: 30447 - protein, 24 aa, Neisseria
GNSNAKNKDDLIRKYNNAVNKYCR

SEQ ID NO: 30448 - protein, 7 aa, Neisseria
SYSDVPK

SEQ ID NO: 30449 - protein, 7 aa, Neisseria
LHPDQSQ

SEQ ID NO: 30450 - protein, 56 aa, Neisseria
PAVKPKPAVDTNADSAKENEKDIAEKNGQLEEEKKKIAETERQNKEENCRISKMNL

SEQ ID NO: 30451 - protein, 14 aa, Neisseria
SNAKNKDDLIRKYN

SEQ ID NO: 30452 - protein, 10 aa, Neisseria
EAFAGFFETV

SEQ ID NO: 30453 - protein, 6 aa, Neisseria
TFAARF

SEQ ID NO: 30454 - protein, 6 aa, Neisseria
VDFDVF

SEQ ID NO: 30455 - protein, 8 aa, Neisseria
VVFRLFRQ

SEQ ID NO: 30456 - protein, 9 aa, Neisseria
NTACGNVGG

SEQ ID NO: 30457 - protein, 5 aa, Neisseria
FAAAF

SEQ ID NO: 30458 - protein, 12 aa, Neisseria
FVQFIRDDFGHR

SEQ ID NO: 30459 - protein, 16 aa, Neisseria
FRVFGQFARQFADCAV

SEQ ID NO: 30460 - protein, 8 aa, Neisseria
DGFDVVDK

SEQ ID NO: 30461 - protein, 20 aa, Neisseria
LHQVRQTARSGDNQIDRFAQ

SEQ ID NO: 30462 - protein, 5 aa, Neisseria
AHIFG

SEQ ID NO: 30463 - protein, 5 aa, Neisseria
RQCVF

SEQ ID NO: 30464 - protein, 16 aa, Neisseria
RAFARFFAAFGQSLQS

SEQ ID NO: 30465 - protein, 9 aa, Neisseria
MPSETRNRF

SEQ ID NO: 30466 - protein, 7 aa, Neisseria
HAFDGQF

SEQ ID NO: 30467 - protein, 11 aa, Neisseria
HFGKRNRNTRA

SEQ ID NO: 30468 - protein, 6 aa, Neisseria
GAPDAV

SEQ ID NO: 30469 - protein, 7 aa, Neisseria
VGNGRYV

SEQ ID NO: 30470 - protein, 8 aa, Neisseria
GNVGGNQN

SEQ ID NO: 30471 - protein, 7 aa, Neisseria
QIRQRAV

SEQ ID NO: 30472 - protein, 5 aa, Neisseria
AVGGE

SEQ ID NO: 30473 - protein, 17 aa, Neisseria
FIRDDFGHRFGGRENHT

SEQ ID NO: 30474 - protein, 9 aa, Neisseria
  VARIANT 8: Xaa is any amino acid
VPSGGEQXS

SEQ ID NO: 30475 - protein, 17 aa, Neisseria
VGRGGFHDGFDVVDKAH

SEQ ID NO: 30476 - protein, 15 aa, Neisseria
RQTARSGDNQIDRFA

SEQ ID NO: 30477 - protein, 19 aa, Neisseria
GAGLVAERCAADDADGAEP

SEQ ID NO: 30478 - protein, 17 aa, Neisseria
DLRRQFAGRCQHQRARA

SEQ ID NO: 30479 - protein, 6 aa, Neisseria
QSLQSR

SEQ ID NO: 30480 - protein, 9 aa, Neisseria
MPSETRNRF

SEQ ID NO: 30481 - protein, 9 aa, Neisseria
GKRNRNTRA

SEQ ID NO: 30482 - protein, 6 aa, Neisseria
IRQRAV

SEQ ID NO: 30483 - protein, 7 aa, Neisseria
IRDDFGH

SEQ ID NO: 30484 - protein, 8 aa, Neisseria
FGGRENHT

SEQ ID NO: 30485 - protein, 6 aa, Neisseria
  VARIANT 6: Xaa is any amino acid
SGGEQX

SEQ ID NO: 30486 - protein, 7 aa, Neisseria
DVVDKAH

SEQ ID NO: 30487 - protein, 15 aa, Neisseria
RQTARSGDNQIDRFA

SEQ ID NO: 30488 - protein, 14 aa, Neisseria
VAERCAADDADGAE

SEQ ID NO: 30489 - protein, 7 aa, Neisseria
DLRRQFA

SEQ ID NO: 30490 - protein, 8 aa, Neisseria
CQHQRARA

SEQ ID NO: 30491 - protein, 5 aa, Neisseria
VCFLG

SEQ ID NO: 30492 - protein, 5 aa, Neisseria
QIPSW

SEQ ID NO: 30493 - protein, 8 aa, Neisseria
GTLLDGFD

SEQ ID NO: 30494 - protein, 10 aa, Neisseria
QGLPDSIDLP

SEQ ID NO: 30495 - protein, 5 aa, Neisseria
HSTAR

SEQ ID NO: 30496 - protein, 15 aa, Neisseria
HPFAESLDKTLEEVL

SEQ ID NO: 30497 - protein, 5 aa, Neisseria
VPSLP

SEQ ID NO: 30498 - protein, 7 aa, Neisseria
AIPSFSD

SEQ ID NO: 30499 - protein, 5 aa, Neisseria
QVLGG

SEQ ID NO: 30500 - protein, 7 aa, Neisseria
IGKAADI

SEQ ID NO: 30501 - protein, 9 aa, Neisseria
GINRELTRW

SEQ ID NO: 30502 - protein, 14 aa, Neisseria
LHIAELHNFFKPPF

SEQ ID NO: 30503 - protein, 7 aa, Neisseria
FGGNMAN

SEQ ID NO: 30504 - protein, 6 aa, Neisseria
RITASL

SEQ ID NO: 30505 - protein, 5 aa, Neisseria
DLGAL

SEQ ID NO: 30506 - protein, 6 aa, Neisseria
QNITGS

SEQ ID NO: 30507 - protein, 5 aa, Neisseria
GSIAD

SEQ ID NO: 30508 - protein, 5 aa, Neisseria
TAELS

SEQ ID NO: 30509 - protein, 6 aa, Neisseria
VTGMIK

SEQ ID NO: 30510 - protein, 10 aa, Neisseria
GNVRGVGTVR

SEQ ID NO: 30511 - protein, 9 aa, Neisseria
TVSFVGPLN

SEQ ID NO: 30512 - protein, 10 aa, Neisseria
AGVEILGSLN

SEQ ID NO: 30513 - protein, 5 aa, Neisseria
LAGQI

SEQ ID NO: 30514 - protein, 19 aa, Neisseria
VKLIYRLTRAIQAVARIGS

SEQ ID NO: 30515 - protein, 7 aa, Neisseria
RFDRLFG

SEQ ID NO: 30516 - protein, 32 aa, Neisseria; identical to SEQ ID NO: 4572

SEQ ID NO: 30517 - protein, 11 aa, Neisseria
KPSELMRRSLH

SEQ ID NO: 30518 - protein, 19 aa, Neisseria
KPTPPKEERPPQGLPDSID

SEQ ID NO: 30519 - protein, 20 aa, Neisseria
DRFETGKISMGKTFDKQTVY

SEQ ID NO: 30520 - protein, 26 aa, Neisseria
YRYDRKGHRLDLKAADTPWSSSSGSA

SEQ ID NO: 30521 - protein, 7 aa, Neisseria
GLKKPFA

SEQ ID NO: 30522 - protein, 10 aa, Neisseria
TKGGFEGETI

SEQ ID NO: 30523 - protein, 14 aa, Neisseria
STARLSGSLKDVRA

SEQ ID NO: 30524 - protein, 14 aa, Neisseria
LTIDGGNIRLSGKS

SEQ ID NO: 30525 - protein, 8 aa, Neisseria
ESLDKTLE

SEQ ID NO: 30526 - protein, 5 aa, Neisseria
SLPDA

SEQ ID NO: 30527 - protein, 9 aa, Neisseria
GSLDLENTK

SEQ ID NO: 30528 - protein, 10 aa, Neisseria
GFADRNGIPV

SEQ ID NO: 30529 - protein, 7 aa, Neisseria
IRQDGTV

SEQ ID NO: 30530 - protein, 18 aa, Neisseria
GRGGIRLSGKIDTEKDIL

SEQ ID NO: 30531 - protein, 8 aa, Neisseria
SVGAEDVL

SEQ ID NO: 30532 - protein, 10 aa, Neisseria
AFKGRLDGSI

SEQ ID NO: 30533 - protein, 7 aa, Neisseria
TTASPKI

SEQ ID NO: 30534 - protein, 11 aa, Neisseria
GTGTARTDGSL

SEQ ID NO: 30535 - protein, 11 aa, Neisseria
SDPANEQRKLV

SEQ ID NO: 30536 - protein, 8 aa, Neisseria
SAGEGSLT

SEQ ID NO: 30537 - protein, 32 aa, Neisseria
LFKDRLLKLDIRSRAFDPSRIDPQFPAGDING

SEQ ID NO: 30538 - protein, 10 aa, Neisseria
ELAKEKFTGK

SEQ ID NO: 30539 - protein, 13 aa, Neisseria
IVYESRHLPRAAV

SEQ ID NO: 30540 - protein, 22 aa, Neisseria
LRLGRNIVKTDGGFGKKGDRLN

SEQ ID NO: 30541 - protein, 8 aa, Neisseria
APDLSRFG

SEQ ID NO: 30542 - protein, 26 aa, Neisseria
NVRGHLSGDLDGGIRTFETDLSGTAR

SEQ ID NO: 30543 - protein, 7 aa, Neisseria
KAADIRS

SEQ ID NO: 30544 - protein, 20 aa, Neisseria
LKGSPGTSRPMRADIKGGRL

SEQ ID NO: 30545 - protein, 5 aa, Neisseria
EGTGA

SEQ ID NO: 30546 - protein, 5 aa, Neisseria
HRIRT

SEQ ID NO: 30547 - protein, 27 aa, Neisseria
LDGKPFKLDLDASGGINRELTRWKGSI

SEQ ID NO: 30548 - protein, 7 aa, Neisseria
LQNRMTL

SEQ ID NO: 30549 - protein, 16 aa, Neisseria
SWDRKTGISAKGGARG

SEQ ID NO: 30550 - protein, 5 aa, Neisseria
LNGDW

SEQ ID NO: 30551 - protein, 5 aa, Neisseria
HNARG

SEQ ID NO: 30552 - protein, 10 aa, Neisseria
ISRQSGDAVL

SEQ ID NO: 30553 - protein, 12 aa, Neisseria
SLKTRFQNDRIG

SEQ ID NO: 30554 - protein, 12 aa, Neisseria
LDGGARFGRINA

SEQ ID NO: 30555 - protein, 7 aa, Neisseria
PLGGRIT

SEQ ID NO: 30556 - protein, 10 aa, Neisseria
IGGRVGSPSV

SEQ ID NO: 30557 - protein, 12 aa, Neisseria
VNGSSNYGKING

SEQ ID NO: 30558 - protein, 15 aa, Neisseria
VGQSRSFDTAPLGGR

SEQ ID NO: 30559 - protein, 6 aa, Neisseria
ADAEAF

SEQ ID NO: 30560 - protein, 7 aa, Neisseria
QTVKGSL

SEQ ID NO: 30561 - protein, 9 aa, Neisseria
SIADPHLGG

SEQ ID NO: 30562 - protein, 12 aa, Neisseria
INGDKLYYRNQT

SEQ ID NO: 30563 - protein, 7 aa, Neisseria
LDNGSLR

SEQ ID NO: 30564 - protein, 7 aa, Neisseria
IAGRKWV

SEQ ID NO: 30565 - protein, 13 aa, Neisseria
LKFRHEGTAELSG

SEQ ID NO: 30566 - protein, 12 aa, Neisseria
VSMENSVPDVDI

SEQ ID NO: 30567 - protein, 14 aa, Neisseria
DKYRILSRPNRRLT

SEQ ID NO: 30568 - protein, 13 aa, Neisseria
GNTRLRYSPQKGI

SEQ ID NO: 30569 - protein, 22 aa, Neisseria
IKTDQGLFGSQKSSMPSVGDDV

SEQ ID NO: 30570 - protein, 8 aa, Neisseria
EVKKEAAA

SEQ ID NO: 30571 - protein, 8 aa, Neisseria
DLNDGIRF

SEQ ID NO: 30572 - protein, 10 aa, Neisseria
QPGGNVRGVG

SEQ ID NO: 30573 - protein, 20 aa, Neisseria
RVIKGRYKAYGQDLDITKGT

SEQ ID NO: 30574 - protein, 19 aa, Neisseria
PLNDPNLNIRAERRLSPVG

SEQ ID NO: 30575 - protein, 7 aa, Neisseria
SLNSPRI

SEQ ID NO: 30576 - protein, 11 aa, Neisseria
ANEPMSEKDKL

SEQ ID NO: 30577 - protein, 11 aa, Neisseria
AGSGSSGDNAA

SEQ ID NO: 30578 - protein, 9 aa, Neisseria
GQINDRIGL

SEQ ID NO: 30579 - protein, 22 aa, Neisseria
DDLGFTSKRSRNAQTGELNPAE

SEQ ID NO: 30580 - protein, 7 aa, Neisseria
GKQLTGK

SEQ ID NO: 30581 - protein, 8 aa, Neisseria
ISSAEQSV

SEQ ID NO: 30582 - protein, 10 aa, Neisseria
IGSRSSGGEL

SEQ ID NO: 30583 - protein, 20 aa, Neisseria
RFDRLFGSDKKDSAGNGKGK

SEQ ID NO: 30584 - protein, 19 aa, Neisseria
FDGDNWSIETEGADLKISR

SEQ ID NO: 30585 - protein, 8 aa, Neisseria
ELMRRSLH

SEQ ID NO: 30586 - protein, 13 aa, Neisseria
PTPPKEERPPQGL

SEQ ID NO: 30587 - protein, 7 aa, Neisseria
DRFETGK

SEQ ID NO: 30588 - protein, 5 aa, Neisseria
KTFDK

SEQ ID NO: 30589 - protein, 16 aa, Neisseria
YRYDRKGHRLDLKAAD

SEQ ID NO: 30590 - protein, 8 aa, Neisseria
GGFEGETI

SEQ ID NO: 30591 - protein, 8 aa, Neisseria
GSLKDVRA

SEQ ID NO: 30592 - protein, 8 aa, Neisseria
ESLDKTLE

SEQ ID NO: 30593 - protein, 9 aa, Neisseria
GSLDLENTK

SEQ ID NO: 30594 - protein, 9 aa, Neisseria
GFADRNGIP

SEQ ID NO: 30595 - protein, 5 aa, Neisseria
IRQDG

SEQ ID NO: 30596 - protein, 12 aa, Neisseria
LSGKIDTEKDIL

SEQ ID NO: 30597 - protein, 6 aa, Neisseria
GAEDVL

SEQ ID NO: 30598 - protein, 7 aa, Neisseria
FKGRLDG

SEQ ID NO: 30599 - protein, 6 aa, Neisseria
TARTDG

SEQ ID NO: 30600 - protein, 11 aa, Neisseria
SDPANEQRKLV

SEQ ID NO: 30601 - protein, 6 aa, Neisseria
AGEGSL

SEQ ID NO: 30602 - protein, 23 aa, Neisseria
LFKDRLLKLDIRSRAFDPSRIDP

SEQ ID NO: 30603 - protein, 9 aa, Neisseria
ELAKEKFTG

SEQ ID NO: 30604 - protein, 9 aa, Neisseria
IVYESRHLP

SEQ ID NO: 30605 - protein, 22 aa, Neisseria
LRLGRNIVKTDGGFGKKGDRLN

SEQ ID NO: 30606 - protein, 18 aa, Neisseria
GDLDGGIRTFETDLSGTA

SEQ ID NO: 30607 - protein, 7 aa, Neisseria
KAADIRS

SEQ ID NO: 30608 - protein, 17 aa, Neisseria
GSPGTSRPMRADIKGGR

SEQ ID NO: 30609 - protein, 5 aa, Neisseria
HRIRT

SEQ ID NO: 30610 - protein, 12 aa, Neisseria
LDGKPFKLDLDA

SEQ ID NO: 30611 - protein, 12 aa, Neisseria
GGINRELTRWKG

SEQ ID NO: 30612 - protein, 15 aa, Neisseria
SWDRKTGISAKGGAR

SEQ ID NO: 30613 - protein, 5 aa, Neisseria
SRQSG

SEQ ID NO: 30614 - protein, 8 aa, Neisseria
TRFQNDRI

SEQ ID NO: 30615 - protein, 10 aa, Neisseria
GGARFGRINA

SEQ ID NO: 30616 - protein, 6 aa, Neisseria
ADAEAF

SEQ ID NO: 30617 - protein, 11 aa, Neisseria
LKFRHEGTAEL

SEQ ID NO: 30618 - protein, 8 aa, Neisseria
NSVPDVDI

SEQ ID NO: 30619 - protein, 14 aa, Neisseria
DKYRILSRPNRRLT

SEQ ID NO: 30620 - protein, 7 aa, Neisseria
TRLRYSP

SEQ ID NO: 30621 - protein, 5 aa, Neisseria
IKTDQ

SEQ ID NO: 30622 - protein, 5 aa, Neisseria
QKSSM

SEQ ID NO: 30623 - protein, 8 aa, Neisseria
EVKKEAAA

SEQ ID NO: 30624 - protein, 7 aa, Neisseria
DLNDGIR

SEQ ID NO: 30625 - protein, 18 aa, Neisseria
RVIKGRYKAYGQDLDITK

SEQ ID NO: 30626 - protein, 8 aa, Neisseria
IRAERRLS

SEQ ID NO: 30627 - protein, 9 aa, Neisseria
EPMSEKDKL

SEQ ID NO: 30628 - protein, 11 aa, Neisseria
AGSGSSGDNAA

SEQ ID NO: 30629 - protein, 7 aa, Neisseria
INDRIGL

SEQ ID NO: 30630 - protein, 17 aa, Neisseria
GFTSKRSRNAQTGELNP

SEQ ID NO: 30631 - protein, 6 aa, Neisseria
SAEQSV

SEQ ID NO: 30632 - protein, 8 aa, Neisseria
IGSRSSGG

SEQ ID NO: 30633 - protein, 15 aa, Neisseria
FGSDKKDSAGNGKGK

SEQ ID NO: 30634 - protein, 6 aa, Neisseria
EIKDMV

SEQ ID NO: 30635 - protein, 6 aa, Neisseria
PDNVKT

SEQ ID NO: 30636 - protein, 6 aa, Neisseria
VAILGD

SEQ ID NO: 30637 - protein, 18 aa, Neisseria
LAEYYRNALENWQQPVGS

SEQ ID NO: 30638 - protein, 6 aa, Neisseria
LAKLGN

SEQ ID NO: 30639 - protein, 19 aa, Neisseria
TQRYPEQTVSGLARFQPGT

SEQ ID NO: 30640 - protein, 8 aa, Neisseria
DYYNLFNK

SEQ ID NO: 30641 - protein, 5 aa, Neisseria
ISQPR

SEQ ID NO: 30642 - protein, 5 aa, Neisseria
TTQNL

SEQ ID NO: 30643 - protein, 9 aa, Neisseria
TASWKRQLL

SEQ ID NO: 30644 - protein, 6 aa, Neisseria
TLGTFL

SEQ ID NO: 30645 - protein, 5 aa, Neisseria
GASSV

SEQ ID NO: 30646 - protein, 15 aa, Neisseria
LSGAVFHDMGDAAAN

SEQ ID NO: 30647 - protein, 6 aa, Neisseria
RWFSPL

SEQ ID NO: 30648 - protein, 8 aa, Neisseria
MHDTRTMM

SEQ ID NO: 30649 - protein, 8 aa, Neisseria
ADLSENKA

SEQ ID NO: 30650 - protein, 19 aa, Neisseria
FKSKSPDTESVKLKPKFPV

SEQ ID NO: 30651 - protein, 16 aa, Neisseria
IDTQDSEIKDMVEEHL

SEQ ID NO: 30652 - protein, 12 aa, Neisseria
QQQEEVLDKEQT

SEQ ID NO: 30653 - protein, 31 aa, Neisseria; identical to SEQ ID NO: 4712

SEQ ID NO: 30654 - protein, 8 aa, Neisseria
TPGPRTKI

SEQ ID NO: 30655 - protein, 19 aa, Neisseria
ILSDGNLAEYYRNALENWQ

SEQ ID NO: 30656 - protein, 17 aa, Neisseria
VGSDFDQDSWENSKTSV

SEQ ID NO: 30657 - protein, 7 aa, Neisseria
VTRKGYP

SEQ ID NO: 30658 - protein, 16 aa, Neisseria
KLGNTRAAVNPDTATA

SEQ ID NO: 30659 - protein, 7 aa, Neisseria
DSGRPIA

SEQ ID NO: 30660 - protein, 13 aa, Neisseria
EITGTQRYPEQTV

SEQ ID NO: 30661 - protein, 9 aa, Neisseria
FQPGTPYDL

SEQ ID NO: 30662 - protein, 9 aa, Neisseria
LEQNGHYSG

SEQ ID NO: 30663 - protein, 13 aa, Neisseria
ADFDRLQGDRVPV

SEQ ID NO: 30664 - protein, 24 aa, Neisseria
SVTEVKRHKLETGIRLDSEYGLGG

SEQ ID NO: 30665 - protein, 7 aa, Neisseria
DMDKYET

SEQ ID NO: 30666 - protein, 11 aa, Neisseria
SQPRNYRGNYW

SEQ ID NO: 30667 - protein, 20 aa, Neisseria
NVSYNRSTTQNLEKRAFSGG

SEQ ID NO: 30668 - protein, 12 aa, Neisseria
VRDRAGIDARLG

SEQ ID NO: 30669 - protein, 19 aa, Neisseria
FLAEGRKIPGSDVDLGNSH

SEQ ID NO: 30670 - protein, 6 aa, Neisseria
SWKRQL

SEQ ID NO: 30671 - protein, 12 aa, Neisseria
HPENGHYLDGKI

SEQ ID NO: 30672 - protein, 6 aa, Neisseria
TSARAG

SEQ ID NO: 30673 - protein, 8 aa, Neisseria
FTPENKKL

SEQ ID NO: 30674 - protein, 10 aa, Neisseria
VARDNADVPS

SEQ ID NO: 30675 - protein, 16 aa, Neisseria
FRSGGASSVRGYELDS

SEQ ID NO: 30676 - protein, 7 aa, Neisseria
VLPERAL

SEQ ID NO: 30677 - protein, 5 aa, Neisseria
DMGDA

SEQ ID NO: 30678 - protein, 14 aa, Neisseria
ANFKRMKLKHGSGL

SEQ ID NO: 30679 - protein, 9 aa, Neisseria
YGHSDKKIR

SEQ ID NO: 30680 - protein, 8 aa, Neisseria
MHDTRTMM

SEQ ID NO: 30681 - protein, 8 aa, Neisseria
ADLSENKA

SEQ ID NO: 30682 - protein, 18 aa, Neisseria
KSKSPDTESVKLKPKFPV

SEQ ID NO: 30683 - protein, 16 aa, Neisseria
IDTQDSEIKDMVEEHL

SEQ ID NO: 30684 - protein, 11 aa, Neisseria
QQEEVLDKEQT

SEQ ID NO: 30685 - protein, 15 aa, Neisseria
LAEEAPDNVKTMLRS

SEQ ID NO: 30686 - protein, 9 aa, Neisseria
VSLTEKDGA

SEQ ID NO: 30687 - protein, 7 aa, Neisseria
PGPRTKI

SEQ ID NO: 30688 - protein, 13 aa, Neisseria
SDFDQDSWENSKT

SEQ ID NO: 30689 - protein, 7 aa, Neisseria
VTRKGYP

SEQ ID NO: 30690 - protein, 10 aa, Neisseria
RAAVNPDTAT

SEQ ID NO: 30691 - protein, 5 aa, Neisseria
QRYPE

SEQ ID NO: 30692 - protein, 13 aa, Neisseria
ADFDRLQGDRVPV

SEQ ID NO: 30693 - protein, 20 aa, Neisseria
SVTEVKRHKLETGIRLDSEY

SEQ ID NO: 30694 - protein, 7 aa, Neisseria
DMDKYET

SEQ ID NO: 30695 - protein, 12 aa, Neisseria
RSTTQNLEKRAF

SEQ ID NO: 30696 - protein, 11 aa, Neisseria
RDRAGIDARLG

SEQ ID NO: 30697 - protein, 15 aa, Neisseria
FLAEGRKIPGSDVDL

SEQ ID NO: 30698 - protein, 6 aa, Neisseria
PENKKL

SEQ ID NO: 30699 - protein, 8 aa, Neisseria
VARDNADV

SEQ ID NO: 30700 - protein, 7 aa, Neisseria
RGYELDS

SEQ ID NO: 30701 - protein, 7 aa, Neisseria
VLPERAL

SEQ ID NO: 30702 - protein, 5 aa, Neisseria
DMGDA

SEQ ID NO: 30703 - protein, 10 aa, Neisseria
ANFKRMKLKH

SEQ ID NO: 30704 - protein, 7 aa, Neisseria
HSDKKIR

SEQ ID NO: 30705 - protein, 6 aa, Neisseria
DTPSKP

SEQ ID NO: 30706 - protein, 13 aa, Neisseria
MPQNAAESANQTG

SEQ ID NO: 30707 - protein, 12 aa, Neisseria
LSDEEKIKRYKK

SEQ ID NO: 30708 - protein, 9 aa, Neisseria
KSVDGIIDS

SEQ ID NO: 30709 - protein, 7 aa, Neisseria
GFKGTWT

SEQ ID NO: 30710 - protein, 6 aa, Neisseria
VSGRFY

SEQ ID NO: 30711 - protein, 21 aa, Neisseria
CGGGGGGSPDVKSADTPSKPA

SEQ ID NO: 30712 - protein, 31 aa, Neisseria
VLPKEKKDEEAAGGAPQADTQDATAGEGSQD

SEQ ID NO: 30713 - protein, 70 aa, Neisseria
SAENTGNGGAATTDNPKNEDAGAQNDMPQNAAESANQTGNNQPAGSSDSAPASNPAPANGGSDFGRTNVG

SEQ ID NO: 30714 - protein, 6 aa, Neisseria
DGPSQN

SEQ ID NO: 30715 - protein, 45 aa, Neisseria
THCKGDSCNGDNLLDEEAPSKSEFEKLSDEEKIKRYKKDEQRENF

SEQ ID NO: 30716 - protein, 12 aa, Neisseria
VADRVKKDGTNK

SEQ ID NO: 30717 - protein, 17 aa, Neisseria
YTDKPPTRSARSRRSLP

SEQ ID NO: 30718 - protein, 8 aa, Neisseria
TLIVDGEA

SEQ ID NO: 30719 - protein, 9 aa, Neisseria
APEGNYRYL

SEQ ID NO: 30720 - protein, 10 aa, Neisseria
GAEKLPGGSY

SEQ ID NO: 30721 - protein, 10 aa, Neisseria
VQGEPAKGEM

SEQ ID NO: 30722 - protein, 16 aa, Neisseria
HMENGRPYPSGGRFAA

SEQ ID NO: 30723 - protein, 48 aa, Neisseria
VDFGSKSVDGIIDSGDDLHMGTQKFKAAIDGNGFKGTWTENGGGDVSG

SEQ ID NO: 30724 - protein, 25 aa, Neisseria
FYGPAGEEVAGKYSYRPTDAEKGGF

SEQ ID NO: 30725 - protein, 7 aa, Neisseria
AGKKDRD

SEQ ID NO: 30726 - protein, 17 aa, Neisseria
GGGSPDVKSADTPSKPA

SEQ ID NO: 30727 - protein, 13 aa, Neisseria
VLPKEKKDEEAAG

SEQ ID NO: 30728 - protein, 16 aa, Neisseria
PQADTQDATAGEGSQD

SEQ ID NO: 30729 - protein, 6 aa, Neisseria
SAENTG

SEQ ID NO: 30730 - protein, 27 aa, Neisseria
ATTDNPKNEDAGAQNDMPQNAAESANQ

SEQ ID NO: 30731 - protein, 10 aa, Neisseria
QPAGSSDSAP

SEQ ID NO: 30732 - protein, 7 aa, Neisseria
GGSDFGR

SEQ ID NO: 30733 - protein, 8 aa, Neisseria
CKGDSCNG

SEQ ID NO: 30734 - protein, 34 aa, Neisseria
NLLDEEAPSKSEFEKLSDEEKIKRYKKDEQRENF

SEQ ID NO: 30735 - protein, 11 aa, Neisseria
VADRVKKDGTN

SEQ ID NO: 30736 - protein, 15 aa, Neisseria
DKPPTRSARSRRSLP

SEQ ID NO: 30737 - protein, 7 aa, Neisseria
LIVDGEA

SEQ ID NO: 30738 - protein, 6 aa, Neisseria
GAEKLP

SEQ ID NO: 30739 - protein, 10 aa, Neisseria
VQGEPAKGEM

SEQ ID NO: 30740 - protein, 8 aa, Neisseria
ENGRPYPS

SEQ ID NO: 30741 - protein, 19 aa, Neisseria
VDFGSKSVDGIIDSGDDLH

SEQ ID NO: 30742 - protein, 8 aa, Neisseria
QKFKAAID

SEQ ID NO: 30743 - protein, 7 aa, Neisseria
GGGDVSG

SEQ ID NO: 30744 - protein, 7 aa, Neisseria
AGEEVAG

SEQ ID NO: 30745 - protein, 12 aa, Neisseria
YSYRPTDAEKGG

SEQ ID NO: 30746 - protein, 7 aa, Neisseria
AGKKDRD

SEQ ID NO: 30747 - protein, 5 aa, Neisseria
VSRVL

SEQ ID NO: 30748 - protein, 6 aa, Neisseria
IVTKCA

SEQ ID NO: 30749 - protein, 11 aa, Neisseria
RPYRTFSPLPV

SEQ ID NO: 30750 - protein, 5 aa, Neisseria
HSTLR

SEQ ID NO: 30751 - protein, 8 aa, Neisseria
TLFQAGFD

SEQ ID NO: 30752 - protein, 5 aa, Neisseria
HTGQA

SEQ ID NO: 30753 - protein, 9 aa, Neisseria
NLPERSAGS

SEQ ID NO: 30754 - protein, 11 aa, Neisseria
CAVRPYRTFSP

SEQ ID NO: 30755 - protein, 7 aa, Neisseria
LPKQPSA

SEQ ID NO: 30756 - protein, 21 aa, Neisseria
LPRPAVNRHSTLRSPDFPPRM

SEQ ID NO: 30757 - protein, 7 aa, Neisseria
IRGDCLP

SEQ ID NO: 30758 - protein, 22 aa, Neisseria
IITRNAKMPSETVQVSDGIQPK

SEQ ID NO: 30759 - protein, 6 aa, Neisseria
GFDEAV

SEQ ID NO: 30760 - protein, 7 aa, Neisseria
NLPERSA

SEQ ID NO: 30761 - protein, 5 aa, Neisseria
CAVRP

SEQ ID NO: 30762 - protein, 10 aa, Neisseria
STLRSPDFPP

SEQ ID NO: 30763 - protein, 5 aa, Neisseria
IRGDC

SEQ ID NO: 30764 - protein, 15 aa, Neisseria
IITRNAKMPSETVQV

SEQ ID NO: 30765 - protein, 6 aa, Neisseria
GFDEAV

SEQ ID NO: 30766 - protein, 11 aa, Neisseria
KILTPFTVLPL

SEQ ID NO: 30767 - protein, 5 aa, Neisseria
GKSVA

SEQ ID NO: 30768 - protein, 6 aa, Neisseria
VLSVSE

SEQ ID NO: 30769 - protein, 7 aa, Neisseria
PVKGIYE

SEQ ID NO: 30770 - protein, 6 aa, Neisseria
ERAADL

SEQ ID NO: 30771 - protein, 11 aa, Neisseria
PLDKAIKEVRG

SEQ ID NO: 30772 - protein, 16 aa, Neisseria
FCKRLEHEFEKMTDVT

SEQ ID NO: 30773 - protein, 8 aa, Neisseria
KAWTDWMR

SEQ ID NO: 30774 - protein, 6 aa, Neisseria
ICDNPV

SEQ ID NO: 30775 - protein, 5 aa, Neisseria
MKTKL

SEQ ID NO: 30776 - protein, 21 aa, Neisseria
TPVSNANAESAVKAESAGKSV

SEQ ID NO: 30777 - protein, 15 aa, Neisseria
LKARLEKTYSAQDLK

SEQ ID NO: 30778 - protein, 8 aa, Neisseria
SETPVKGI

SEQ ID NO: 30779 - protein, 8 aa, Neisseria
YTDAEGGY

SEQ ID NO: 30780 - protein, 19 aa, Neisseria
INIDTRKNLTEERAADLNK

SEQ ID NO: 30781 - protein, 17 aa, Neisseria
PLDKAIKEVRGNGKLKV

SEQ ID NO: 30782 - protein, 9 aa, Neisseria
VFSDPDCPF

SEQ ID NO: 30783 - protein, 12 aa, Neisseria
KRLEHEFEKMTD

SEQ ID NO: 30784 - protein, 8 aa, Neisseria
HPDAARKA

SEQ ID NO: 30785 - protein, 8 aa, Neisseria
CQPDRAKA

SEQ ID NO: 30786 - protein, 9 aa, Neisseria
WMRKGKFPV

SEQ ID NO: 30787 - protein, 16 aa, Neisseria
GSICDNPVAETTSLGE

SEQ ID NO: 30788 - protein, 11 aa, Neisseria
PNGRTQSGYSP

SEQ ID NO: 30789 - protein, 12 aa, Neisseria
PQLEEIIRKNQQ

SEQ ID NO: 30790 - protein, 5 aa, Neisseria
MKTKL

SEQ ID NO: 30791 - protein, 16 aa, Neisseria
ANAESAVKAESAGKSV

SEQ ID NO: 30792 - protein, 10 aa, Neisseria
LKARLEKTYS

SEQ ID NO: 30793 - protein, 19 aa, Neisseria
INIDTRKNLTEERAADLNK

SEQ ID NO: 30794 - protein, 16 aa, Neisseria
PLDKAIKEVRGNGKLK

SEQ ID NO: 30795 - protein, 7 aa, Neisseria
SDPDCPF

SEQ ID NO: 30796 - protein, 12 aa, Neisseria
KRLEHEFEKMTD

SEQ ID NO: 30797 - protein, 6 aa, Neisseria
DAARKA

SEQ ID NO: 30798 - protein, 7 aa, Neisseria
QPDRAKA

SEQ ID NO: 30799 - protein, 7 aa, Neisseria
WMRKGKF

SEQ ID NO: 30800 - protein, 5 aa, Neisseria
GRTQS

SEQ ID NO: 30801 - protein, 12 aa, Neisseria
PQLEEIIRKNQQ

SEQ ID NO: 30802 - protein, 10 aa, Neisseria
RFPAALRRYS

SEQ ID NO: 30803 - protein, 5 aa, Neisseria
KPAGT

SEQ ID NO: 30804 - protein, 19 aa, Neisseria
WHRVRRFKSNRRTRGVKPL

SEQ ID NO: 30805 - protein, 29 aa, Neisseria
AWTALSHNIAERARESPRRCGKRYADIGG

SEQ ID NO: 30806 - protein, 9 aa, Neisseria
VAHIIHLYC

SEQ ID NO: 30807 - protein, 9 aa, Neisseria
VSREARREV

SEQ ID NO: 30808 - protein, 5 aa, Neisseria
AMSYR

SEQ ID NO: 30809 - protein, 6 aa, Neisseria
FATSFG

SEQ ID NO: 30810 - protein, 8 aa, Neisseria
AFSVLAHF

SEQ ID NO: 30811 - protein, 11 aa, Neisseria
TVGWSKYIHAV

SEQ ID NO: 30812 - protein, 9 aa, Neisseria
AVRTSSNRF

SEQ ID NO: 30813 - protein, 10 aa, Neisseria
AALRRYSAFR

SEQ ID NO: 30814 - protein, 31 aa, Neisseria
PKPAGTPWHRVRRFKSNRRTRGVKPLKKPYL

SEQ ID NO: 30815 - protein, 10 aa, Neisseria
RGAECRCRRA

SEQ ID NO: 30816 - protein, 37 aa, Neisseria; identical to SEQ ID NO: 4878

SEQ ID NO: 30817 - protein, 18 aa, Neisseria
HTGRVSREARREVEKAMS

SEQ ID NO: 30818 - protein, 5 aa, Neisseria
KMARS

SEQ ID NO: 30819 - protein, 8 aa, Neisseria
AVRTSSNR

SEQ ID NO: 30820 - protein, 5 aa, Neisseria
AALRR

SEQ ID NO: 30821 - protein, 20 aa, Neisseria
HRVRRFKSNRRTRGVKPLKK

SEQ ID NO: 30822 - protein, 10 aa, Neisseria
RGAECRCRRA

SEQ ID NO: 30823 - protein, 27 aa, Neisseria
IAERARESPRRCGKRYADIGGDSDTIR

SEQ ID NO: 30824 - protein, 9 aa, Neisseria
RVFRLEHRM

SEQ ID NO: 30825 - protein, 15 aa, Neisseria
RVSREARREVEKAMS

SEQ ID NO: 30826 - protein, 5 aa, Neisseria
FRQPR

SEQ ID NO: 30827 - protein, 8 aa, Neisseria
VQRFFRQP

SEQ ID NO: 30828 - protein, 6 aa, Neisseria
AFLHQI

SEQ ID NO: 30829 - protein, 8 aa, Neisseria
VIRKIAAL

SEQ ID NO: 30830 - protein, 6 aa, Neisseria
NLRGFP

SEQ ID NO: 30831 - protein, 9 aa, Neisseria
HQQRRIGKT

SEQ ID NO: 30832 - protein, 8 aa, Neisseria
YIIKPLEH

SEQ ID NO: 30833 - protein, 9 aa, Neisseria
MARHDGQQG

SEQ ID NO: 30834 - protein, 6 aa, Neisseria
LPRRQQ

SEQ ID NO: 30835 - protein, 23 aa, Neisseria
AAAHGNRPASDAFFKLPRQRFHV

SEQ ID NO: 30836 - protein, 34 aa, Neisseria
HGCRAQFRQPRRIRLRLRQTARQRSGCGTDQAAD

SEQ ID NO: 30837 - protein, 17 aa, Neisseria
FRQPRIRQKQRHTRSPA

SEQ ID NO: 30838 - protein, 5 aa, Neisseria
GPDFG

SEQ ID NO: 30839 - protein, 7 aa, Neisseria
QNAEHRA

SEQ ID NO: 30840 - protein, 32 aa, Neisseria
RIGKQNLRGFPSRRGHLRHQQRRIGKTPPQLA

SEQ ID NO: 30841 - protein, 26 aa, Neisseria
GGTRFSDRNGVYPNRAGNGIRMRLAE

SEQ ID NO: 30842 - protein, 8 aa, Neisseria
PVCRGTSG

SEQ ID NO: 30843 - protein, 11 aa, Neisseria
PYPYRRKQPQY

SEQ ID NO: 30844 - protein, 21 aa, Neisseria
SCKTNAVRTVRTAFRQRNQIS

SEQ ID NO: 30845 - protein, 7 aa, Neisseria
ARHDGQQ

SEQ ID NO: 30846 - protein, 6 aa, Neisseria
LPRRQQ

SEQ ID NO: 30847 - protein, 10 aa, Neisseria
AAAHGNRPAS

SEQ ID NO: 30848 - protein, 29 aa, Neisseria
AQFRQPRRIRLRLRQTARQRSGCGTDQAA

SEQ ID NO: 30849 - protein, 11 aa, Neisseria
PRIRQKQRHTR

SEQ ID NO: 30850 - protein, 5 aa, Neisseria
AEHRA

SEQ ID NO: 30851 - protein, 7 aa, Neisseria
RIGKQNL

SEQ ID NO: 30852 - protein, 20 aa, Neisseria
FPSRRGHLRHQQRRIGKTPP

SEQ ID NO: 30853 - protein, 7 aa, Neisseria
RFSDRNG

SEQ ID NO: 30854 - protein, 7 aa, Neisseria
IRMRLAE

SEQ ID NO: 30855 - protein, 6 aa, Neisseria
PVCRGT

SEQ ID NO: 30856 - protein, 7 aa, Neisseria
PYRRKQP

SEQ ID NO: 30857 - protein, 13 aa, Neisseria
RTVRTAFRQRNQI

SEQ ID NO: 30858 - protein, 11 aa, Neisseria
QPGDSLADVLA

SEQ ID NO: 30859 - protein, 10 aa, Neisseria
DEIARITEKY

SEQ ID NO: 30860 - protein, 5 aa, Neisseria
LPTLR

SEQ ID NO: 30861 - protein, 6 aa, Neisseria
LKEGDA

SEQ ID NO: 30862 - protein, 8 aa, Neisseria
LVYTRISS

SEQ ID NO: 30863 - protein, 17 aa, Neisseria
HANGVETLYAHLSAFSQ

SEQ ID NO: 30864 - protein, 7 aa, Neisseria
AKHRKYA

SEQ ID NO: 30865 - protein, 19 aa, Neisseria
ASTEGTERVRPQRVEQKLP

SEQ ID NO: 30866 - protein, 6 aa, Neisseria
SWGGNG

SEQ ID NO: 30867 - protein, 9 aa, Neisseria
AVQPGDSLA

SEQ ID NO: 30868 - protein, 33 aa, Neisseria; identical to SEQ ID NO: 4930

SEQ ID NO: 30869 - protein, 8 aa, Neisseria
GGDGSARE

SEQ ID NO: 30870 - protein, 30 aa, Neisseria
TDEDGERNLVALEKKGGIWRRSASDADMKV

SEQ ID NO: 30871 - protein, 21 aa, Neisseria
TSARGSLARAEVPVEIRESLS

SEQ ID NO: 30872 - protein, 12 aa, Neisseria
FSLDGLKEGDAV

SEQ ID NO: 30873 - protein, 8 aa, Neisseria
EVVKGGTT

SEQ ID NO: 30874 - protein, 29 aa, Neisseria
YYRSDKEGGGGGNYYDEDGRVLQEKGGFN

SEQ ID NO: 30875 - protein, 8 aa, Neisseria
RISSPFGY

SEQ ID NO: 30876 - protein, 7 aa, Neisseria
HTGIDYA

SEQ ID NO: 30877 - protein, 12 aa, Neisseria
PQGTPVRASADG

SEQ ID NO: 30878 - protein, 9 aa, Neisseria
FKGRKGGYG

SEQ ID NO: 30879 - protein, 6 aa, Neisseria
HANGVE

SEQ ID NO: 30880 - protein, 9 aa, Neisseria
AQGNVRGGE

SEQ ID NO: 30881 - protein, 10 aa, Neisseria
STGRSTGPHL

SEQ ID NO: 30882 - protein, 11 aa, Neisseria
YEARINGQPVN

SEQ ID NO: 30883 - protein, 12 aa, Neisseria
PTPELTQADKAA

SEQ ID NO: 30884 - protein, 8 aa, Neisseria
QKQKADAL

SEQ ID NO: 30885 - protein, 5 aa, Neisseria
VSQSD

SEQ ID NO: 30886 - protein, 7 aa, Neisseria
AKHRKYA

SEQ ID NO: 30887 - protein, 16 aa, Neisseria
TEGTERVRPQRVEQKL

SEQ ID NO: 30888 - protein, 8 aa, Neisseria
VQPGDSLA

SEQ ID NO: 30889 - protein, 27 aa, Neisseria
GMARDEIARITEKYGGEADLRHLRADQ

SEQ ID NO: 30890 - protein, 6 aa, Neisseria
DGSARE

SEQ ID NO: 30891 - protein, 30 aa, Neisseria; identical to SEQ ID NO: 30870

SEQ ID NO: 30892 - protein, 20 aa, Neisseria
TSARGSLARAEVPVEIRESL

SEQ ID NO: 30893 - protein, 12 aa, Neisseria
FSLDGLKEGDAV

SEQ ID NO: 30894 - protein, 8 aa, Neisseria
RSDKEGGG

SEQ ID NO: 30895 - protein, 15 aa, Neisseria
YYDEDGRVLQEKGGF

SEQ ID NO: 30896 - protein, 7 aa, Neisseria
TPVRASA

SEQ ID NO: 30897 - protein, 7 aa, Neisseria
KGRKGGY

SEQ ID NO: 30898 - protein, 7 aa, Neisseria
GNVRGGE

SEQ ID NO: 30899 - protein, 6 aa, Neisseria
TGRSTG

SEQ ID NO: 30900 - protein, 5 aa, Neisseria
ARING

SEQ ID NO: 30901 - protein, 9 aa, Neisseria
ELTQADKAA

SEQ ID NO: 30902 - protein, 8 aa, Neisseria
QKQKADAL

SEQ ID NO: 30903 - protein, 13 aa, Neisseria
SLFASILMSALIA

SEQ ID NO: 30904 - protein, 7 aa, Neisseria
INAYWQQ

SEQ ID NO: 30905 - protein, 5 aa, Neisseria
PLAAY

SEQ ID NO: 30906 - protein, 8 aa, Neisseria
LSDGIKTF

SEQ ID NO: 30907 - protein, 6 aa, Neisseria
VQKSLK

SEQ ID NO: 30908 - protein, 5 aa, Neisseria
NLSKQ

SEQ ID NO: 30909 - protein, 21 aa, Neisseria
SYPSFFDWPKTIEETLKKHPE

SEQ ID NO: 30910 - protein, 5 aa, Neisseria
NDPWD

SEQ ID NO: 30911 - protein, 13 aa, Neisseria
AQEYLKRVDRILE

SEQ ID NO: 30912 - protein, 12 aa, Neisseria
MRYLDKLLSEHL

SEQ ID NO: 30913 - protein, 5 aa, Neisseria
RYTDS

SEQ ID NO: 30914 - protein, 6 aa, Neisseria
EKIMEK

SEQ ID NO: 30915 - protein, 8 aa, Neisseria
SQNPINAY

SEQ ID NO: 30916 - protein, 9 aa, Neisseria
YHRNSPLEP

SEQ ID NO: 30917 - protein, 11 aa, Neisseria
GWWRSGAALQE

SEQ ID NO: 30918 - protein, 40 aa, Neisseria
LSGETPPTAQDGGSADMPPEAAASEAAPPAGGTEWKQGTE

SEQ ID NO: 30919 - protein, 11 aa, Neisseria
AAVRSGDKVFF

SEQ ID NO: 30920 - protein, 19 aa, Neisseria
KSLKQQYGIESANLSKQST

SEQ ID NO: 30921 - protein, 16 aa, Neisseria
FDWPKTIEETLKKHPE

SEQ ID NO: 30922 - protein, 6 aa, Neisseria
GPNDPW

SEQ ID NO: 30923 - protein, 7 aa, Neisseria
PVGKRYL

SEQ ID NO: 30924 - protein, 6 aa, Neisseria
ASDEWA

SEQ ID NO: 30925 - protein, 10 aa, Neisseria
YLKRVDRILE

SEQ ID NO: 30926 - protein, 13 aa, Neisseria
KKVKLDGQMRYLD

SEQ ID NO: 30927 - protein, 8 aa, Neisseria
LLSEHLKG

SEQ ID NO: 30928 - protein, 28 aa, Neisseria
TLSGGKGRYTDSVNVNGKPVRYRSKDGI

SEQ ID NO: 30929 - protein, 7 aa, Neisseria
EGQKLLA

SEQ ID NO: 30930 - protein, 10 aa, Neisseria
PSTQPSSTQP

SEQ ID NO: 30931 - protein, 25 aa, Neisseria
ETPPTAQDGGSADMPPEAAASEAAP

SEQ ID NO: 30932 - protein, 8 aa, Neisseria
TEWKQGTE

SEQ ID NO: 30933 - protein, 7 aa, Neisseria
AAVRSGD

SEQ ID NO: 30934 - protein, 7 aa, Neisseria
NLSKQST

SEQ ID NO: 30935 - protein, 12 aa, Neisseria
KTIEETLKKHPE

SEQ ID NO: 30936 - protein, 10 aa, Neisseria
YLKRVDRILE

SEQ ID NO: 30937 - protein, 13 aa, Neisseria
KKVKLDGQMRYLD

SEQ ID NO: 30938 - protein, 8 aa, Neisseria
LLSEHLKG

SEQ ID NO: 30939 - protein, 9 aa, Neisseria
SGGKGRYTD

SEQ ID NO: 30940 - protein, 16 aa, Neisseria
VNVNGKPVRYRSKDGI

SEQ ID NO: 30941 - protein, 7 aa, Neisseria
EGQKLLA

SEQ ID NO: 30942 - protein, 9 aa, Neisseria
STQPSSTQP

SEQ ID NO: 30943 - protein, 397 aa, Neisseria
MNPKHFIAFSALFAATQAEALPVASVSPDTVTVSPSAPYTDTNGLLTDYGNAAASPWMKKLRSVAQGSGEAFRILQIGDSHTAGDFFTDALRKRLQKTWGDGGIGWVYPANVKGQRMAAVRHSGNWQSFTSRNNTGDFPLGGILAQTGSGGGMTLTASDGKTGKQRVSLFAKPLLAEQTLTVNGNTVSANGGGWQVLDTGAALPLAIQTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVLLTEVQQMQRRVARQGQTMFWSWQNAMGGICSMKNWLNQGWAAKDGVHFSAQGYRRAAEMLADSLEELVRAAAIRQ

SEQ ID NO: 30944 - protein, 18 aa, Neisseria
SGRFLRTVEWLGNMLPHP

SEQ ID NO: 30945 - protein, 34 aa, Neisseria; identical to SEQ ID NO: 18920

SEQ ID NO: 30946 - protein, 5 aa, Neisseria
SALMR

SEQ ID NO: 30947 - protein, 22 aa, Neisseria
IFHSLGRHPLAGLAAAFAGVSG

SEQ ID NO: 30948 - protein, 14 aa, Neisseria
GTIDPLLAGITQQA

SEQ ID NO: 30949 - protein, 5 aa, Neisseria
IALIG

SEQ ID NO: 30950 - protein, 6 aa, Neisseria
RHSNEI

SEQ ID NO: 30951 - protein, 7 aa, Neisseria
LSALLAW

SEQ ID NO: 30952 - protein, 7 aa, Neisseria
ILRHPET

SEQ ID NO: 30953 - protein, 10 aa, Neisseria
YGRITRSLRG

SEQ ID NO: 30954 - protein, 12 aa, Neisseria
REVVNAMAESMS

SEQ ID NO: 30955 - protein, 14 aa, Neisseria
FVAFFNWTNIGQYI

SEQ ID NO: 30956 - protein, 5 aa, Neisseria
APQVI

SEQ ID NO: 30957 - protein, 24 aa, Neisseria
AYRIGDSVTNIITPMMSYFGLIMA

SEQ ID NO: 30958 - protein, 9 aa, Neisseria
IAWIALFCI

SEQ ID NO: 30959 - protein, 18 aa, Neisseria
KEKQMSQTDARRSGRFLR

SEQ ID NO: 30960 - protein, 18 aa, Neisseria
SVPDPRPVGAKGRADDGL

SEQ ID NO: 30961 - protein, 6 aa, Neisseria
LDADGL

SEQ ID NO: 30962 - protein, 6 aa, Neisseria
IAEKSG

SEQ ID NO: 30963 - protein, 9 aa, Neisseria
LTKSPRKLT

SEQ ID NO: 30964 - protein, 7 aa, Neisseria
LSNTASE

SEQ ID NO: 30965 - protein, 6 aa, Neisseria
LGRHPL

SEQ ID NO: 30966 - protein, 33 aa, Neisseria; identical to SEQ ID NO: 5064

SEQ ID NO: 30967 - protein, 13 aa, Neisseria
PADGILRHPETGL

SEQ ID NO: 30968 - protein, 13 aa, Neisseria
RITRSLRGEREVV

SEQ ID NO: 30969 - protein, 5 aa, Neisseria
VGLGG

SEQ ID NO: 30970 - protein, 8 aa, Neisseria
KYKKDAGV

SEQ ID NO: 30971 - protein, 16 aa, Neisseria
KEKQMSQTDARRSGRF

SEQ ID NO: 30972 - protein, 16 aa, Neisseria
PDPRPVGAKGRADDGL

SEQ ID NO: 30973 - protein, 6 aa, Neisseria
LDADGL

SEQ ID NO: 30974 - protein, 6 aa, Neisseria
IAEKSG

SEQ ID NO: 30975 - protein, 6 aa, Neisseria
KSPRKL

SEQ ID NO: 30976 - protein, 13 aa, Neisseria
LSQEEKDIRHSNE

SEQ ID NO: 30977 - protein, 7 aa, Neisseria
GILRHPE

SEQ ID NO: 30978 - protein, 12 aa, Neisseria
ITRSLRGEREVV

SEQ ID NO: 30979 - protein, 7 aa, Neisseria
KYKKDAG

SEQ ID NO: 30980 - protein, 14 aa, Neisseria
LMMGLVEGFTEFLP

SEQ ID NO: 30981 - protein, 6 aa, Neisseria
FGNLIG

SEQ ID NO: 30982 - protein, 6 aa, Neisseria
FSNVLH

SEQ ID NO: 30983 - protein, 5 aa, Neisseria
AAVMG

SEQ ID NO: 30984 - protein, 11 aa, Neisseria
LFDKQIKEYLF

SEQ ID NO: 30985 - protein, 10 aa, Neisseria
DVDALRPIDA

SEQ ID NO: 30986 - protein, 6 aa, Neisseria
VAQVFA

SEQ ID NO: 30987 - protein, 14 aa, Neisseria
AYDVLKHYRFFTLH

SEQ ID NO: 30988 - protein, 9 aa, Neisseria
IGFIAAFVS

SEQ ID NO: 30989 - protein, 6 aa, Neisseria
VKALLK

SEQ ID NO: 30990 - protein, 6 aa, Neisseria
SNHKVF

SEQ ID NO: 30991 - protein, 8 aa, Neisseria
EYRQRFSN

SEQ ID NO: 30992 - protein, 9 aa, Neisseria
GVGKDRKAN

SEQ ID NO: 30993 - protein, 14 aa, Neisseria
VEKRQSRAEPKIAD

SEQ ID NO: 30994 - protein, 7 aa, Neisseria
DALRPID

SEQ ID NO: 30995 - protein, 9 aa, Neisseria
PGTSRSGST

SEQ ID NO: 30996 - protein, 7 aa, Neisseria
IERKTAT

SEQ ID NO: 30997 - protein, 7 aa, Neisseria
FVSKKNY

SEQ ID NO: 30998 - protein, 5 aa, Neisseria
YRQRF

SEQ ID NO: 30999 - protein, 8 aa, Neisseria
VGKDRKAN

SEQ ID NO: 31000 - protein, 14 aa, Neisseria
VEKRQSRAEPKIAD

SEQ ID NO: 31001 - protein, 7 aa, Neisseria
DALRPID

SEQ ID NO: 31002 - protein, 6 aa, Neisseria
TSRSGS

SEQ ID NO: 31003 - protein, 7 aa, Neisseria
IERKTAT

SEQ ID NO: 31004 - protein, 5 aa, Neisseria
VSKKN

SEQ ID NO: 31005 - protein, 9 aa, Neisseria
FYRILGVAD

SEQ ID NO: 31006 - protein, 6 aa, Neisseria
TIIAGL

SEQ ID NO: 31007 - protein, 8 aa, Neisseria
ALELLRAQ

SEQ ID NO: 31008 - protein, 8 aa, Neisseria
AEMARASE

SEQ ID NO: 31009 - protein, 14 aa, Neisseria
LADFVHPIGNIGAC

SEQ ID NO: 31010 - protein, 14 aa, Neisseria
SMRTLASVAHGFGD

SEQ ID NO: 31011 - protein, 12 aa, Neisseria
LAHLDNMKRVTE

SEQ ID NO: 31012 - protein, 7 aa, Neisseria
WERRMMV

SEQ ID NO: 31013 - protein, 8 aa, Neisseria
LRAQDVET

SEQ ID NO: 31014 - protein, 19 aa, Neisseria
SKGAEMARASETDYTKDEV

SEQ ID NO: 31015 - protein, 8 aa, Neisseria
GTFKTDGM

SEQ ID NO: 31016 - protein, 7 aa, Neisseria
GFGDNLL

SEQ ID NO: 31017 - protein, 13 aa, Neisseria
RAADVVLKERRRL

SEQ ID NO: 31018 - protein, 5 aa, Neisseria
RETPL

SEQ ID NO: 31019 - protein, 10 aa, Neisseria
DNMKRVTEMG

SEQ ID NO: 31020 - protein, 12 aa, Neisseria
MYRKPQTADDIV

SEQ ID NO: 31021 - protein, 7 aa, Neisseria
DTPDLAE

SEQ ID NO: 31022 - protein, 7 aa, Neisseria
WERRMMV

SEQ ID NO: 31023 - protein, 8 aa, Neisseria
LRAQDVET

SEQ ID NO: 31024 - protein, 18 aa, Neisseria
KGAEMARASETDYTKDEV

SEQ ID NO: 31025 - protein, 5 aa, Neisseria
FKTDG

SEQ ID NO: 31026 - protein, 13 aa, Neisseria
RAADVVLKERRRL

SEQ ID NO: 31027 - protein, 8 aa, Neisseria
DNMKRVTE

SEQ ID NO: 31028 - protein, 12 aa, Neisseria
MYRKPQTADDIV

SEQ ID NO: 31029 - protein, 22 aa, Neisseria
SHWRVLAELADGLPQHVSQLAR

SEQ ID NO: 31030 - protein, 17 aa, Neisseria
LNGFWQQMPAHIRGLLR

SEQ ID NO: 31031 - protein, 23 aa, Neisseria
HDGYWRLVRPLAVFDAEGLRDLG

SEQ ID NO: 31032 - protein, 10 aa, Neisseria
RQGRKWSHRL

SEQ ID NO: 31033 - protein, 6 aa, Neisseria
LSPVAA

SEQ ID NO: 31034 - protein, 12 aa, Neisseria
VENAASVQSLFQ

SEQ ID NO: 31035 - protein, 17 aa, Neisseria
ETLLAELGAVLEQYAEE

SEQ ID NO: 31036 - protein, 5 aa, Neisseria
PFLNE

SEQ ID NO: 31037 - protein, 5 aa, Neisseria
CEGTV

SEQ ID NO: 31038 - protein, 13 aa, Neisseria
TVGSAPYRDLSPL

SEQ ID NO: 31039 - protein, 18 aa, Neisseria
YRHPEEHGSDRWFNALGS

SEQ ID NO: 31040 - protein, 12 aa, Neisseria
AVASGMMDAVCG

SEQ ID NO: 31041 - protein, 10 aa, Neisseria
AAKVAEALPP

SEQ ID NO: 31042 - protein, 6 aa, Neisseria
HGLLNL

SEQ ID NO: 31043 - protein, 11 aa, Neisseria
LAREADMKPQQ

SEQ ID NO: 31044 - protein, 9 aa, Neisseria
GLLRQHDGY

SEQ ID NO: 31045 - protein, 14 aa, Neisseria
EGLRDLGERSGFQT

SEQ ID NO: 31046 - protein, 14 aa, Neisseria
LKHECASSNDEILE

SEQ ID NO: 31047 - protein, 9 aa, Neisseria
RIAPDKAHK

SEQ ID NO: 31048 - protein, 20 aa, Neisseria
HLQSKGRGRQGRKWSHRLGE

SEQ ID NO: 31049 - protein, 10 aa, Neisseria
FDRPQYELGS

SEQ ID NO: 31050 - protein, 7 aa, Neisseria
ACRRALG

SEQ ID NO: 31051 - protein, 7 aa, Neisseria
TQIKWPN

SEQ ID NO: 31052 - protein, 9 aa, Neisseria
LVVGRDKLG

SEQ ID NO: 31053 - protein, 9 aa, Neisseria
TVRAGGKTV

SEQ ID NO: 31054 - protein, 7 aa, Neisseria
LPKEVEN

SEQ ID NO: 31055 - protein, 9 aa, Neisseria
TASRRGNAD

SEQ ID NO: 31056 - protein, 7 aa, Neisseria
QYAEEGF

SEQ ID NO: 31057 - protein, 11 aa, Neisseria
EYETANRDHGK

SEQ ID NO: 31058 - protein, 22 aa, Neisseria
LLRDGETVCEGTVKGVDGRGVL

SEQ ID NO: 31059 - protein, 35 aa, Neisseria
ETAEGEQTVVSGEISLRPDNRSVSVPKRPDSERFL

SEQ ID NO: 31060 - protein, 8 aa, Neisseria
EGGNSRLK

SEQ ID NO: 31061 - protein, 12 aa, Neisseria
GSAPYRDLSPLG

SEQ ID NO: 31062 - protein, 11 aa, Neisseria
WAEKADGNVRI

SEQ ID NO: 31063 - protein, 18 aa, Neisseria
CGESKKAQVKEQLARKIE

SEQ ID NO: 31064 - protein, 14 aa, Neisseria
NHYRHPEEHGSDRW

SEQ ID NO: 31065 - protein, 11 aa, Neisseria
ALGSRRFSRNA

SEQ ID NO: 31066 - protein, 10 aa, Neisseria
ALTDDGHYLG

SEQ ID NO: 31067 - protein, 6 aa, Neisseria
MKESLA

SEQ ID NO: 31068 - protein, 12 aa, Neisseria
ANLNRPAGKRYP

SEQ ID NO: 31069 - protein, 13 aa, Neisseria
GRLKEKNGAGKPV

SEQ ID NO: 31070 - protein, 9 aa, Neisseria
GGGAAKVAE

SEQ ID NO: 31071 - protein, 7 aa, Neisseria
NTVRVAD

SEQ ID NO: 31072 - protein, 9 aa, Neisseria
AEGGESEHA

SEQ ID NO: 31073 - protein, 11 aa, Neisseria
LAREADMKPQQ

SEQ ID NO: 31074 - protein, 6 aa, Neisseria
GLLRQH

SEQ ID NO: 31075 - protein, 12 aa, Neisseria
EGLRDLGERSGF

SEQ ID NO: 31076 - protein, 14 aa, Neisseria
LKHECASSNDEILE

SEQ ID NO: 31077 - protein, 9 aa, Neisseria
RIAPDKAHK

SEQ ID NO: 31078 - protein, 18 aa, Neisseria
QSKGRGRQGRKWSHRLGE

SEQ ID NO: 31079 - protein, 6 aa, Neisseria
ACRRAL

SEQ ID NO: 31080 - protein, 8 aa, Neisseria
VVGRDKLG

SEQ ID NO: 31081 - protein, 7 aa, Neisseria
TVRAGGK

SEQ ID NO: 31082 - protein, 5 aa, Neisseria
KEVEN

SEQ ID NO: 31083 - protein, 8 aa, Neisseria
ASRRGNAD

SEQ ID NO: 31084 - protein, 7 aa, Neisseria
QYAEEGF

SEQ ID NO: 31085 - protein, 10 aa, Neisseria
YETANRDHGK

SEQ ID NO: 31086 - protein, 7 aa, Neisseria
RDGETVC

SEQ ID NO: 31087 - protein, 10 aa, Neisseria
GTVKGVDGRG

SEQ ID NO: 31088 - protein, 10 aa, Neisseria
ETAEGEQTVV

SEQ ID NO: 31089 - protein, 20 aa, Neisseria
ISLRPDNRSVSVPKRPDSER

SEQ ID NO: 31090 - protein, 5 aa, Neisseria
GNSRL

SEQ ID NO: 31091 - protein, 6 aa, Neisseria
PYRDLS

SEQ ID NO: 31092 - protein, 9 aa, Neisseria
WAEKADGNV

SEQ ID NO: 31093 - protein, 17 aa, Neisseria
GESKKAQVKEQLARKIE

SEQ ID NO: 31094 - protein, 11 aa, Neisseria
NHYRHPEEHGS

SEQ ID NO: 31095 - protein, 7 aa, Neisseria
GSRRFSR

SEQ ID NO: 31096 - protein, 7 aa, Neisseria
ALTDDGH

SEQ ID NO: 31097 - protein, 6 aa, Neisseria
MKESLA

SEQ ID NO: 31098 - protein, 11 aa, Neisseria
NLNRPAGKRYP

SEQ ID NO: 31099 - protein, 13 aa, Neisseria
GRLKEKNGAGKPV

SEQ ID NO: 31100 - protein, 7 aa, Neisseria
GAAKVAE

SEQ ID NO: 31101 - protein, 7 aa, Neisseria
NTVRVAD

SEQ ID NO: 31102 - protein, 8 aa, Neisseria
EGGESEHA

SEQ ID NO: 31103 - protein, 12 aa, Neisseria
GEILETVKMVAD

SEQ ID NO: 31104 - protein, 12 aa, Neisseria
QNIYNKITTVGK

SEQ ID NO: 31105 - protein, 8 aa, Neisseria
IAQIAAAT

SEQ ID NO: 31106 - protein, 11 aa, Neisseria
SVAQTLDKAAK

SEQ ID NO: 31107 - protein, 13 aa, Neisseria
GVSFIGGFSALVQ

SEQ ID NO: 31108 - protein, 9 aa, Neisseria
RSVPEAMKT

SEQ ID NO: 31109 - protein, 10 aa, Neisseria
GETIKRTAEI

SEQ ID NO: 31110 - protein, 9 aa, Neisseria
GCAKIVVFC

SEQ ID NO: 31111 - protein, 15 aa, Neisseria
SDAVSLTEVAEVVKK

SEQ ID NO: 31112 - protein, 14 aa, Neisseria
ITRVGELIGREASK

SEQ ID NO: 31113 - protein, 13 aa, Neisseria
VGDSVARILEEMG

SEQ ID NO: 31114 - protein, 5 aa, Neisseria
LNDAV

SEQ ID NO: 31115 - protein, 8 aa, Neisseria
SAVGGLSG

SEQ ID NO: 31116 - protein, 11 aa, Neisseria
LTLDKLEAMTA

SEQ ID NO: 31117 - protein, 10 aa, Neisseria
TPAHTISGII

SEQ ID NO: 31118 - protein, 12 aa, Neisseria
VGDSVEFGGLLG

SEQ ID NO: 31119 - protein, 7 aa, Neisseria
QSGEILE

SEQ ID NO: 31120 - protein, 10 aa, Neisseria
KMVADRNFDV

SEQ ID NO: 31121 - protein, 7 aa, Neisseria
ISTDIDV

SEQ ID NO: 31122 - protein, 8 aa, Neisseria
TVGKDLVA

SEQ ID NO: 31123 - protein, 5 aa, Neisseria
LSAKY

SEQ ID NO: 31124 - protein, 7 aa, Neisseria
TKADSYV

SEQ ID NO: 31125 - protein, 7 aa, Neisseria
TLDKAAK

SEQ ID NO: 31126 - protein, 11 aa, Neisseria
QKGMSPSDEVL

SEQ ID NO: 31127 - protein, 10 aa, Neisseria
SVPEAMKTTD

SEQ ID NO: 31128 - protein, 5 aa, Neisseria
GSTRA

SEQ ID NO: 31129 - protein, 22 aa, Neisseria
DAVKLAGETIKRTAEITPEGFG

SEQ ID NO: 31130 - protein, 7 aa, Neisseria
AVEDNPF

SEQ ID NO: 31131 - protein, 8 aa, Neisseria
HGSGEADA

SEQ ID NO: 31132 - protein, 8 aa, Neisseria
AALENSDA

SEQ ID NO: 31133 - protein, 7 aa, Neisseria
EVAEVVK

SEQ ID NO: 31134 - protein, 12 aa, Neisseria
RVGELIGREASK

SEQ ID NO: 31135 - protein, 11 aa, Neisseria
AVGDSVARILE

SEQ ID NO: 31136 - protein, 8 aa, Neisseria
DAVKKGGM

SEQ ID NO: 31137 - protein, 7 aa, Neisseria
VSEDEGM

SEQ ID NO: 31138 - protein, 5 aa, Neisseria
DKLEA

SEQ ID NO: 31139 - protein, 7 aa, Neisseria
VPGDTPA

SEQ ID NO: 31140 - protein, 6 aa, Neisseria
IADEAA

SEQ ID NO: 31141 - protein, 7 aa, Neisseria
INSKTTA

SEQ ID NO: 31142 - protein, 10 aa, Neisseria
TGKTVGDSVE

SEQ ID NO: 31143 - protein, 7 aa, Neisseria
PAKEGSC

SEQ ID NO: 31144 - protein, 8 aa, Neisseria
FVNRGGRI

SEQ ID NO: 31145 - protein, 5 aa, Neisseria
QSMKN

SEQ ID NO: 31146 - protein, 10 aa, Neisseria
KMVADRNFDV

SEQ ID NO: 31147 - protein, 7 aa, Neisseria
ISTDIDV

SEQ ID NO: 31148 - protein, 8 aa, Neisseria
TVGKDLVA

SEQ ID NO: 31149 - protein, 5 aa, Neisseria
TKADS

SEQ ID NO: 31150 - protein, 7 aa, Neisseria
TLDKAAK

SEQ ID NO: 31151 - protein, 9 aa, Neisseria
GMSPSDEVL

SEQ ID NO: 31152 - protein, 10 aa, Neisseria
SVPEAMKTTD

SEQ ID NO: 31153 - protein, 18 aa, Neisseria
DAVKLAGETIKRTAEITP

SEQ ID NO: 31154 - protein, 6 aa, Neisseria
AVEDNP

SEQ ID NO: 31155 - protein, 5 aa, Neisseria
GEADA

SEQ ID NO: 31156 - protein, 8 aa, Neisseria
AALENSDA

SEQ ID NO: 31157 - protein, 7 aa, Neisseria
EVAEVVK

SEQ ID NO: 31158 - protein, 12 aa, Neisseria
RVGELIGREASK

SEQ ID NO: 31159 - protein, 7 aa, Neisseria
SVARILE

SEQ ID NO: 31160 - protein, 8 aa, Neisseria
DAVKKGGM

SEQ ID NO: 31161 - protein, 7 aa, Neisseria
VSEDEGM

SEQ ID NO: 31162 - protein, 5 aa, Neisseria
DKLEA

SEQ ID NO: 31163 - protein, 6 aa, Neisseria
IADEAA

SEQ ID NO: 31164 - protein, 7 aa, Neisseria
TVGDSVE

SEQ ID NO: 31165 - protein, 7 aa, Neisseria
PAKEGSC

SEQ ID NO: 31166 - protein, 5 aa, Neisseria
RGGRI

SEQ ID NO: 31167 - protein, 5 aa, Neisseria
QSMKN

SEQ ID NO: 31168 - protein, 11 aa, Neisseria
GMDDPRTYGSG

SEQ ID NO: 31169 - protein, 5 aa, Neisseria
ATNVL

SEQ ID NO: 31170 - protein, 5 aa, Neisseria
DAAKG

SEQ ID NO: 31171 - protein, 12 aa, Neisseria
VAVLLARVLQEP

SEQ ID NO: 31172 - protein, 12 aa, Neisseria
VALAALVGHMWP

SEQ ID NO: 31173 - protein, 7 aa, Neisseria
SLAALVA

SEQ ID NO: 31174 - protein, 16 aa, Neisseria
YGMDDPRTYGSGNPGA

SEQ ID NO: 31175 - protein, 8 aa, Neisseria
RSGKKKAA

SEQ ID NO: 31176 - protein, 12 aa, Neisseria
VLQEPLGLSDSA

SEQ ID NO: 31177 - protein, 7 aa, Neisseria
FKGGKGV

SEQ ID NO: 31178 - protein, 5 aa, Neisseria
RHKSN

SEQ ID NO: 31179 - protein, 12 aa, Neisseria
IKGKESKIGEKR

SEQ ID NO: 31180 - protein, 10 aa, Neisseria
YGMDDPRTYG

SEQ ID NO: 31181 - protein, 8 aa, Neisseria
RSGKKKAA

SEQ ID NO: 31182 - protein, 6 aa, Neisseria
KGGKGV

SEQ ID NO: 31183 - protein, 12 aa, Neisseria
IKGKESKIGEKR

SEQ ID NO: 31184 - protein, 7 aa, Neisseria
VKPYNAL

SEQ ID NO: 31185 - protein, 13 aa, Neisseria
CYNCHSQMIRPFR

SEQ ID NO: 31186 - protein, 12 aa, Neisseria
VGGRYSDEWHRI

SEQ ID NO: 31187 - protein, 9 aa, Neisseria
MKALRKVGT

SEQ ID NO: 31188 - protein, 8 aa, Neisseria
IAKAPEAL

SEQ ID NO: 31189 - protein, 7 aa, Neisseria
QLAEEKI

SEQ ID NO: 31190 - protein, 13 aa, Neisseria
AATQPAPGVKPYN

SEQ ID NO: 31191 - protein, 15 aa, Neisseria
AGRDIYIREGCYNCH

SEQ ID NO: 31192 - protein, 12 aa, Neisseria
RPFRAETERYGH

SEQ ID NO: 31193 - protein, 5 aa, Neisseria
GESVY

SEQ ID NO: 31194 - protein, 24 aa, Neisseria
FQWGSKRTGPDLARVGGRYSDEWH

SEQ ID NO: 31195 - protein, 14 aa, Neisseria
LLNPRDVVPESNMP

SEQ ID NO: 31196 - protein, 7 aa, Neisseria
NKVDVDA

SEQ ID NO: 31197 - protein, 20 aa, Neisseria
KALRKVGTPYSDEEIAKAPE

SEQ ID NO: 31198 - protein, 9 aa, Neisseria
LANKSELDA

SEQ ID NO: 31199 - protein, 7 aa, Neisseria
QLAEEKI

SEQ ID NO: 31200 - protein, 9 aa, Neisseria
FRAETERYG

SEQ ID NO: 31201 - protein, 21 aa, Neisseria
GSKRTGPDLARVGGRYSDEWH

SEQ ID NO: 31202 - protein, 7 aa, Neisseria
NPRDVVP

SEQ ID NO: 31203 - protein, 7 aa, Neisseria
NKVDVDA

SEQ ID NO: 31204 - protein, 7 aa, Neisseria
KALRKVG

SEQ ID NO: 31205 - protein, 11 aa, Neisseria
YSDEEIAKAPE

SEQ ID NO: 31206 - protein, 9 aa, Neisseria
LANKSELDA

SEQ ID NO: 31207 - protein, 9 aa, Neisseria
INMLSFLTG

SEQ ID NO: 31208 - protein, 6 aa, Neisseria
QAFSFI

SEQ ID NO: 31209 - protein, 6 aa, Neisseria
AGIADF

SEQ ID NO: 31210 - protein, 8 aa, Neisseria
TGFSGFVH

SEQ ID NO: 31211 - protein, 6 aa, Neisseria
AVVRGL

SEQ ID NO: 31212 - protein, 5 aa, Neisseria
KSGRQ

SEQ ID NO: 31213 - protein, 6 aa, Neisseria
FANVAG

SEQ ID NO: 31214 - protein, 10 aa, Neisseria
VFQNIAGRPD

SEQ ID NO: 31215 - protein, 10 aa, Neisseria
DIFNSVNGIE

SEQ ID NO: 31216 - protein, 5 aa, Neisseria
KSGIR

SEQ ID NO: 31217 - protein, 13 aa, Neisseria
SWARVLSAIPEMQ

SEQ ID NO: 31218 - protein, 8 aa, Neisseria
RKWLRRHP

SEQ ID NO: 31219 - protein, 11 aa, Neisseria
AEFLKQVQSHL

SEQ ID NO: 31220 - protein, 14 aa, Neisseria
HSPHAFATAVHSIP

SEQ ID NO: 31221 - protein, 6 aa, Neisseria
QRLSRL

SEQ ID NO: 31222 - protein, 5 aa, Neisseria
AAQKV

SEQ ID NO: 31223 - protein, 7 aa, Neisseria
SRMLIRM

SEQ ID NO: 31224 - protein, 8 aa, Neisseria
VNTKPNTS

SEQ ID NO: 31225 - protein, 9 aa, Neisseria
RICRSRFVD

SEQ ID NO: 31226 - protein, 13 aa, Neisseria
VGTDGNKSGRQVS

SEQ ID NO: 31227 - protein, 13 aa, Neisseria
AGRPDRLIENKHG

SEQ ID NO: 31228 - protein, 9 aa, Neisseria
YHRDGDKVV

SEQ ID NO: 31229 - protein, 8 aa, Neisseria
NSVNGIER

SEQ ID NO: 31230 - protein, 8 aa, Neisseria
SLKSGIRR

SEQ ID NO: 31231 - protein, 6 aa, Neisseria
IADEPQ

SEQ ID NO: 31232 - protein, 26 aa, Neisseria
LQDKRVEIVLDDGRKWLRRHPDEKFD

SEQ ID NO: 31233 - protein, 6 aa, Neisseria
HLTPDG

SEQ ID NO: 31234 - protein, 12 aa, Neisseria
FPNKELLKQRLS

SEQ ID NO: 31235 - protein, 14 aa, Neisseria
WPESGRHVFDSSTV

SEQ ID NO: 31236 - protein, 7 aa, Neisseria
MTEPSAG

SEQ ID NO: 31237 - protein, 7 aa, Neisseria
VITDDNM

SEQ ID NO: 31238 - protein, 9 aa, Neisseria
VEYKYGRGI

SEQ ID NO: 31239 - protein, 6 aa, Neisseria
VNTKPN

SEQ ID NO: 31240 - protein, 11 aa, Neisseria
GTDGNKSGRQV

SEQ ID NO: 31241 - protein, 12 aa, Neisseria
AGRPDRLIENKH

SEQ ID NO: 31242 - protein, 8 aa, Neisseria
HRDGDKVV

SEQ ID NO: 31243 - protein, 6 aa, Neisseria
LKSGIR

SEQ ID NO: 31244 - protein, 6 aa, Neisseria
IADEPQ

SEQ ID NO: 31245 - protein, 26 aa, Neisseria
LQDKRVEIVLDDGRKWLRRHPDEKFD

SEQ ID NO: 31246 - protein, 11 aa, Neisseria
PNKELLKQRLS

SEQ ID NO: 31247 - protein, 7 aa, Neisseria
ESGRHVF

SEQ ID NO: 31248 - protein, 7 aa, Neisseria
MTEPSAG

SEQ ID NO: 31249 - protein, 7 aa, Neisseria
VITDDNM

SEQ ID NO: 31250 - protein, 17 aa, Neisseria
VEVLQELFRQYRVARQL

SEQ ID NO: 31251 - protein, 18 aa, Neisseria
VFAAFQAVFFQCLNHCFG

SEQ ID NO: 31252 - protein, 5 aa, Neisseria
NAFQG

SEQ ID NO: 31253 - protein, 15 aa, Neisseria
VFEALGNITRRTTEA

SEQ ID NO: 31254 - protein, 21 aa, Neisseria
DGFTRINRCGKRCHAFGDFID

SEQ ID NO: 31255 - protein, 6 aa, Neisseria
AFAGQI

SEQ ID NO: 31256 - protein, 18 aa, Neisseria
YGNFLTVFQEFGRIAAAD

SEQ ID NO: 31257 - protein, 8 aa, Neisseria
GNQYVAGF

SEQ ID NO: 31258 - protein, 10 aa, Neisseria
GENHFDVFRT

SEQ ID NO: 31259 - protein, 24 aa, Neisseria
FERGFEHIKFVRVDRALYDVFAQT

SEQ ID NO: 31260 - protein, 7 aa, Neisseria
LTADTDI

SEQ ID NO: 31261 - protein, 12 aa, Neisseria
GGDGKMQHHFDG

SEQ ID NO: 31262 - protein, 6 aa, Neisseria
VEAEGQ

SEQ ID NO: 31263 - protein, 10 aa, Neisseria
VRADGEAVEV

SEQ ID NO: 31264 - protein, 14 aa, Neisseria
QSADERNHDFDVGQ

SEQ ID NO: 31265 - protein, 11 aa, Neisseria
NITRRTTEAQH

SEQ ID NO: 31266 - protein, 19 aa, Neisseria
GHTDDGFTRINRCGKRCHA

SEQ ID NO: 31267 - protein, 18 aa, Neisseria
IDVEVDRGCVTGDAADNF

SEQ ID NO: 31268 - protein, 22 aa, Neisseria
QQGFRVDADLAVDDKFHTRQAD

SEQ ID NO: 31269 - protein, 9 aa, Neisseria
IGEAECEFG

SEQ ID NO: 31270 - protein, 8 aa, Neisseria
VHHDFDGC

SEQ ID NO: 31271 - protein, 5 aa, Neisseria
QGDIG

SEQ ID NO: 31272 - protein, 6 aa, Neisseria
GIDKAG

SEQ ID NO: 31273 - protein, 19 aa, Neisseria
AAADDGRNTQFARDDGGVA

SEQ ID NO: 31274 - protein, 8 aa, Neisseria
VGHDGGST

SEQ ID NO: 31275 - protein, 5 aa, Neisseria
LTDGT

SEQ ID NO: 31276 - protein, 5 aa, Neisseria
FAQDG

SEQ ID NO: 31277 - protein, 5 aa, Neisseria
FDGFG

SEQ ID NO: 31278 - protein, 5 aa, Neisseria
FDIHR

SEQ ID NO: 31279 - protein, 5 aa, Neisseria
DGQRV

SEQ ID NO: 31280 - protein, 5 aa, Neisseria
FDVGY

SEQ ID NO: 31281 - protein, 8 aa, Neisseria
HGLAQDGG

SEQ ID NO: 31282 - protein, 7 aa, Neisseria
VRVDRAL

SEQ ID NO: 31283 - protein, 11 aa, Neisseria
TVRGGNKDDLV

SEQ ID NO: 31284 - protein, 7 aa, Neisseria
VEGEHHT

SEQ ID NO: 31285 - protein, 5 aa, Neisseria
LTADT

SEQ ID NO: 31286 - protein, 6 aa, Neisseria
GGDGKM

SEQ ID NO: 31287 - protein, 6 aa, Neisseria
VEAEGQ

SEQ ID NO: 31288 - protein, 10 aa, Neisseria
VRADGEAVEV

SEQ ID NO: 31289 - protein, 12 aa, Neisseria
QSADERNHDFDV

SEQ ID NO: 31290 - protein, 10 aa, Neisseria
ITRRTTEAQH

SEQ ID NO: 31291 - protein, 19 aa, Neisseria
GHTDDGFTRINRCGKRCHA

SEQ ID NO: 31292 - protein, 10 aa, Neisseria
IDVEVDRGCV

SEQ ID NO: 31293 - protein, 6 aa, Neisseria
DAADNF

SEQ ID NO: 31294 - protein, 19 aa, Neisseria
FRVDADLAVDDKFHTRQAD

SEQ ID NO: 31295 - protein, 9 aa, Neisseria
IGEAECEFG

SEQ ID NO: 31296 - protein, 5 aa, Neisseria
VHHDF

SEQ ID NO: 31297 - protein, 6 aa, Neisseria
GIDKAG

SEQ ID NO: 31298 - protein, 18 aa, Neisseria
AAADDGRNTQFARDDGGV

SEQ ID NO: 31299 - protein, 5 aa, Neisseria
VGHDG

SEQ ID NO: 31300 - protein, 7 aa, Neisseria
VRVDRAL

SEQ ID NO: 31301 - protein, 10 aa, Neisseria
VRGGNKDDLV

SEQ ID NO: 31302 - protein, 7 aa, Neisseria
VEGEHHT

SEQ ID NO: 31303 - protein, 9 aa, Neisseria
NLFQFLAVC

SEQ ID NO: 31304 - protein, 22 aa, Neisseria
GAVDALKQFNNDADGISGSFTQ

SEQ ID NO: 31305 - protein, 8 aa, Neisseria
QVTKSSQD

SEQ ID NO: 31306 - protein, 5 aa, Neisseria
GIDYV

SEQ ID NO: 31307 - protein, 13 aa, Neisseria
KQFNNDADGISGS

SEQ ID NO: 31308 - protein, 14 aa, Neisseria
TVQSKKKTQTAHGT

SEQ ID NO: 31309 - protein, 15 aa, Neisseria
QVTKSSQDQAIGGSP

SEQ ID NO: 31310 - protein, 21 aa, Neisseria
LSNKTALESSYTLKEDGSSNG

SEQ ID NO: 31311 - protein, 10 aa, Neisseria
RATPKRNNAG

SEQ ID NO: 31312 - protein, 5 aa, Neisseria
FKGGN

SEQ ID NO: 31313 - protein, 10 aa, Neisseria
QLKDSFGNQT

SEQ ID NO: 31314 - protein, 11 aa, Neisseria
NTNPQLSRGAF

SEQ ID NO: 31315 - protein, 9 aa, Neisseria
FTPPKGVDV

SEQ ID NO: 31316 - protein, 8 aa, Neisseria
FNNDADGI

SEQ ID NO: 31317 - protein, 9 aa, Neisseria
VQSKKKTQT

SEQ ID NO: 31318 - protein, 9 aa, Neisseria
TKSSQDQAI

SEQ ID NO: 31319 - protein, 10 aa, Neisseria
YTLKEDGSSN

SEQ ID NO: 31320 - protein, 9 aa, Neisseria
RATPKRNNA

SEQ ID NO: 31321 - protein, 7 aa, Neisseria
QLKDSFG

SEQ ID NO: 31322 - protein, 5 aa, Neisseria
YREAK

SEQ ID NO: 31323 - protein, 16 aa, Neisseria
TSSTSNFARAAEMRSF

SEQ ID NO: 31324 - protein, 8 aa, Neisseria
SLYREAKT

SEQ ID NO: 31325 - protein, 25 aa, Neisseria
PANDASGRSSAVAEERTATEMSAPS

SEQ ID NO: 31326 - protein, 11 aa, Neisseria
SASSCSGKGVS

SEQ ID NO: 31327 - protein, 15 aa, Neisseria
LPTRASSETSSTSNF

SEQ ID NO: 31328 - protein, 17 aa, Neisseria
RAAEMRSFRPLCARNAR

SEQ ID NO: 31329 - protein, 8 aa, Neisseria
SLYREAKT

SEQ ID NO: 31330 - protein, 20 aa, Neisseria
DASGRSSAVAEERTATEMSA

SEQ ID NO: 31331 - protein, 7 aa, Neisseria
CSGKGVS

SEQ ID NO: 31332 - protein, 9 aa, Neisseria
TRASSETSS

SEQ ID NO: 31333 - protein, 9 aa, Neisseria
RAAEMRSFR

SEQ ID NO: 31334 - protein, 16 aa, Neisseria
LTALLKCLSLLSLSCL

SEQ ID NO: 31335 - protein, 5 aa, Neisseria
TLGNR

SEQ ID NO: 31336 - protein, 28 aa, Neisseria
PAFFKKPEDIETMFKAVHGWEHVQQALD

SEQ ID NO: 31337 - protein, 18 aa, Neisseria
AMYKPPKIKAIDKIMQAG

SEQ ID NO: 31338 - protein, 12 aa, Neisseria
IQGVKQIIKALR

SEQ ID NO: 31339 - protein, 10 aa, Neisseria
GVWADFFGKP

SEQ ID NO: 31340 - protein, 5 aa, Neisseria
GNRLG

SEQ ID NO: 31341 - protein, 8 aa, Neisseria
LKEDRARI

SEQ ID NO: 31342 - protein, 10 aa, Neisseria
AGLNPDTQTV

SEQ ID NO: 31343 - protein, 7 aa, Neisseria
ETAKCGL

SEQ ID NO: 31344 - protein, 9 aa, Neisseria
FKKPEDIET

SEQ ID NO: 31345 - protein, 8 aa, Neisseria
ALDKGEGL

SEQ ID NO: 31346 - protein, 9 aa, Neisseria
YDLGGRYIS

SEQ ID NO: 31347 - protein, 13 aa, Neisseria
KPPKIKAIDKIMQ

SEQ ID NO: 31348 - protein, 13 aa, Neisseria
GRVRGKGKTAPTG

SEQ ID NO: 31349 - protein, 8 aa, Neisseria
QGVKQIIK

SEQ ID NO: 31350 - protein, 5 aa, Neisseria
LRAGE

SEQ ID NO: 31351 - protein, 12 aa, Neisseria
DHVPSPQEGGGV

SEQ ID NO: 31352 - protein, 9 aa, Neisseria
CERLPDGQG

SEQ ID NO: 31353 - protein, 12 aa, Neisseria
VQGELNGNKAHD

SEQ ID NO: 31354 - protein, 7 aa, Neisseria
NRNTEYW

SEQ ID NO: 31355 - protein, 6 aa, Neisseria
NRYKTP

SEQ ID NO: 31356 - protein, 8 aa, Neisseria
LKEDRARI

SEQ ID NO: 31357 - protein, 8 aa, Neisseria
GLNPDTQT

SEQ ID NO: 31358 - protein, 7 aa, Neisseria
ETAKCGL

SEQ ID NO: 31359 - protein, 9 aa, Neisseria
FKKPEDIET

SEQ ID NO: 31360 - protein, 6 aa, Neisseria
ALDKGE

SEQ ID NO: 31361 - protein, 13 aa, Neisseria
KPPKIKAIDKIMQ

SEQ ID NO: 31362 - protein, 10 aa, Neisseria
GRVRGKGKTA

SEQ ID NO: 31363 - protein, 5 aa, Neisseria
LRAGE

SEQ ID NO: 31364 - protein, 7 aa, Neisseria
VPSPQEG

SEQ ID NO: 31365 - protein, 12 aa, Neisseria
VQGELNGNKAHD

SEQ ID NO: 31366 - protein, 13 aa, Neisseria
EVGRIAHGCGGVV

SEQ ID NO: 31367 - protein, 13 aa, Neisseria
RVVHQVEQGARLA

SEQ ID NO: 31368 - protein, 5 aa, Neisseria
FQRRF

SEQ ID NO: 31369 - protein, 8 aa, Neisseria
ATRTIDGD

SEQ ID NO: 31370 - protein, 6 aa, Neisseria
EQTGLQ

SEQ ID NO: 31371 - protein, 7 aa, Neisseria
GNEVARC

SEQ ID NO: 31372 - protein, 9 aa, Neisseria
QVKRMIRHF

SEQ ID NO: 31373 - protein, 17 aa, Neisseria
VHRPFRELAALDGFVQV

SEQ ID NO: 31374 - protein, 17 aa, Neisseria
GDDFCSFFVGQVFNPLL

SEQ ID NO: 31375 - protein, 8 aa, Neisseria
KTFARFVP

SEQ ID NO: 31376 - protein, 6 aa, Neisseria
NLVQGF

SEQ ID NO: 31377 - protein, 14 aa, Neisseria
FVQVGEFARVAQEE

SEQ ID NO: 31378 - protein, 14 aa, Neisseria
GFFADFAENFGAGV

SEQ ID NO: 31379 - protein, 11 aa, Neisseria
FGDDFAHEVGE

SEQ ID NO: 31380 - protein, 10 aa, Neisseria
CSFSQVGQMG

SEQ ID NO: 31381 - protein, 5 aa, Neisseria
HGCGG

SEQ ID NO: 31382 - protein, 7 aa, Neisseria
EQGARLA

SEQ ID NO: 31383 - protein, 10 aa, Neisseria
VDFQRRFGEV

SEQ ID NO: 31384 - protein, 12 aa, Neisseria
RATRTIDGDLAE

SEQ ID NO: 31385 - protein, 16 aa, Neisseria
IRARADTGNEVARCEG

SEQ ID NO: 31386 - protein, 10 aa, Neisseria
PNFGQVKRMI

SEQ ID NO: 31387 - protein, 11 aa, Neisseria
HDLDVHRPFRE

SEQ ID NO: 31388 - protein, 6 aa, Neisseria
GDDFCS

SEQ ID NO: 31389 - protein, 8 aa, Neisseria
MEFHPKTF

SEQ ID NO: 31390 - protein, 7 aa, Neisseria
VGMRTEA

SEQ ID NO: 31391 - protein, 6 aa, Neisseria
HHDGNL

SEQ ID NO: 31392 - protein, 10 aa, Neisseria
FGQQRPEVPV

SEQ ID NO: 31393 - protein, 13 aa, Neisseria
ARVAQEEHGRVVA

SEQ ID NO: 31394 - protein, 8 aa, Neisseria
FQRKTADV

SEQ ID NO: 31395 - protein, 8 aa, Neisseria
CHGGETGE

SEQ ID NO: 31396 - protein, 11 aa, Neisseria
CYGKRTERART

SEQ ID NO: 31397 - protein, 9 aa, Neisseria
FGDDFAHEV

SEQ ID NO: 31398 - protein, 10 aa, Neisseria
QQGAARAGGQ

SEQ ID NO: 31399 - protein, 8 aa, Neisseria
GGSHRSCS

SEQ ID NO: 31400 - protein, 29 aa, Neisseria
GQMGGKRLTVRFGGKRIRNRFLDCNKFLE

SEQ ID NO: 31401 - protein, 7 aa, Neisseria
KTMDAII

SEQ ID NO: 31402 - protein, 5 aa, Neisseria
QDFRY

SEQ ID NO: 31403 - protein, 7 aa, Neisseria
EQGARLA

SEQ ID NO: 31404 - protein, 9 aa, Neisseria
VDFQRRFGE

SEQ ID NO: 31405 - protein, 12 aa, Neisseria
RATRTIDGDLAE

SEQ ID NO: 31406 - protein, 16 aa, Neisseria
IRARADTGNEVARCEG

SEQ ID NO: 31407 - protein, 6 aa, Neisseria
QVKRMI

SEQ ID NO: 31408 - protein, 5 aa, Neisseria
HDLDV

SEQ ID NO: 31409 - protein, 5 aa, Neisseria
RPFRE

SEQ ID NO: 31410 - protein, 5 aa, Neisseria
MEFHP

SEQ ID NO: 31411 - protein, 7 aa, Neisseria
VGMRTEA

SEQ ID NO: 31412 - protein, 7 aa, Neisseria
GQQRPEV

SEQ ID NO: 31413 - protein, 13 aa, Neisseria
ARVAQEEHGRVVA

SEQ ID NO: 31414 - protein, 8 aa, Neisseria
FQRKTADV

SEQ ID NO: 31415 - protein, 6 aa, Neisseria
GGETGE

SEQ ID NO: 31416 - protein, 9 aa, Neisseria
GKRTERART

SEQ ID NO: 31417 - protein, 5 aa, Neisseria
FAHEV

SEQ ID NO: 31418 - protein, 8 aa, Neisseria
QGAARAGG

SEQ ID NO: 31419 - protein, 7 aa, Neisseria
MGGKRLT

SEQ ID NO: 31420 - protein, 12 aa, Neisseria
FGGKRIRNRFLD

SEQ ID NO: 31421 - protein, 7 aa, Neisseria
KTMDAII

SEQ ID NO: 31422 - protein, 5 aa, Neisseria
QDFRY

SEQ ID NO: 31423 - protein, 16 aa, Neisseria
TEWLHGWVGAINDPMW

SEQ ID NO: 31424 - protein, 6 aa, Neisseria
GRSIKE

SEQ ID NO: 31425 - protein, 13 aa, Neisseria
GITPFQAFVTGLA

SEQ ID NO: 31426 - protein, 11 aa, Neisseria
SSLAQLFKVRD

SEQ ID NO: 31427 - protein, 9 aa, Neisseria
GLGQKWLGV

SEQ ID NO: 31428 - protein, 5 aa, Neisseria
IADTV

SEQ ID NO: 31429 - protein, 10 aa, Neisseria
GGIRRISKAA

SEQ ID NO: 31430 - protein, 7 aa, Neisseria
VFGQIFS

SEQ ID NO: 31431 - protein, 8 aa, Neisseria
GGLLGGLI

SEQ ID NO: 31432 - protein, 8 aa, Neisseria
APNAAAAA

SEQ ID NO: 31433 - protein, 12 aa, Neisseria
QGMIQMLGVFVD

SEQ ID NO: 31434 - protein, 5 aa, Neisseria
PYGDL

SEQ ID NO: 31435 - protein, 7 aa, Neisseria
VSQVGQW

SEQ ID NO: 31436 - protein, 6 aa, Neisseria
TAVFRM

SEQ ID NO: 31437 - protein, 6 aa, Neisseria
YFGAVA

SEQ ID NO: 31438 - protein, 14 aa, Neisseria
IMAWINLVAILLLS

SEQ ID NO: 31439 - protein, 5 aa, Neisseria
MNENF

SEQ ID NO: 31440 - protein, 19 aa, Neisseria
GRSIKEMLGGRKQGDDPHG

SEQ ID NO: 31441 - protein, 15 aa, Neisseria
KVRDCDNHHFRGGPA

SEQ ID NO: 31442 - protein, 8 aa, Neisseria
RRISKAAE

SEQ ID NO: 31443 - protein, 19 aa, Neisseria
GIKRGLYSNEAGMGSAPNA

SEQ ID NO: 31444 - protein, 8 aa, Neisseria
AEVKHPVS

SEQ ID NO: 31445 - protein, 8 aa, Neisseria
QPYGDLSG

SEQ ID NO: 31446 - protein, 7 aa, Neisseria
AYAESNV

SEQ ID NO: 31447 - protein, 32 aa, Neisseria; identical to SEQ ID NO: 5466

SEQ ID NO: 31448 - protein, 19 aa, Neisseria
GRSIKEMLGGRKQGDDPHG

SEQ ID NO: 31449 - protein, 9 aa, Neisseria
KVRDCDNHH

SEQ ID NO: 31450 - protein, 8 aa, Neisseria
RRISKAAE

SEQ ID NO: 31451 - protein, 7 aa, Neisseria
GIKRGLY

SEQ ID NO: 31452 - protein, 7 aa, Neisseria
AEVKHPV

SEQ ID NO: 31453 - protein, 13 aa, Neisseria
LKMGKDPEFKLSE

SEQ ID NO: 31454 - protein, 9 aa, Neisseria
PGLKRRIKS

SEQ ID NO: 31455 - protein, 15 aa, Neisseria
RAAGVARGLHSEFAR

SEQ ID NO: 31456 - protein, 19 aa, Neisseria
DVRFFAQVEEIGQDFFADA

SEQ ID NO: 31457 - protein, 12 aa, Neisseria
AGECADEVSDQP

SEQ ID NO: 31458 - protein, 16 aa, Neisseria
ESAQSAAGGGLTDGFG

SEQ ID NO: 31459 - protein, 7 aa, Neisseria
CGKTVGV

SEQ ID NO: 31460 - protein, 5 aa, Neisseria
LHRRA

SEQ ID NO: 31461 - protein, 6 aa, Neisseria
VADVLR

SEQ ID NO: 31462 - protein, 23 aa, Neisseria
FGGVAGDVGGGADGVAQGLFGEV

SEQ ID NO: 31463 - protein, 10 aa, Neisseria
HADALSERFA

SEQ ID NO: 31464 - protein, 14 aa, Neisseria
AAEVEEFGSGVVEQ

SEQ ID NO: 31465 - protein, 8 aa, Neisseria
VTAEEIAF

SEQ ID NO: 31466 - protein, 10 aa, Neisseria
HEARRGGNTF

SEQ ID NO: 31467 - protein, 9 aa, Neisseria
IAAAERAGD

SEQ ID NO: 31468 - protein, 5 aa, Neisseria
EEIGQ

SEQ ID NO: 31469 - protein, 6 aa, Neisseria
AVDQET

SEQ ID NO: 31470 - protein, 42 aa, Neisseria
LAVERAAGECADEVSDQPARNGGIEEDGVAACRDAAAAESAQ

SEQ ID NO: 31471 - protein, 8 aa, Neisseria
AGGGLTDG

SEQ ID NO: 31472 - protein, 8 aa, Neisseria
GGNDAAGN

SEQ ID NO: 31473 - protein, 5 aa, Neisseria
LHRRA

SEQ ID NO: 31474 - protein, 6 aa, Neisseria
ADGGFR

SEQ ID NO: 31475 - protein, 7 aa, Neisseria
GVGKSGA

SEQ ID NO: 31476 - protein, 9 aa, Neisseria
DVGGGADGV

SEQ ID NO: 31477 - protein, 7 aa, Neisseria
DVNGNVQ

SEQ ID NO: 31478 - protein, 7 aa, Neisseria
ALSERFA

SEQ ID NO: 31479 - protein, 9 aa, Neisseria
GFGGGRARC

SEQ ID NO: 31480 - protein, 17 aa, Neisseria
CQVERAAAEVEEFGSGV

SEQ ID NO: 31481 - protein, 5 aa, Neisseria
QHNNL

SEQ ID NO: 31482 - protein, 8 aa, Neisseria
VTAEEIAF

SEQ ID NO: 31483 - protein, 8 aa, Neisseria
HEARRGGN

SEQ ID NO: 31484 - protein, 9 aa, Neisseria
IAAAERAGD

SEQ ID NO: 31485 - protein, 6 aa, Neisseria
AVDQET

SEQ ID NO: 31486 - protein, 42 aa, Neisseria; identical to SEQ ID NO: 31470

SEQ ID NO: 31487 - protein, 5 aa, Neisseria
NDAAG

SEQ ID NO: 31488 - protein, 5 aa, Neisseria
LHRRA

SEQ ID NO: 31489 - protein, 8 aa, Neisseria
VGGGADGV

SEQ ID NO: 31490 - protein, 7 aa, Neisseria
ALSERFA

SEQ ID NO: 31491 - protein, 5 aa, Neisseria
GRARC

SEQ ID NO: 31492 - protein, 14 aa, Neisseria
CQVERAAAEVEEFG

SEQ ID NO: 31493 - protein, 7 aa, Neisseria
VFGFKSF

SEQ ID NO: 31494 - protein, 15 aa, Neisseria
VVERLGRFHRALTAG

SEQ ID NO: 31495 - protein, 14 aa, Neisseria
MAITQLAQTTLRSV

SEQ ID NO: 31496 - protein, 8 aa, Neisseria
VSALDEAA

SEQ ID NO: 31497 - protein, 8 aa, Neisseria
QEILRAMQ

SEQ ID NO: 31498 - protein, 5 aa, Neisseria
KIEQI

SEQ ID NO: 31499 - protein, 10 aa, Neisseria
SNAEKIARIN

SEQ ID NO: 31500 - protein, 8 aa, Neisseria
AIRQIAAA

SEQ ID NO: 31501 - protein, 11 aa, Neisseria
QYVAAFNNLAK

SEQ ID NO: 31502 - protein, 23 aa, Neisseria
ANVADIGSLISAGMKIIDSSKTA

SEQ ID NO: 31503 - protein, 8 aa, Neisseria
ERLGRFHR

SEQ ID NO: 31504 - protein, 13 aa, Neisseria
HSLKEIPLDVPSQ

SEQ ID NO: 31505 - protein, 11 aa, Neisseria
CITRDNTQLTV

SEQ ID NO: 31506 - protein, 7 aa, Neisseria
TDPKLAS

SEQ ID NO: 31507 - protein, 14 aa, Neisseria
MELDKTFEERDEIN

SEQ ID NO: 31508 - protein, 7 aa, Neisseria
ALDEAAG

SEQ ID NO: 31509 - protein, 10 aa, Neisseria
LRYEIKDLVP

SEQ ID NO: 31510 - protein, 21 aa, Neisseria
ITAEREKRARIAESEGRKIEQ

SEQ ID NO: 31511 - protein, 20 aa, Neisseria
NLASGQREAEIQQSEGEAQA

SEQ ID NO: 31512 - protein, 23 aa, Neisseria
NASNAEKIARINRAKGEAESLRL

SEQ ID NO: 31513 - protein, 7 aa, Neisseria
ANAEAIR

SEQ ID NO: 31514 - protein, 10 aa, Neisseria
QTQGGADAVN

SEQ ID NO: 31515 - protein, 7 aa, Neisseria
LAKESNT

SEQ ID NO: 31516 - protein, 13 aa, Neisseria
AGMKIIDSSKTAK

SEQ ID NO: 31517 - protein, 8 aa, Neisseria
ERLGRFHR

SEQ ID NO: 31518 - protein, 8 aa, Neisseria
HSLKEIPL

SEQ ID NO: 31519 - protein, 6 aa, Neisseria
ITRDNT

SEQ ID NO: 31520 - protein, 5 aa, Neisseria
TDPKL

SEQ ID NO: 31521 - protein, 14 aa, Neisseria
MELDKTFEERDEIN

SEQ ID NO: 31522 - protein, 6 aa, Neisseria
ALDEAA

SEQ ID NO: 31523 - protein, 10 aa, Neisseria
LRYEIKDLVP

SEQ ID NO: 31524 - protein, 21 aa, Neisseria
ITAEREKRARIAESEGRKIEQ

SEQ ID NO: 31525 - protein, 17 aa, Neisseria
SGQREAEIQQSEGEAQA

SEQ ID NO: 31526 - protein, 21 aa, Neisseria
SNAEKIARINRAKGEAESLRL

SEQ ID NO: 31527 - protein, 7 aa, Neisseria
ANAEAIR

SEQ ID NO: 31528 - protein, 6 aa, Neisseria
LAKESN

SEQ ID NO: 31529 - protein, 10 aa, Neisseria
KIIDSSKTAK

SEQ ID NO: 31530 - protein, 12 aa, Neisseria
DGQIWRAFSSLK

SEQ ID NO: 31531 - protein, 7 aa, Neisseria
KPSRRAL

SEQ ID NO: 31532 - protein, 8 aa, Neisseria
ASGKISLP

SEQ ID NO: 31533 - protein, 26 aa, Neisseria
PPNNSTTTSTSLRATSSNGSLTKAAD

SEQ ID NO: 31534 - protein, 27 aa, Neisseria
HMAEIRISRPKRREISSALSRNTAAAP

SEQ ID NO: 31535 - protein, 10 aa, Neisseria
PTVPKPKRPM

SEQ ID NO: 31536 - protein, 8 aa, Neisseria
SPCKPTEM

SEQ ID NO: 31537 - protein, 7 aa, Neisseria
KPSRRAL

SEQ ID NO: 31538 - protein, 8 aa, Neisseria
TSLRATSS

SEQ ID NO: 31539 - protein, 7 aa, Neisseria
SLTKAAD

SEQ ID NO: 31540 - protein, 16 aa, Neisseria
HMAEIRISRPKRREIS

SEQ ID NO: 31541 - protein, 6 aa, Neisseria
LSRNTA

SEQ ID NO: 31542 - protein, 9 aa, Neisseria
TVPKPKRPM

SEQ ID NO: 31543 - protein, 6 aa, Neisseria
CKPTEM

SEQ ID NO: 31544 - protein, 7 aa, Neisseria
TKPSKSC

SEQ ID NO: 31545 - protein, 5 aa, Neisseria
LPPIG

SEQ ID NO: 31546 - protein, 10 aa, Neisseria
VKTVSKPAKS

SEQ ID NO: 31547 - protein, 5 aa, Neisseria
AQKML

SEQ ID NO: 31548 - protein, 9 aa, Neisseria
QARLAKGGN

SEQ ID NO: 31549 - protein, 14 aa, Neisseria
INALSNVLDRQQNI

SEQ ID NO: 31550 - protein, 5 aa, Neisseria
MKSKL

SEQ ID NO: 31551 - protein, 27 aa, Neisseria
VYTTKPSKSCHSTDLPPIGNYSSERYI

SEQ ID NO: 31552 - protein, 14 aa, Neisseria
QTPEPAPSPSNGGQ

SEQ ID NO: 31553 - protein, 7 aa, Neisseria
VKYKAPV

SEQ ID NO: 31554 - protein, 44 aa, Neisseria
TVSKPAKSNTPPQQAPVNNSRRSILEAELSNERKALTEAQKMLS

SEQ ID NO: 31555 - protein, 12 aa, Neisseria
RLAKGGNINHQK

SEQ ID NO: 31556 - protein, 7 aa, Neisseria
VLDRQQN

SEQ ID NO: 31557 - protein, 7 aa, Neisseria
LQRELGR

SEQ ID NO: 31558 - protein, 5 aa, Neisseria
MKSKL

SEQ ID NO: 31559 - protein, 7 aa, Neisseria
KPSKSCH

SEQ ID NO: 31560 - protein, 6 aa, Neisseria
SSERYI

SEQ ID NO: 31561 - protein, 11 aa, Neisseria
TPEPAPSPSNG

SEQ ID NO: 31562 - protein, 7 aa, Neisseria
VKYKAPV

SEQ ID NO: 31563 - protein, 11 aa, Neisseria
TVSKPAKSNTP

SEQ ID NO: 31564 - protein, 27 aa, Neisseria
NNSRRSILEAELSNERKALTEAQKMLS

SEQ ID NO: 31565 - protein, 7 aa, Neisseria
VLDRQQN

SEQ ID NO: 31566 - protein, 7 aa, Neisseria
LQRELGR

SEQ ID NO: 31567 - protein, 8 aa, Neisseria
KIVESCMK

SEQ ID NO: 31568 - protein, 32 aa, Neisseria
MWEQPLDGLSEKQISSFGKLGAQEQLDLLGGA

SEQ ID NO: 31569 - protein, 26 aa, Neisseria
MTEPKHETPTEEQVAARKKAKAKIRT

SEQ ID NO: 31570 - protein, 17 aa, Neisseria
AMSKPQAKQKIVESCMK

SEQ ID NO: 31571 - protein, 18 aa, Neisseria
KWQNDLKARGLDADNTRL

SEQ ID NO: 31572 - protein, 15 aa, Neisseria
GLSEKQISSFGKLGA

SEQ ID NO: 31573 - protein, 17 aa, Neisseria
NAFETRDKQCVADLKAD

SEQ ID NO: 31574 - protein, 26 aa, Neisseria
MTEPKHETPTEEQVAARKKAKAKIRT

SEQ ID NO: 31575 - protein, 16 aa, Neisseria
AMSKPQAKQKIVESCM

SEQ ID NO: 31576 - protein, 17 aa, Neisseria
WQNDLKARGLDADNTRL

SEQ ID NO: 31577 - protein, 7 aa, Neisseria
GLSEKQI

SEQ ID NO: 31578 - protein, 15 aa, Neisseria
FETRDKQCVADLKAD

SEQ ID NO: 31579 - protein, 11 aa, Neisseria
EFAEFVNSHPQ

SEQ ID NO: 31580 - protein, 7 aa, Neisseria
KHWMKNG

SEQ ID NO: 31581 - protein, 10 aa, Neisseria
RLPTIDEWEF

SEQ ID NO: 31582 - protein, 6 aa, Neisseria
TILDWY

SEQ ID NO: 31583 - protein, 8 aa, Neisseria
RKGLHDVG

SEQ ID NO: 31584 - protein, 5 aa, Neisseria
WGVYD

SEQ ID NO: 31585 - protein, 5 aa, Neisseria
WEWTE

SEQ ID NO: 31586 - protein, 21 aa, Neisseria
VQIEGGSYRPLYLKKDTGLIK

SEQ ID NO: 31587 - protein, 11 aa, Neisseria
KPFKLDKYPVT

SEQ ID NO: 31588 - protein, 15 aa, Neisseria
HPQWQKGRIGSKQAE

SEQ ID NO: 31589 - protein, 19 aa, Neisseria
WMKNGSRSYAPKAGELKQP

SEQ ID NO: 31590 - protein, 12 aa, Neisseria
QGKRLPTIDEWE

SEQ ID NO: 31591 - protein, 15 aa, Neisseria
ATQKNGSNEPGYNRT

SEQ ID NO: 31592 - protein, 19 aa, Neisseria
YADGGRKGLHDVGKDRPNY

SEQ ID NO: 31593 - protein, 15 aa, Neisseria
WTEDFNSSLLSSGNA

SEQ ID NO: 31594 - protein, 11 aa, Neisseria
ASVGASDSSNY

SEQ ID NO: 31595 - protein, 6 aa, Neisseria
SLQSKY

SEQ ID NO: 31596 - protein, 7 aa, Neisseria
GFRCASR

SEQ ID NO: 31597 - protein, 10 aa, Neisseria
YLKKDTGLIK

SEQ ID NO: 31598 - protein, 9 aa, Neisseria
KPFKLDKYP

SEQ ID NO: 31599 - protein, 11 aa, Neisseria
QKGRIGSKQAE

SEQ ID NO: 31600 - protein, 7 aa, Neisseria
NGSRSYA

SEQ ID NO: 31601 - protein, 7 aa, Neisseria
KAGELKQ

SEQ ID NO: 31602 - protein, 7 aa, Neisseria
QGKRLPT

SEQ ID NO: 31603 - protein, 12 aa, Neisseria
ATQKNGSNEPGY

SEQ ID NO: 31604 - protein, 15 aa, Neisseria
GGRKGLHDVGKDRPN

SEQ ID NO: 31605 - protein, 7 aa, Neisseria
GASDSSN

SEQ ID NO: 31606 - protein, 6 aa, Neisseria
FFQPVQ

SEQ ID NO: 31607 - protein, 13 aa, Neisseria
DAAELVELFALFP

SEQ ID NO: 31608 - protein, 17 aa, Neisseria
GKGIERQVDNIADVYGF

SEQ ID NO: 31609 - protein, 14 aa, Neisseria
GRSAVGMGGSDAAE

SEQ ID NO: 31610 - protein, 8 aa, Neisseria
QKPRLGCR

SEQ ID NO: 31611 - protein, 14 aa, Neisseria
FMGKGIERQVDNIA

SEQ ID NO: 31612 - protein, 24 aa, Neisseria
LLRKGTGLEKTCRPKPFVQPHGGR

SEQ ID NO: 31613 - protein, 7 aa, Neisseria
GGSDAAE

SEQ ID NO: 31614 - protein, 6 aa, Neisseria
KPRLGC

SEQ ID NO: 31615 - protein, 14 aa, Neisseria
FMGKGIERQVDNIA

SEQ ID NO: 31616 - protein, 16 aa, Neisseria
LLRKGTGLEKTCRPKP

SEQ ID NO: 31617 - protein, 23 aa, Neisseria
RLAGWYECSSLSGWCKPRKPAAI

SEQ ID NO: 31618 - protein, 5 aa, Neisseria
NRSVR

SEQ ID NO: 31619 - protein, 6 aa, Neisseria
RKIGKF

SEQ ID NO: 31620 - protein, 7 aa, Neisseria
PLVERFK

SEQ ID NO: 31621 - protein, 16 aa, Neisseria
ECSSLSGWCKPRKPAA

SEQ ID NO: 31622 - protein, 37 aa, Neisseria
DIGGESPLSLEDYEIPLSDGNRSVRANEYESAQKSYF

SEQ ID NO: 31623 - protein, 48 aa, Neisseria
KIGKFEACGLDWRTRDGKPLVERFKQEGFDCLEKQGLRRNGLSERVRW

SEQ ID NO: 31624 - protein, 8 aa, Neisseria
CKPRKPAA

SEQ ID NO: 31625 - protein, 12 aa, Neisseria
SPLSLEDYEIPL

SEQ ID NO: 31626 - protein, 15 aa, Neisseria
DGNRSVRANEYESAQ

SEQ ID NO: 31627 - protein, 8 aa, Neisseria
KIGKFEAC

SEQ ID NO: 31628 - protein, 37 aa, Neisseria
WRTRDGKPLVERFKQEGFDCLEKQGLRRNGLSERVRW

SEQ ID NO: 31629 - protein, 6 aa, Neisseria
LADYMA

SEQ ID NO: 31630 - protein, 16 aa, Neisseria
GSIIGIFFSLPGLILG

SEQ ID NO: 31631 - protein, 6 aa, Neisseria
IGAAAG

SEQ ID NO: 31632 - protein, 6 aa, Neisseria
LLGLVV

SEQ ID NO: 31633 - protein, 8 aa, Neisseria
TGAGKLAV

SEQ ID NO: 31634 - protein, 8 aa, Neisseria
ELIDRRNM

SEQ ID NO: 31635 - protein, 8 aa, Neisseria
ELIDRRNM

SEQ ID NO: 31636 - protein, 5 aa, Neisseria
KKQAD

SEQ ID NO: 31637 - protein, 18 aa, Neisseria
ALLSAVTHLLAIFVPMIT

SEQ ID NO: 31638 - protein, 10 aa, Neisseria
YLQVNRFGSV

SEQ ID NO: 31639 - protein, 8 aa, Neisseria
STLLGVSF

SEQ ID NO: 31640 - protein, 7 aa, Neisseria
KVITPTV

SEQ ID NO: 31641 - protein, 9 aa, Neisseria
TFGSMENLG

SEQ ID NO: 31642 - protein, 5 aa, Neisseria
CMKNP

SEQ ID NO: 31643 - protein, 6 aa, Neisseria
GYIVAL

SEQ ID NO: 31644 - protein, 8 aa, Neisseria
FSALQNLP

SEQ ID NO: 31645 - protein, 12 aa, Neisseria
LGVFEAVGDLTA

SEQ ID NO: 31646 - protein, 8 aa, Neisseria
TKRLRGGV

SEQ ID NO: 31647 - protein, 12 aa, Neisseria
DGLVSVIATALG

SEQ ID NO: 31648 - protein, 8 aa, Neisseria
ASRHVGKY

SEQ ID NO: 31649 - protein, 10 aa, Neisseria
RAFTTIPSPV

SEQ ID NO: 31650 - protein, 12 aa, Neisseria
ETMKKQADSPDL

SEQ ID NO: 31651 - protein, 9 aa, Neisseria
YGLEDRPPF

SEQ ID NO: 31652 - protein, 5 aa, Neisseria
NRFGS

SEQ ID NO: 31653 - protein, 6 aa, Neisseria
  VARIANT (1)...(6): Xaa is any amino acid
XXXXSS

SEQ ID NO: 31654 - protein, 12 aa, Neisseria
AGMKEGGLSEGA

SEQ ID NO: 31655 - protein, 11 aa, Neisseria
FGAKADGTFGS

SEQ ID NO: 31656 - protein, 7 aa, Neisseria
MKNPLLR

SEQ ID NO: 31657 - protein, 20 aa, Neisseria
VSDQPIEGEEYTKRLRGGVL

SEQ ID NO: 31658 - protein, 8 aa, Neisseria
GIRRREAV

SEQ ID NO: 31659 - protein, 5 aa, Neisseria
ISGGG

SEQ ID NO: 31660 - protein, 19 aa, Neisseria
LPEDKTEAAVKFDTDHLEH

SEQ ID NO: 31661 - protein, 11 aa, Neisseria
ETMKKQADSPD

SEQ ID NO: 31662 - protein, 7 aa, Neisseria
LEDRPPF

SEQ ID NO: 31663 - protein, 8 aa, Neisseria
GMKEGGLS

SEQ ID NO: 31664 - protein, 5 aa, Neisseria
AKADG

SEQ ID NO: 31665 - protein, 14 aa, Neisseria
QPIEGEEYTKRLRG

SEQ ID NO: 31666 - protein, 8 aa, Neisseria
GIRRREAV

SEQ ID NO: 31667 - protein, 19 aa, Neisseria
LPEDKTEAAVKFDTDHLEH

SEQ ID NO: 31668 - protein, 15 aa, Neisseria
QIRDGGDALHYLNRI

SEQ ID NO: 31669 - protein, 5 aa, Neisseria
HGEHH

SEQ ID NO: 31670 - protein, 9 aa, Neisseria
GYLYNGVHE

SEQ ID NO: 31671 - protein, 11 aa, Neisseria
RQVDALMSAIY

SEQ ID NO: 31672 - protein, 6 aa, Neisseria
NGSFER

SEQ ID NO: 31673 - protein, 16 aa, Neisseria
GRRQPEAGRKYYRNAC

SEQ ID NO: 31674 - protein, 9 aa, Neisseria
RPVRVLTAG

SEQ ID NO: 31675 - protein, 11 aa, Neisseria
YTAVFDYVRNG

SEQ ID NO: 31676 - protein, 5 aa, Neisseria
TRYTY

SEQ ID NO: 31677 - protein, 9 aa, Neisseria
TQNQSLPAG

SEQ ID NO: 31678 - protein, 14 aa, Neisseria
VYPSAPQIRDGGDA

SEQ ID NO: 31679 - protein, 8 aa, Neisseria
NSARRHAR

SEQ ID NO: 31680 - protein, 16 aa, Neisseria
LNPEDGHGEHHPDNPH

SEQ ID NO: 31681 - protein, 9 aa, Neisseria
QKLTERTRL

SEQ ID NO: 31682 - protein, 27 aa, Neisseria
VHENISTEEEAAESSDSDIRTQQRQVD

SEQ ID NO: 31683 - protein, 11 aa, Neisseria
SLLDRHTDEAG

SEQ ID NO: 31684 - protein, 8 aa, Neisseria
FVRENGKT

SEQ ID NO: 31685 - protein, 31 aa, Neisseria
QGNGSFERACAKGRRQPEAGRKYYRNACHNG

SEQ ID NO: 31686 - protein, 19 aa, Neisseria
YGERPDPVPEYEITGNPAS

SEQ ID NO: 31687 - protein, 7 aa, Neisseria
DFSEAAG

SEQ ID NO: 31688 - protein, 5 aa, Neisseria
IAMKS

SEQ ID NO: 31689 - protein, 9 aa, Neisseria
YQGKNEIRP

SEQ ID NO: 31690 - protein, 11 aa, Neisseria
TAGNDPNGRLT

SEQ ID NO: 31691 - protein, 9 aa, Neisseria
YVRNGRHAQ

SEQ ID NO: 31692 - protein, 10 aa, Neisseria
FRTRKPDYPY

SEQ ID NO: 31693 - protein, 15 aa, Neisseria
EVNGGETLAVRKGEK

SEQ ID NO: 31694 - protein, 7 aa, Neisseria
WRGRWCL

SEQ ID NO: 31695 - protein, 6 aa, Neisseria
RQFGNS

SEQ ID NO: 31696 - protein, 7 aa, Neisseria
LRHEAGG

SEQ ID NO: 31697 - protein, 18 aa, Neisseria
GMAGSRIRLTPEDSPERG

SEQ ID NO: 31698 - protein, 8 aa, Neisseria
PQIRDGGD

SEQ ID NO: 31699 - protein, 8 aa, Neisseria
NSARRHAR

SEQ ID NO: 31700 - protein, 12 aa, Neisseria
NPEDGHGEHHPD

SEQ ID NO: 31701 - protein, 8 aa, Neisseria
KLTERTRL

SEQ ID NO: 31702 - protein, 23 aa, Neisseria
ISTEEEAAESSDSDIRTQQRQVD

SEQ ID NO: 31703 - protein, 11 aa, Neisseria
SLLDRHTDEAG

SEQ ID NO: 31704 - protein, 7 aa, Neisseria
FVRENGK

SEQ ID NO: 31705 - protein, 22 aa, Neisseria
GSFERACAKGRRQPEAGRKYYR

SEQ ID NO: 31706 - protein, 11 aa, Neisseria
ERPDPVPEYEI

SEQ ID NO: 31707 - protein, 7 aa, Neisseria
DFSEAAG

SEQ ID NO: 31708 - protein, 5 aa, Neisseria
IAMKS

SEQ ID NO: 31709 - protein, 8 aa, Neisseria
QGKNEIRP

SEQ ID NO: 31710 - protein, 9 aa, Neisseria
GNDPNGRLT

SEQ ID NO: 31711 - protein, 7 aa, Neisseria
RNGRHAQ

SEQ ID NO: 31712 - protein, 7 aa, Neisseria
FRTRKPD

SEQ ID NO: 31713 - protein, 8 aa, Neisseria
LAVRKGEK

SEQ ID NO: 31714 - protein, 5 aa, Neisseria
LRHEA

SEQ ID NO: 31715 - protein, 14 aa, Neisseria
SRIRLTPEDSPERG

SEQ ID NO: 31716 - protein, 14 aa, Neisseria
TALAEAVELVKAAG

SEQ ID NO: 31717 - protein, 10 aa, Neisseria
KAAELSEAVA

SEQ ID NO: 31718 - protein, 17 aa, Neisseria
QERNLEKILQCRVLDRV

SEQ ID NO: 31719 - protein, 17 aa, Neisseria
QLSHLAGRLIRGYGHLQ

SEQ ID NO: 31720 - protein, 9 aa, Neisseria
INALKKQLA

SEQ ID NO: 31721 - protein, 13 aa, Neisseria
GRIKTFALVGYTN

SEQ ID NO: 31722 - protein, 6 aa, Neisseria
FNRLTK

SEQ ID NO: 31723 - protein, 19 aa, Neisseria
GFVSDLPHKLISAFSATLE

SEQ ID NO: 31724 - protein, 17 aa, Neisseria
NSGQQIEDVENVLQEIH

SEQ ID NO: 31725 - protein, 17 aa, Neisseria
ENTGIDALREAIAEYCA

SEQ ID NO: 31726 - protein, 17 aa, Neisseria
SGRTGRNSATQAQPERV

SEQ ID NO: 31727 - protein, 12 aa, Neisseria
LDKDDTGSNAAR

SEQ ID NO: 31728 - protein, 5 aa, Neisseria
VELVK

SEQ ID NO: 31729 - protein, 18 aa, Neisseria
AGGDSVRVETAKRDRPHT

SEQ ID NO: 31730 - protein, 9 aa, Neisseria
TGKAAELSE

SEQ ID NO: 31731 - protein, 12 aa, Neisseria
ELTPTQERNLEK

SEQ ID NO: 31732 - protein, 13 aa, Neisseria
ARRARTQEGRLQV

SEQ ID NO: 31733 - protein, 25 aa, Neisseria
QSQRGGIGMKGPGETKLETDRRLTA

SEQ ID NO: 31734 - protein, 28 aa, Neisseria
NALKKQLANLKKQRALRRKSRESGRIKT

SEQ ID NO: 31735 - protein, 7 aa, Neisseria
NVGKSSL

SEQ ID NO: 31736 - protein, 9 aa, Neisseria
RLTKSGIYA

SEQ ID NO: 31737 - protein, 7 aa, Neisseria
TLEETVQ

SEQ ID NO: 31738 - protein, 17 aa, Neisseria
AAARNSGQQIEDVENVL

SEQ ID NO: 31739 - protein, 16 aa, Neisseria
YNKTDLLPSEEQNTGI

SEQ ID NO: 31740 - protein, 12 aa, Neisseria
ENTGIDALREAI

SEQ ID NO: 31741 - protein, 12 aa, Neisseria
AAAPNTDETEMP

SEQ ID NO: 31742 - protein, 9 aa, Neisseria
SGRTGRNSA

SEQ ID NO: 31743 - protein, 5 aa, Neisseria
AQPER

SEQ ID NO: 31744 - protein, 12 aa, Neisseria
LDKDDTGSNAAR

SEQ ID NO: 31745 - protein, 5 aa, Neisseria
VELVK

SEQ ID NO: 31746 - protein, 17 aa, Neisseria
AGGDSVRVETAKRDRPH

SEQ ID NO: 31747 - protein, 8 aa, Neisseria
GKAAELSE

SEQ ID NO: 31748 - protein, 11 aa, Neisseria
LTPTQERNLEK

SEQ ID NO: 31749 - protein, 13 aa, Neisseria
ARRARTQEGRLQV

SEQ ID NO: 31750 - protein, 7 aa, Neisseria
QSQRGGI

SEQ ID NO: 31751 - protein, 15 aa, Neisseria
GPGETKLETDRRLTA

SEQ ID NO: 31752 - protein, 27 aa, Neisseria
NALKKQLANLKKQRALRRKSRESGRIK

SEQ ID NO: 31753 - protein, 7 aa, Neisseria
TLEETVQ

SEQ ID NO: 31754 - protein, 17 aa, Neisseria
AAARNSGQQIEDVENVL

SEQ ID NO: 31755 - protein, 9 aa, Neisseria
DLLPSEEQN

SEQ ID NO: 31756 - protein, 7 aa, Neisseria
DALREAI

SEQ ID NO: 31757 - protein, 9 aa, Neisseria
PNTDETEMP

SEQ ID NO: 31758 - protein, 14 aa, Neisseria
TALAEAVELVKAAG

SEQ ID NO: 31759 - protein, 10 aa, Neisseria
KAAELSEAVA

SEQ ID NO: 31760 - protein, 17 aa, Neisseria
QERNLEKILQCRVLDRV

SEQ ID NO: 31761 - protein, 17 aa, Neisseria
QLSHLAGRLIRGYGHLQ

SEQ ID NO: 31762 - protein, 9 aa, Neisseria
INALKKQLA

SEQ ID NO: 31763 - protein, 13 aa, Neisseria
GRIKTFALVGYTN

SEQ ID NO: 31764 - protein, 6 aa, Neisseria
FNRLTK

SEQ ID NO: 31765 - protein, 19 aa, Neisseria
GFVSDLPHKLISAFSATLE

SEQ ID NO: 31766 - protein, 17 aa, Neisseria
NSGQQIEDVENVLQEIH

SEQ ID NO: 31767 - protein, 17 aa, Neisseria
ENTGIDALREAIAEYCA

SEQ ID NO: 31768 - protein, 17 aa, Neisseria
SGRTGRNSATQAQPERV

SEQ ID NO: 31769 - protein, 12 aa, Neisseria
LDKDDTGSNAAR

SEQ ID NO: 31770 - protein, 5 aa, Neisseria
VELVK

SEQ ID NO: 31771 - protein, 18 aa, Neisseria
AGGDSVRVETAKRDRPHT

SEQ ID NO: 31772 - protein, 9 aa, Neisseria
TGKAAELSE

SEQ ID NO: 31773 - protein, 12 aa, Neisseria
ELTPTQERNLEK

SEQ ID NO: 31774 - protein, 13 aa, Neisseria
ARRARTQEGRLQV

SEQ ID NO: 31775 - protein, 25 aa, Neisseria
QSQRGGIGMKGPGETKLETDRRLTA

SEQ ID NO: 31776 - protein, 28 aa, Neisseria
NALKKQLANLKKQRALRRKSRESGRIKT

SEQ ID NO: 31777 - protein, 7 aa, Neisseria
NVGKSSL

SEQ ID NO: 31778 - protein, 9 aa, Neisseria
RLTKSGIYA

SEQ ID NO: 31779 - protein, 7 aa, Neisseria
TLEETVQ

SEQ ID NO: 31780 - protein, 17 aa, Neisseria
AAARNSGQQIEDVENVL

SEQ ID NO: 31781 - protein, 16 aa, Neisseria
YNKTDLLPSEEQNTGI

SEQ ID NO: 31782 - protein, 12 aa, Neisseria
ENTGIDALREAI

SEQ ID NO: 31783 - protein, 12 aa, Neisseria
AAAPNTDETEMP

SEQ ID NO: 31784 - protein, 9 aa, Neisseria
SGRTGRNSA

SEQ ID NO: 31785 - protein, 5 aa, Neisseria
AQPER

SEQ ID NO: 31786 - protein, 12 aa, Neisseria
LDKDDTGSNAAR

SEQ ID NO: 31787 - protein, 5 aa, Neisseria
VELVK

SEQ ID NO: 31788 - protein, 17 aa, Neisseria
AGGDSVRVETAKRDRPH

SEQ ID NO: 31789 - protein, 8 aa, Neisseria
GKAAELSE

SEQ ID NO: 31790 - protein, 11 aa, Neisseria
LTPTQERNLEK

SEQ ID NO: 31791 - protein, 13 aa, Neisseria
ARRARTQEGRLQV

SEQ ID NO: 31792 - protein, 7 aa, Neisseria
QSQRGGI

SEQ ID NO: 31793 - protein, 15 aa, Neisseria
GPGETKLETDRRLTA

SEQ ID NO: 31794 - protein, 27 aa, Neisseria
NALKKQLANLKKQRALRRKSRESGRIK

SEQ ID NO: 31795 - protein, 7 aa, Neisseria
TLEETVQ

SEQ ID NO: 31796 - protein, 17 aa, Neisseria
AAARNSGQQIEDVENVL

SEQ ID NO: 31797 - protein, 9 aa, Neisseria
DLLPSEEQN

SEQ ID NO: 31798 - protein, 7 aa, Neisseria
DALREAI

SEQ ID NO: 31799 - protein, 9 aa, Neisseria
PNTDETEMP

SEQ ID NO: 31800 - protein, 11 aa, Neisseria
RQREHHRLHHT

SEQ ID NO: 31801 - protein, 15 aa, Neisseria
LVGGFDFLRVIGCGG

SEQ ID NO: 31802 - protein, 8 aa, Neisseria
AGGAGNAA

SEQ ID NO: 31803 - protein, 6 aa, Neisseria
RAIMGF

SEQ ID NO: 31804 - protein, 7 aa, Neisseria
DLVEDFL

SEQ ID NO: 31805 - protein, 8 aa, Neisseria
DALCDCLT

SEQ ID NO: 31806 - protein, 7 aa, Neisseria
QVFGNVQ

SEQ ID NO: 31807 - protein, 7 aa, Neisseria
FGAAAQY

SEQ ID NO: 31808 - protein, 7 aa, Neisseria
GRSLTNP

SEQ ID NO: 31809 - protein, 11 aa, Neisseria
VSRVAKSWSFA

SEQ ID NO: 31810 - protein, 8 aa, Neisseria
MPDLVSRL

SEQ ID NO: 31811 - protein, 8 aa, Neisseria
MEDLQEIG

SEQ ID NO: 31812 - protein, 10 aa, Neisseria
KVGRQREHHR

SEQ ID NO: 31813 - protein, 12 aa, Neisseria
HHTQSGNGKADD

SEQ ID NO: 31814 - protein, 11 aa, Neisseria
PDFQQNVGEAD

SEQ ID NO: 31815 - protein, 7 aa, Neisseria
VPDDAAA

SEQ ID NO: 31816 - protein, 10 aa, Neisseria
IEVDADDAVC

SEQ ID NO: 31817 - protein, 16 aa, Neisseria
LFDQPDAGGAGNAAEH

SEQ ID NO: 31818 - protein, 7 aa, Neisseria
GIDDALC

SEQ ID NO: 31819 - protein, 7 aa, Neisseria
MASRSAS

SEQ ID NO: 31820 - protein, 5 aa, Neisseria
TEMRT

SEQ ID NO: 31821 - protein, 8 aa, Neisseria
CSSDGSRS

SEQ ID NO: 31822 - protein, 7 aa, Neisseria
TTCSSTS

SEQ ID NO: 31823 - protein, 12 aa, Neisseria
TVSSKVAEKAEI

SEQ ID NO: 31824 - protein, 11 aa, Neisseria
LCGRSLTNPTV

SEQ ID NO: 31825 - protein, 7 aa, Neisseria
YSRRAVV

SEQ ID NO: 31826 - protein, 5 aa, Neisseria
RVAKS

SEQ ID NO: 31827 - protein, 10 aa, Neisseria
LVSRLNRLDL

SEQ ID NO: 31828 - protein, 8 aa, Neisseria
MEDLQEIG

SEQ ID NO: 31829 - protein, 10 aa, Neisseria
KVGRQREHHR

SEQ ID NO: 31830 - protein, 7 aa, Neisseria
GNGKADD

SEQ ID NO: 31831 - protein, 5 aa, Neisseria
VGEAD

SEQ ID NO: 31832 - protein, 6 aa, Neisseria
PDDAAA

SEQ ID NO: 31833 - protein, 10 aa, Neisseria
IEVDADDAVC

SEQ ID NO: 31834 - protein, 9 aa, Neisseria
LFDQPDAGG

SEQ ID NO: 31835 - protein, 5 aa, Neisseria
NAAEH

SEQ ID NO: 31836 - protein, 6 aa, Neisseria
GIDDAL

SEQ ID NO: 31837 - protein, 5 aa, Neisseria
ASRSA

SEQ ID NO: 31838 - protein, 5 aa, Neisseria
TEMRT

SEQ ID NO: 31839 - protein, 5 aa, Neisseria
SDGSR

SEQ ID NO: 31840 - protein, 8 aa, Neisseria
KVAEKAEI

SEQ ID NO: 31841 - protein, 7 aa, Neisseria
YSRRAVV

SEQ ID NO: 31842 - protein, 10 aa, Neisseria
LVSRLNRLDL

SEQ ID NO: 31843 - protein, 7 aa, Neisseria
RIRRCSV

SEQ ID NO: 31844 - protein, 12 aa, Neisseria
MPKWSRIRRCSV

SEQ ID NO: 31845 - protein, 5 aa, Neisseria
PPSNA

SEQ ID NO: 31846 - protein, 11 aa, Neisseria
VRLKSSDGIAS

SEQ ID NO: 31847 - protein, 32 aa, Neisseria
GSMPSETVSHKSDSSRNTSASRRNVSPKCPFG

SEQ ID NO: 31848 - protein, 14 aa, Neisseria
CRQDAAKPRRFGGK

SEQ ID NO: 31849 - protein, 5 aa, Neisseria
LTGSR

SEQ ID NO: 31850 - protein, 7 aa, Neisseria
SRIRRCS

SEQ ID NO: 31851 - protein, 10 aa, Neisseria
VRLKSSDGIA

SEQ ID NO: 31852 - protein, 25 aa, Neisseria
MPSETVSHKSDSSRNTSASRRNVSP

SEQ ID NO: 31853 - protein, 13 aa, Neisseria
CRQDAAKPRRFGG

SEQ ID NO: 31854 - protein, 24 aa, Neisseria
FWFPSCPGCVSEMPKVTKTANDYK

SEQ ID NO: 31855 - protein, 17 aa, Neisseria
LAVAQPIDPIESVRQYV

SEQ ID NO: 31856 - protein, 7 aa, Neisseria
KAVGQAF

SEQ ID NO: 31857 - protein, 5 aa, Neisseria
MKKIL

SEQ ID NO: 31858 - protein, 8 aa, Neisseria
IPDSKTAP

SEQ ID NO: 31859 - protein, 14 aa, Neisseria
DLHGKTVSNADLQG

SEQ ID NO: 31860 - protein, 5 aa, Neisseria
SCPGC

SEQ ID NO: 31861 - protein, 17 aa, Neisseria
EMPKVTKTANDYKNKDF

SEQ ID NO: 31862 - protein, 16 aa, Neisseria
PIDPIESVRQYVKDYG

SEQ ID NO: 31863 - protein, 6 aa, Neisseria
DADKAV

SEQ ID NO: 31864 - protein, 8 aa, Neisseria
IGKKGEIL

SEQ ID NO: 31865 - protein, 15 aa, Neisseria
VGEPDFGKLYQEIDT

SEQ ID NO: 31866 - protein, 5 aa, Neisseria
MKKIL

SEQ ID NO: 31867 - protein, 5 aa, Neisseria
PDSKT

SEQ ID NO: 31868 - protein, 17 aa, Neisseria
EMPKVTKTANDYKNKDF

SEQ ID NO: 31869 - protein, 11 aa, Neisseria
DPIESVRQYVK

SEQ ID NO: 31870 - protein, 6 aa, Neisseria
DADKAV

SEQ ID NO: 31871 - protein, 7 aa, Neisseria
IGKKGEI

SEQ ID NO: 31872 - protein, 17 aa, Neisseria
FNKTVASFAQIVETFDV

SEQ ID NO: 31873 - protein, 5 aa, Neisseria
NRSFK

SEQ ID NO: 31874 - protein, 8 aa, Neisseria
ELLTILVK

SEQ ID NO: 31875 - protein, 9 aa, Neisseria
VDNGFNKTV

SEQ ID NO: 31876 - protein, 7 aa, Neisseria
QMKQRCG

SEQ ID NO: 31877 - protein, 12 aa, Neisseria
CGFEIPNRSFKE

SEQ ID NO: 31878 - protein, 13 aa, Neisseria
LSERFRTNAEVEM

SEQ ID NO: 31879 - protein, 10 aa, Neisseria
NLSPNGKKRF

SEQ ID NO: 31880 - protein, 5 aa, Neisseria
MKQRC

SEQ ID NO: 31881 - protein, 8 aa, Neisseria
IPNRSFKE

SEQ ID NO: 31882 - protein, 13 aa, Neisseria
LSERFRTNAEVEM

SEQ ID NO: 31883 - protein, 9 aa, Neisseria
LSPNGKKRF

SEQ ID NO: 31884 - protein, 12 aa, Neisseria
SFLVLAALAACK

SEQ ID NO: 31885 - protein, 5 aa, Neisseria
AASSS

SEQ ID NO: 31886 - protein, 7 aa, Neisseria
AENAAKP

SEQ ID NO: 31887 - protein, 10 aa, Neisseria
FTHCPDVCPT

SEQ ID NO: 31888 - protein, 11 aa, Neisseria
YSDTLKQLGGQ

SEQ ID NO: 31889 - protein, 8 aa, Neisseria
EIIGKYAK

SEQ ID NO: 31890 - protein, 7 aa, Neisseria
KPQDNSA

SEQ ID NO: 31891 - protein, 5 aa, Neisseria
SSSAS

SEQ ID NO: 31892 - protein, 36 aa, Neisseria
PAAENAAKPQTRGTDMRKEDIGGDFTLTDGEGKPFS

SEQ ID NO: 31893 - protein, 5 aa, Neisseria
SDLKG

SEQ ID NO: 31894 - protein, 5 aa, Neisseria
PDVCP

SEQ ID NO: 31895 - protein, 15 aa, Neisseria
SDTLKQLGGQAKDVK

SEQ ID NO: 31896 - protein, 22 aa, Neisseria
IDPERDTPEIIGKYAKQFNPDF

SEQ ID NO: 31897 - protein, 5 aa, Neisseria
ATGGQ

SEQ ID NO: 31898 - protein, 12 aa, Neisseria
KINQKDDSENYL

SEQ ID NO: 31899 - protein, 7 aa, Neisseria
LIDKNGE

SEQ ID NO: 31900 - protein, 14 aa, Neisseria
SPYGSEPETIAADV

SEQ ID NO: 31901 - protein, 7 aa, Neisseria
KPQDNSA

SEQ ID NO: 31902 - protein, 23 aa, Neisseria
PAAENAAKPQTRGTDMRKEDIGG

SEQ ID NO: 31903 - protein, 9 aa, Neisseria
TLTDGEGKP

SEQ ID NO: 31904 - protein, 5 aa, Neisseria
SDLKG

SEQ ID NO: 31905 - protein, 8 aa, Neisseria
GGQAKDVK

SEQ ID NO: 31906 - protein, 11 aa, Neisseria
IDPERDTPEII

SEQ ID NO: 31907 - protein, 11 aa, Neisseria
INQKDDSENYL

SEQ ID NO: 31908 - protein, 5 aa, Neisseria
DKNGE

SEQ ID NO: 31909 - protein, 11 aa, Neisseria
GSEPETIAADV

SEQ ID NO: 31910 - protein, 14 aa, Neisseria
LAAVAGFYGFYTDL

SEQ ID NO: 31911 - protein, 11 aa, Neisseria
NLADIVRFADD

SEQ ID NO: 31912 - protein, 5 aa, Neisseria
ELGSL

SEQ ID NO: 31913 - protein, 5 aa, Neisseria
HFVVL

SEQ ID NO: 31914 - protein, 10 aa, Neisseria
GISGLGRTLF

SEQ ID NO: 31915 - protein, 14 aa, Neisseria
LLALAAAMEVFAFL

SEQ ID NO: 31916 - protein, 9 aa, Neisseria
HDIYSLPPP

SEQ ID NO: 31917 - protein, 5 aa, Neisseria
LTKKL

SEQ ID NO: 31918 - protein, 7 aa, Neisseria
RALRSKY

SEQ ID NO: 31919 - protein, 8 aa, Neisseria
LKGENLAD

SEQ ID NO: 31920 - protein, 12 aa, Neisseria
RALRLDLDELGS

SEQ ID NO: 31921 - protein, 5 aa, Neisseria
VSSDG

SEQ ID NO: 31922 - protein, 19 aa, Neisseria
DPASGRRKVKTEEISRKFT

SEQ ID NO: 31923 - protein, 16 aa, Neisseria
WPNTRFEAGEEKQEIR

SEQ ID NO: 31924 - protein, 5 aa, Neisseria
ISGLG

SEQ ID NO: 31925 - protein, 7 aa, Neisseria
KIGRGES

SEQ ID NO: 31926 - protein, 11 aa, Neisseria
IGRSGCGKSTL

SEQ ID NO: 31927 - protein, 12 aa, Neisseria
LSGNLPPESGKV

SEQ ID NO: 31928 - protein, 9 aa, Neisseria
FECDGQGRT

SEQ ID NO: 31929 - protein, 6 aa, Neisseria
GLNLNR

SEQ ID NO: 31930 - protein, 5 aa, Neisseria
LTKKL

SEQ ID NO: 31931 - protein, 5 aa, Neisseria
RALRS

SEQ ID NO: 31932 - protein, 8 aa, Neisseria
LKGENLAD

SEQ ID NO: 31933 - protein, 12 aa, Neisseria
RALRLDLDELGS

SEQ ID NO: 31934 - protein, 5 aa, Neisseria
VSSDG

SEQ ID NO: 31935 - protein, 18 aa, Neisseria
PASGRRKVKTEEISRKFT

SEQ ID NO: 31936 - protein, 12 aa, Neisseria
RFEAGEEKQEIR

SEQ ID NO: 31937 - protein, 7 aa, Neisseria
KIGRGES

SEQ ID NO: 31938 - protein, 5 aa, Neisseria
SGCGK

SEQ ID NO: 31939 - protein, 7 aa, Neisseria
LPPESGK

SEQ ID NO: 31940 - protein, 7 aa, Neisseria
FECDGQG

SEQ ID NO: 31941 - protein, 10 aa, Neisseria
APTLQTPETL

SEQ ID NO: 31942 - protein, 7 aa, Neisseria
AALTQLM

SEQ ID NO: 31943 - protein, 10 aa, Neisseria
RMFVRPGDTV

SEQ ID NO: 31944 - protein, 7 aa, Neisseria
LLKGMIA

SEQ ID NO: 31945 - protein, 19 aa, Neisseria
ADRLGNGSIENFVQQMNKE

SEQ ID NO: 31946 - protein, 15 aa, Neisseria
EALMRDFPEYYPLFS

SEQ ID NO: 31947 - protein, 9 aa, Neisseria
RALQAFDTP

SEQ ID NO: 31948 - protein, 5 aa, Neisseria
TVAQI

SEQ ID NO: 31949 - protein, 12 aa, Neisseria
EQILETIQPIPA

SEQ ID NO: 31950 - protein, 8 aa, Neisseria
SPAPNRPT

SEQ ID NO: 31951 - protein, 7 aa, Neisseria
TLQTPET

SEQ ID NO: 31952 - protein, 17 aa, Neisseria
LQSRQTLSAKNTNTPVE

SEQ ID NO: 31953 - protein, 18 aa, Neisseria
KNMKSGNIQSEENLKIPE

SEQ ID NO: 31954 - protein, 22 aa, Neisseria
WASEGSRMFVRPGDTVSTDKLL

SEQ ID NO: 31955 - protein, 11 aa, Neisseria
DRLGNGSIENF

SEQ ID NO: 31956 - protein, 35 aa, Neisseria
MNKEARRLGMKNTVFKNPTGLGREGQVSTAKDLSL

SEQ ID NO: 31957 - protein, 10 aa, Neisseria
ALMRDFPEYY

SEQ ID NO: 31958 - protein, 11 aa, Neisseria
ENIEQNNRNIL

SEQ ID NO: 31959 - protein, 19 aa, Neisseria
YRDNNVNGLKAGHTESGGY

SEQ ID NO: 31960 - protein, 7 aa, Neisseria
YSGNGRH

SEQ ID NO: 31961 - protein, 18 aa, Neisseria
LGSESAETRASDNSKLLN

SEQ ID NO: 31962 - protein, 11 aa, Neisseria
DTPKIYPKGKT

SEQ ID NO: 31963 - protein, 10 aa, Neisseria
ISGGSKKTVR

SEQ ID NO: 31964 - protein, 12 aa, Neisseria
PHKEAKMAEQIL

SEQ ID NO: 31965 - protein, 28 aa, Neisseria
APVKKGQILGKIKIRQNGHTIAEKEIVA

SEQ ID NO: 31966 - protein, 12 aa, Neisseria
ENVEKRSRWQRL

SEQ ID NO: 31967 - protein, 6 aa, Neisseria
APNRPT

SEQ ID NO: 31968 - protein, 13 aa, Neisseria
QTLSAKNTNTPVE

SEQ ID NO: 31969 - protein, 17 aa, Neisseria
NMKSGNIQSEENLKIPE

SEQ ID NO: 31970 - protein, 19 aa, Neisseria
EGSRMFVRPGDTVSTDKLL

SEQ ID NO: 31971 - protein, 10 aa, Neisseria
MNKEARRLGM

SEQ ID NO: 31972 - protein, 17 aa, Neisseria
TGLGREGQVSTAKDLSL

SEQ ID NO: 31973 - protein, 8 aa, Neisseria
ENIEQNNR

SEQ ID NO: 31974 - protein, 6 aa, Neisseria
RDNNVN

SEQ ID NO: 31975 - protein, 6 aa, Neisseria
GHTESG

SEQ ID NO: 31976 - protein, 16 aa, Neisseria
SESAETRASDNSKLLN

SEQ ID NO: 31977 - protein, 8 aa, Neisseria
KIYPKGKT

SEQ ID NO: 31978 - protein, 8 aa, Neisseria
GGSKKTVR

SEQ ID NO: 31979 - protein, 12 aa, Neisseria
PHKEAKMAEQIL

SEQ ID NO: 31980 - protein, 7 aa, Neisseria
PVKKGQI

SEQ ID NO: 31981 - protein, 7 aa, Neisseria
IKIRQNG

SEQ ID NO: 31982 - protein, 8 aa, Neisseria
IAEKEIVA

SEQ ID NO: 31983 - protein, 9 aa, Neisseria
ENVEKRSRW

SEQ ID NO: 31984 - protein, 5 aa, Neisseria
IERLK

SEQ ID NO: 31985 - protein, 9 aa, Neisseria
MDNKTKLRL

SEQ ID NO: 31986 - protein, 44 aa, Neisseria; identical to SEQ ID NO: 6009

SEQ ID NO: 31987 - protein, 23 aa, Neisseria
SQKCSVDEAHAMFKKRPTRQEIN

SEQ ID NO: 31988 - protein, 13 aa, Neisseria
AAKQSRGQKRPHR

SEQ ID NO: 31989 - protein, 9 aa, Neisseria
MDNKTKLRL

SEQ ID NO: 31990 - protein, 33 aa, Neisseria; identical to SEQ ID NO: 6013

SEQ ID NO: 31991 - protein, 6 aa, Neisseria
QHQKDA

SEQ ID NO: 31992 - protein, 20 aa, Neisseria
CSVDEAHAMFKKRPTRQEIN

SEQ ID NO: 31993 - protein, 13 aa, Neisseria
AAKQSRGQKRPHR

SEQ ID NO: 31994 - protein, 5 aa, Neisseria
GADGI

SEQ ID NO: 31995 - protein, 8 aa, Neisseria
SGRVDDAA

SEQ ID NO: 31996 - protein, 12 aa, Neisseria
TVSVRRILDYAD

SEQ ID NO: 31997 - protein, 8 aa, Neisseria
RQDVAEQI

SEQ ID NO: 31998 - protein, 24 aa, Neisseria
LKGADGISPPLTYRSWHIEGGQAL

SEQ ID NO: 31999 - protein, 10 aa, Neisseria
ASGRVDDAAG

SEQ ID NO: 32000 - protein, 14 aa, Neisseria
LRIDSVSQNKETYT

SEQ ID NO: 32001 - protein, 13 aa, Neisseria
QVLKRGEPVGKPM

SEQ ID NO: 32002 - protein, 20 aa, Neisseria
RILDYADNEILGKQEEEETL

SEQ ID NO: 32003 - protein, 11 aa, Neisseria
MRQDVAEQIVR

SEQ ID NO: 32004 - protein, 6 aa, Neisseria
KGADGI

SEQ ID NO: 32005 - protein, 8 aa, Neisseria
GRVDDAAG

SEQ ID NO: 32006 - protein, 14 aa, Neisseria
LRIDSVSQNKETYT

SEQ ID NO: 32007 - protein, 10 aa, Neisseria
QVLKRGEPVG

SEQ ID NO: 32008 - protein, 12 aa, Neisseria
EILGKQEEEETL

SEQ ID NO: 32009 - protein, 11 aa, Neisseria
MRQDVAEQIVR

SEQ ID NO: 32010 - protein, 14 aa, Neisseria
FRDGAHKMARVWVG

SEQ ID NO: 32011 - protein, 6 aa, Neisseria
RMAKMF

SEQ ID NO: 32012 - protein, 7 aa, Neisseria
FLKYPGE

SEQ ID NO: 32013 - protein, 11 aa, Neisseria
ELMEKCEHLIE

SEQ ID NO: 32014 - protein, 9 aa, Neisseria
PFRDGAHKM

SEQ ID NO: 32015 - protein, 8 aa, Neisseria
EHIPDRPS

SEQ ID NO: 32016 - protein, 7 aa, Neisseria
KHQSGWE

SEQ ID NO: 32017 - protein, 7 aa, Neisseria
VAKRELF

SEQ ID NO: 32018 - protein, 16 aa, Neisseria
IGIDRNNRREANEQLI

SEQ ID NO: 32019 - protein, 9 aa, Neisseria
GLARKNEGY

SEQ ID NO: 32020 - protein, 18 aa, Neisseria
PEGTRLAPGKRGKYKLGG

SEQ ID NO: 32021 - protein, 18 aa, Neisseria
NSGEFWPKNSFLKYPGEI

SEQ ID NO: 32022 - protein, 17 aa, Neisseria
HASGSEAELMEKCEHLI

SEQ ID NO: 32023 - protein, 5 aa, Neisseria
MPSET

SEQ ID NO: 32024 - protein, 9 aa, Neisseria
PFRDGAHKM

SEQ ID NO: 32025 - protein, 7 aa, Neisseria
HIPDRPS

SEQ ID NO: 32026 - protein, 7 aa, Neisseria
VAKRELF

SEQ ID NO: 32027 - protein, 16 aa, Neisseria
IGIDRNNRREANEQLI

SEQ ID NO: 32028 - protein, 7 aa, Neisseria
GLARKNE

SEQ ID NO: 32029 - protein, 17 aa, Neisseria
EGTRLAPGKRGKYKLGG

SEQ ID NO: 32030 - protein, 15 aa, Neisseria
SGSEAELMEKCEHLI

SEQ ID NO: 32031 - protein, 5 aa, Neisseria
MPSET

SEQ ID NO: 32032 - protein, 5 aa, Neisseria
RFSDG

SEQ ID NO: 32033 - protein, 8 aa, Neisseria
GLWVGLAA

SEQ ID NO: 32034 - protein, 9 aa, Neisseria
ASVIEEAGN

SEQ ID NO: 32035 - protein, 20 aa, Neisseria
QIDNQIAEFEKSLKRISQSD

SEQ ID NO: 32036 - protein, 8 aa, Neisseria
AYRRPTQI

SEQ ID NO: 32037 - protein, 16 aa, Neisseria
VIRPLQALREGAERIG

SEQ ID NO: 32038 - protein, 10 aa, Neisseria
FKQVGRCFNQ

SEQ ID NO: 32039 - protein, 7 aa, Neisseria
YDDLEGQ

SEQ ID NO: 32040 - protein, 8 aa, Neisseria
QTHNLEKQ

SEQ ID NO: 32041 - protein, 10 aa, Neisseria
RTTRDLHQSY

SEQ ID NO: 32042 - protein, 12 aa, Neisseria
QAAEEFLNHILP

SEQ ID NO: 32043 - protein, 8 aa, Neisseria
QTLIRQLG

SEQ ID NO: 32044 - protein, 12 aa, Neisseria
QGLHDSIAQALT

SEQ ID NO: 32045 - protein, 12 aa, Neisseria
GVQECYEDVREL

SEQ ID NO: 32046 - protein, 14 aa, Neisseria
KEFPEAVADLFARF

SEQ ID NO: 32047 - protein, 9 aa, Neisseria
LSNIRKHAR

SEQ ID NO: 32048 - protein, 8 aa, Neisseria
TEKIGEPT

SEQ ID NO: 32049 - protein, 9 aa, Neisseria
PTRFSDGIP

SEQ ID NO: 32050 - protein, 7 aa, Neisseria
VIEEAGN

SEQ ID NO: 32051 - protein, 31 aa, Neisseria
AGEGSPRAQIDNQIAEFEKSLKRISQSDAIH

SEQ ID NO: 32052 - protein, 8 aa, Neisseria
IPSDNPLA

SEQ ID NO: 32053 - protein, 14 aa, Neisseria
PPLQAYRRPTQIEL

SEQ ID NO: 32054 - protein, 10 aa, Neisseria
ENAGEKNTWW

SEQ ID NO: 32055 - protein, 35 aa, Neisseria
QALREGAERIGQRHFDIPVPEDGTPEFKQVGRCFN

SEQ ID NO: 32056 - protein, 24 aa, Neisseria
TLYDDLEGQVAEQTHNLEKQNRNL

SEQ ID NO: 32057 - protein, 19 aa, Neisseria
RTTRDLHQSYTPRQAAEEF

SEQ ID NO: 32058 - protein, 5 aa, Neisseria
AQSGN

SEQ ID NO: 32059 - protein, 10 aa, Neisseria
CLENGSDTDI

SEQ ID NO: 32060 - protein, 18 aa, Neisseria
TAEHGKKPPLEKYHDETF

SEQ ID NO: 32061 - protein, 7 aa, Neisseria
YQNEKLG

SEQ ID NO: 32062 - protein, 15 aa, Neisseria
GFSDGTSLTGDDRTL

SEQ ID NO: 32063 - protein, 10 aa, Neisseria
GAKQEEEKRL

SEQ ID NO: 32064 - protein, 6 aa, Neisseria
LQERNL

SEQ ID NO: 32065 - protein, 5 aa, Neisseria
LHDSI

SEQ ID NO: 32066 - protein, 12 aa, Neisseria
AFAENKREEAAE

SEQ ID NO: 32067 - protein, 11 aa, Neisseria
GVQECYEDVRE

SEQ ID NO: 32068 - protein, 13 aa, Neisseria
RTKISNKEFPEAV

SEQ ID NO: 32069 - protein, 5 aa, Neisseria
WENGS

SEQ ID NO: 32070 - protein, 7 aa, Neisseria
PTQDEQL

SEQ ID NO: 32071 - protein, 10 aa, Neisseria
SLSNIRKHAR

SEQ ID NO: 32072 - protein, 7 aa, Neisseria
SEYGGRF

SEQ ID NO: 32073 - protein, 20 aa, Neisseria
IQDNGQGFDTEKIGEPTGSH

SEQ ID NO: 32074 - protein, 10 aa, Neisseria
MQERAKRIRA

SEQ ID NO: 32075 - protein, 11 aa, Neisseria
LEIRSQAQQGT

SEQ ID NO: 32076 - protein, 9 aa, Neisseria
TGAPKESLP

SEQ ID NO: 32077 - protein, 7 aa, Neisseria
VIEEAGN

SEQ ID NO: 32078 - protein, 8 aa, Neisseria
EGSPRAQI

SEQ ID NO: 32079 - protein, 14 aa, Neisseria
QIAEFEKSLKRISQ

SEQ ID NO: 32080 - protein, 7 aa, Neisseria
AYRRPTQ

SEQ ID NO: 32081 - protein, 6 aa, Neisseria
ENAGEK

SEQ ID NO: 32082 - protein, 15 aa, Neisseria
QALREGAERIGQRHF

SEQ ID NO: 32083 - protein, 14 aa, Neisseria
PVPEDGTPEFKQVG

SEQ ID NO: 32084 - protein, 22 aa, Neisseria
TLYDDLEGQVAEQTHNLEKQNR

SEQ ID NO: 32085 - protein, 6 aa, Neisseria
TTRDLH

SEQ ID NO: 32086 - protein, 6 aa, Neisseria
QAAEEF

SEQ ID NO: 32087 - protein, 7 aa, Neisseria
NGSDTDI

SEQ ID NO: 32088 - protein, 16 aa, Neisseria
EHGKKPPLEKYHDETF

SEQ ID NO: 32089 - protein, 7 aa, Neisseria
YQNEKLG

SEQ ID NO: 32090 - protein, 10 aa, Neisseria
TSLTGDDRTL

SEQ ID NO: 32091 - protein, 10 aa, Neisseria
GAKQEEEKRL

SEQ ID NO: 32092 - protein, 6 aa, Neisseria
LQERNL

SEQ ID NO: 32093 - protein, 12 aa, Neisseria
AFAENKREEAAE

SEQ ID NO: 32094 - protein, 8 aa, Neisseria
ECYEDVRE

SEQ ID NO: 32095 - protein, 12 aa, Neisseria
TKISNKEFPEAV

SEQ ID NO: 32096 - protein, 6 aa, Neisseria
TQDEQL

SEQ ID NO: 32097 - protein, 10 aa, Neisseria
SLSNIRKHAR

SEQ ID NO: 32098 - protein, 16 aa, Neisseria
DNGQGFDTEKIGEPTG

SEQ ID NO: 32099 - protein, 10 aa, Neisseria
MQERAKRIRA

SEQ ID NO: 32100 - protein, 8 aa, Neisseria
LEIRSQAQ

SEQ ID NO: 32101 - protein, 8 aa, Neisseria
GAPKESLP

SEQ ID NO: 32102 - protein, 11 aa, Neisseria
WSLVSAWMVVI

SEQ ID NO: 32103 - protein, 12 aa, Neisseria
LETTVMSAVRTL

SEQ ID NO: 32104 - protein, 11 aa, Neisseria
FTPYTTVASTS

SEQ ID NO: 32105 - protein, 9 aa, Neisseria
TFFAPLSRW

SEQ ID NO: 32106 - protein, 16 aa, Neisseria
NAPVHSMTKSTPSSFH

SEQ ID NO: 32107 - protein, 9 aa, Neisseria
VSNLVRWAL

SEQ ID NO: 32108 - protein, 8 aa, Neisseria
FNSGKTKP

SEQ ID NO: 32109 - protein, 11 aa, Neisseria
PLRARRRSLWR

SEQ ID NO: 32110 - protein, 8 aa, Neisseria
ATGERQLV

SEQ ID NO: 32111 - protein, 10 aa, Neisseria
STSSPPGAEM

SEQ ID NO: 32112 - protein, 14 aa, Neisseria
MTKSTPSSFHGSSA

SEQ ID NO: 32113 - protein, 13 aa, Neisseria
LRVEKKGILSPLT

SEQ ID NO: 32114 - protein, 16 aa, Neisseria
RLPPSWDTSASKRPCT

SEQ ID NO: 32115 - protein, 6 aa, Neisseria
SGKTKP

SEQ ID NO: 32116 - protein, 9 aa, Neisseria
LRARRRSLW

SEQ ID NO: 32117 - protein, 8 aa, Neisseria
ATGERQLV

SEQ ID NO: 32118 - protein, 5 aa, Neisseria
PGAEM

SEQ ID NO: 32119 - protein, 5 aa, Neisseria
TKSTP

SEQ ID NO: 32120 - protein, 8 aa, Neisseria
LRVEKKGI

SEQ ID NO: 32121 - protein, 8 aa, Neisseria
SASKRPCT

SEQ ID NO: 32122 - protein, 8 aa, Neisseria
TKREGKSC

SEQ ID NO: 32123 - protein, 6 aa, Neisseria
NQYAQF

SEQ ID NO: 32124 - protein, 17 aa, Neisseria
VNQINSSHPSQLNGYIE

SEQ ID NO: 32125 - protein, 11 aa, Neisseria
AANVQDMNNTA

SEQ ID NO: 32126 - protein, 11 aa, Neisseria
IQNTGKLLSAG

SEQ ID NO: 32127 - protein, 6 aa, Neisseria
DNAVQG

SEQ ID NO: 32128 - protein, 7 aa, Neisseria
QMNNIGT

SEQ ID NO: 32129 - protein, 8 aa, Neisseria
AQRIHNAG

SEQ ID NO: 32130 - protein, 6 aa, Neisseria
LHNTNE

SEQ ID NO: 32131 - protein, 6 aa, Neisseria
YEAFGR

SEQ ID NO: 32132 - protein, 15 aa, Neisseria
SDHLRTPDGVAHENW

SEQ ID NO: 32133 - protein, 6 aa, Neisseria
TAPAKI

SEQ ID NO: 32134 - protein, 8 aa, Neisseria
GKLHNYWR

SEQ ID NO: 32135 - protein, 5 aa, Neisseria
EEITR

SEQ ID NO: 32136 - protein, 6 aa, Neisseria
SHSKAL

SEQ ID NO: 32137 - protein, 8 aa, Neisseria
PNSFTPLP

SEQ ID NO: 32138 - protein, 9 aa, Neisseria
LHKRLGDGY

SEQ ID NO: 32139 - protein, 17 aa, Neisseria
EQIAELTGHRRLDGYQN

SEQ ID NO: 32140 - protein, 5 aa, Neisseria
KALMD

SEQ ID NO: 32141 - protein, 7 aa, Neisseria
TLDNIGG

SEQ ID NO: 32142 - protein, 12 aa, Neisseria
ATQDINNIGGIL

SEQ ID NO: 32143 - protein, 5 aa, Neisseria
KSSQN

SEQ ID NO: 32144 - protein, 6 aa, Neisseria
QAGRDI

SEQ ID NO: 32145 - protein, 9 aa, Neisseria
GSTNEVGSS

SEQ ID NO: 32146 - protein, 10 aa, Neisseria
VDDASKHTGR

SEQ ID NO: 32147 - protein, 5 aa, Neisseria
SHHET

SEQ ID NO: 32148 - protein, 6 aa, Neisseria
QAGNHV

SEQ ID NO: 32149 - protein, 7 aa, Neisseria
QSETYHQ

SEQ ID NO: 32150 - protein, 5 aa, Neisseria
YEQTG

SEQ ID NO: 32151 - protein, 8 aa, Neisseria
STQSSKQV

SEQ ID NO: 32152 - protein, 16 aa, Neisseria
YQTGKGAQNLANGTTN

SEQ ID NO: 32153 - protein, 9 aa, Neisseria
EQSNTERSQ

SEQ ID NO: 32154 - protein, 8 aa, Neisseria
GGNVGKGY

SEQ ID NO: 32155 - protein, 8 aa, Neisseria
SDIQNYSQ

SEQ ID NO: 32156 - protein, 6 aa, Neisseria
LGQGAK

SEQ ID NO: 32157 - protein, 7 aa, Neisseria
INTPKNI

SEQ ID NO: 32158 - protein, 13 aa, Neisseria
TDTAERHSGSLKN

SEQ ID NO: 32159 - protein, 10 aa, Neisseria
VSQDFSKNVQ

SEQ ID NO: 32160 - protein, 13 aa, Neisseria
ILNMLASGLAEPT

SEQ ID NO: 32161 - protein, 9 aa, Neisseria
GQHFKDLAG

SEQ ID NO: 32162 - protein, 5 aa, Neisseria
PAGAL

SEQ ID NO: 32163 - protein, 10 aa, Neisseria
SAITRMLGTA

SEQ ID NO: 32164 - protein, 16 aa, Neisseria
FQTASDFASSFSYPIN

SEQ ID NO: 32165 - protein, 5 aa, Neisseria
MNKTL

SEQ ID NO: 32166 - protein, 9 aa, Neisseria
IFNRKRGAV

SEQ ID NO: 32167 - protein, 17 aa, Neisseria
ETTKREGKSCADSGSGS

SEQ ID NO: 32168 - protein, 5 aa, Neisseria
PTHSK

SEQ ID NO: 32169 - protein, 12 aa, Neisseria
IITDKAAPKTQQ

SEQ ID NO: 32170 - protein, 17 aa, Neisseria
VGNRGAILNNSRSNTQT

SEQ ID NO: 32171 - protein, 11 aa, Neisseria
NPWLTRGEARV

SEQ ID NO: 32172 - protein, 11 aa, Neisseria
INSSHPSQLNG

SEQ ID NO: 32173 - protein, 10 aa, Neisseria
IEVGGRRAEV

SEQ ID NO: 32174 - protein, 7 aa, Neisseria
NASRATL

SEQ ID NO: 32175 - protein, 21 aa, Neisseria
TGQPQYQAGDFSGFKIRQGNA

SEQ ID NO: 32176 - protein, 9 aa, Neisseria
GLDARDTDF

SEQ ID NO: 32177 - protein, 9 aa, Neisseria
AGIRNQGQL

SEQ ID NO: 32178 - protein, 8 aa, Neisseria
DANGRLVN

SEQ ID NO: 32179 - protein, 14 aa, Neisseria
QDMNNTAEHKVNIR

SEQ ID NO: 32180 - protein, 10 aa, Neisseria
QAFENSGTAV

SEQ ID NO: 32181 - protein, 7 aa, Neisseria
QQGTQIH

SEQ ID NO: 32182 - protein, 9 aa, Neisseria
QSIQNTGKL

SEQ ID NO: 32183 - protein, 9 aa, Neisseria
SAGTEDLAV

SEQ ID NO: 32184 - protein, 12 aa, Neisseria
SLNNQNGEIATN

SEQ ID NO: 32185 - protein, 8 aa, Neisseria
IIHDGQQS

SEQ ID NO: 32186 - protein, 14 aa, Neisseria
NTNGTIQSGRDVAI

SEQ ID NO: 32187 - protein, 19 aa, Neisseria
KSLSNNGTLAADNKLDIAL

SEQ ID NO: 32188 - protein, 15 aa, Neisseria
DDFYVERKIVAGNEL

SEQ ID NO: 32189 - protein, 12 aa, Neisseria
LSTRGSLKNSHT

SEQ ID NO: 32190 - protein, 15 aa, Neisseria
QAGKRIRIKANNLDN

SEQ ID NO: 32191 - protein, 30 aa, Neisseria
NIQSGGTTDIGTQHNLTNRGLIDGQQTKIQ

SEQ ID NO: 32192 - protein, 13 aa, Neisseria
ATRLDNQDENGTG

SEQ ID NO: 32193 - protein, 6 aa, Neisseria
AARENL

SEQ ID NO: 32194 - protein, 9 aa, Neisseria
QLNNRENSL

SEQ ID NO: 32195 - protein, 21 aa, Neisseria
GALDTNDQATGKAQRIHNAGA

SEQ ID NO: 32196 - protein, 20 aa, Neisseria
AAGKMRLGVEKLHNTNEHLK

SEQ ID NO: 32197 - protein, 9 aa, Neisseria
ETGRERIVD

SEQ ID NO: 32198 - protein, 9 aa, Neisseria
ELLREGTQH

SEQ ID NO: 32199 - protein, 16 aa, Neisseria
YNNESDHLRTPDGVAH

SEQ ID NO: 32200 - protein, 14 aa, Neisseria
HKYDYEKVTQETQV

SEQ ID NO: 32201 - protein, 19 aa, Neisseria
AGSDLIIDSKAVFNSDSRI

SEQ ID NO: 32202 - protein, 27 aa, Neisseria
QTEKDGLHNEQTFGEKKVFSENGKLHN

SEQ ID NO: 32203 - protein, 30 aa, Neisseria
WRARRKGHDETGHREQNYTLPEEITRDISL

SEQ ID NO: 32204 - protein, 34 aa, Neisseria
ESHSKALSRHAPSQGTELPQSNRDNIRTAKSNGI

SEQ ID NO: 32205 - protein, 16 aa, Neisseria
PANKGYLVETDPRFAN

SEQ ID NO: 32206 - protein, 23 aa, Neisseria
LKLDPNNLHKRLGDGYYEQRLIN

SEQ ID NO: 32207 - protein, 31 aa, Neisseria
TGHRRLDGYQNDEEQFKALMDNGATAARSMN

SEQ ID NO: 32208 - protein, 5 aa, Neisseria
AEQAA

SEQ ID NO: 32209 - protein, 10 aa, Neisseria
KEVKLPDGGT

SEQ ID NO: 32210 - protein, 10 aa, Neisseria
VKNGGIDGKG

SEQ ID NO: 32211 - protein, 14 aa, Neisseria
GSLKNSGTIAGRNA

SEQ ID NO: 32212 - protein, 10 aa, Neisseria
NTDTLDNIGG

SEQ ID NO: 32213 - protein, 8 aa, Neisseria
IHAQKSAV

SEQ ID NO: 32214 - protein, 20 aa, Neisseria
AGNNINNQSTAKSSQNAQGS

SEQ ID NO: 32215 - protein, 7 aa, Neisseria
TGKEKGV

SEQ ID NO: 32216 - protein, 7 aa, Neisseria
AGKDINI

SEQ ID NO: 32217 - protein, 57 aa, Neisseria
ISNQSDQGQTRLQAGRDINLDTVQTGKYQEIHFDADNHTIRGSTNEVGSSIQTKGDV

SEQ ID NO: 32218 - protein, 17 aa, Neisseria
GNNLNAKAAEVGSAKGT

SEQ ID NO: 32219 - protein, 8 aa, Neisseria
YAKNDITI

SEQ ID NO: 32220 - protein, 17 aa, Neisseria
QVDDASKHTGRSGGGNK

SEQ ID NO: 32221 - protein, 22 aa, Neisseria
VITDKAQSHHETAQSSTFEGKQ

SEQ ID NO: 32222 - protein, 7 aa, Neisseria
QAGNDAN

SEQ ID NO: 32223 - protein, 11 aa, Neisseria
VISDNGTRIQA

SEQ ID NO: 32224 - protein, 20 aa, Neisseria
GTTQTQSQSETYHQTQKSGL

SEQ ID NO: 32225 - protein, 30 aa, Neisseria; identical to SEQ ID NO: 6264

SEQ ID NO: 32226 - protein, 18 aa, Neisseria
KHYEQTGSNVSSPEGNNL

SEQ ID NO: 32227 - protein, 16 aa, Neisseria
NQLNSKTTQTYEQKGL

SEQ ID NO: 32228 - protein, 27 aa, Neisseria
RFGTTSDCRSTQSSKQVGQSKNDRVNA

SEQ ID NO: 32229 - protein, 19 aa, Neisseria
AYQTGKGAQNLANGTTNAK

SEQ ID NO: 32230 - protein, 11 aa, Neisseria
YGEQQNRQTTQ

SEQ ID NO: 32231 - protein, 9 aa, Neisseria
SQIQAGGKT

SEQ ID NO: 32232 - protein, 11 aa, Neisseria
LYCRRCGEQSN

SEQ ID NO: 32233 - protein, 8 aa, Neisseria
GVSGRAGT

SEQ ID NO: 32234 - protein, 7 aa, Neisseria
LIADKQI

SEQ ID NO: 32235 - protein, 18 aa, Neisseria
SAEQSNTERSQNKSAGWN

SEQ ID NO: 32236 - protein, 26 aa, Neisseria
GNVGKGYGYGDSVTHRHSHIGDKGSQ

SEQ ID NO: 32237 - protein, 8 aa, Neisseria
QSGGDTII

SEQ ID NO: 32238 - protein, 14 aa, Neisseria
AQVRGKGVQVNAKN

SEQ ID NO: 32239 - protein, 17 aa, Neisseria
SVQDRETYQSKQQNAGA

SEQ ID NO: 32240 - protein, 14 aa, Neisseria
ASGDYSQSKIRADH

SEQ ID NO: 32241 - protein, 16 aa, Neisseria
SVTEQSGIYAGEDGYQ

SEQ ID NO: 32242 - protein, 10 aa, Neisseria
GNHTGLKGGI

SEQ ID NO: 32243 - protein, 34 aa, Neisseria
SQSAKDKGKNRFSTGTLAGSDIQNYSQYEGKSFG

SEQ ID NO: 32244 - protein, 19 aa, Neisseria
VSGKTLGQGAKNKPQDKHL

SEQ ID NO: 32245 - protein, 9 aa, Neisseria
IADKNGASS

SEQ ID NO: 32246 - protein, 31 aa, Neisseria
GYGSDSDSQSSITKSGINTPKNIQITDEAAQ

SEQ ID NO: 32247 - protein, 63 aa, Neisseria
LTGKIAAQTKADIDTNVTTDTAERHSGSLKNIFDKDRVQSELDLQRTVSQDFSKNVQQTNTEI

SEQ ID NO: 32248 - protein, 17 aa, Neisseria
QHLDKLKADKEAAETAA

SEQ ID NO: 32249 - protein, 27 aa, Neisseria
ANGDMETAKRKAHEAQDAAAKADNWQQ

SEQ ID NO: 32250 - protein, 10 aa, Neisseria
SGLAEPTQSG

SEQ ID NO: 32251 - protein, 7 aa, Neisseria
TASPDVS

SEQ ID NO: 32252 - protein, 20 aa, Neisseria
HFKDLAGQNANGKLTASQET

SEQ ID NO: 32253 - protein, 6 aa, Neisseria
  VARIANT 1: Xaa is any amino acid
XGNNAP

SEQ ID NO: 32254 - protein, 8 aa, Neisseria
GAGGSEAA

SEQ ID NO: 32255 - protein, 18 aa, Neisseria
LYGKGDGGSLNAEEKETV

SEQ ID NO: 32256 - protein, 11 aa, Neisseria
GAAEGNSSADA

SEQ ID NO: 32257 - protein, 11 aa, Neisseria
TASDFASSFSY

SEQ ID NO: 32258 - protein, 7 aa, Neisseria
FNRKRGA

SEQ ID NO: 32259 - protein, 15 aa, Neisseria
ETTKREGKSCADSGS

SEQ ID NO: 32260 - protein, 12 aa, Neisseria
IITDKAAPKTQQ

SEQ ID NO: 32261 - protein, 6 aa, Neisseria
NSRSNT

SEQ ID NO: 32262 - protein, 5 aa, Neisseria
GEARV

SEQ ID NO: 32263 - protein, 8 aa, Neisseria
VGGRRAEV

SEQ ID NO: 32264 - protein, 8 aa, Neisseria
LDARDTDF

SEQ ID NO: 32265 - protein, 5 aa, Neisseria
AGIRN

SEQ ID NO: 32266 - protein, 13 aa, Neisseria
QDMNNTAEHKVNI

SEQ ID NO: 32267 - protein, 7 aa, Neisseria
QAFENSG

SEQ ID NO: 32268 - protein, 6 aa, Neisseria
GTEDLA

SEQ ID NO: 32269 - protein, 7 aa, Neisseria
QNGEIAT

SEQ ID NO: 32270 - protein, 8 aa, Neisseria
QSGRDVAI

SEQ ID NO: 32271 - protein, 11 aa, Neisseria
LAADNKLDIAL

SEQ ID NO: 32272 - protein, 9 aa, Neisseria
FYVERKIVA

SEQ ID NO: 32273 - protein, 5 aa, Neisseria
GSLKN

SEQ ID NO: 32274 - protein, 13 aa, Neisseria
QAGKRIRIKANNL

SEQ ID NO: 32275 - protein, 7 aa, Neisseria
GTTDIGT

SEQ ID NO: 32276 - protein, 6 aa, Neisseria
QQTKIQ

SEQ ID NO: 32277 - protein, 11 aa, Neisseria
TRLDNQDENGT

SEQ ID NO: 32278 - protein, 6 aa, Neisseria
AARENL

SEQ ID NO: 32279 - protein, 8 aa, Neisseria
QLNNRENS

SEQ ID NO: 32280 - protein, 15 aa, Neisseria
LDTNDQATGKAQRIH

SEQ ID NO: 32281 - protein, 20 aa, Neisseria
AAGKMRLGVEKLHNTNEHLK

SEQ ID NO: 32282 - protein, 9 aa, Neisseria
ETGRERIVD

SEQ ID NO: 32283 - protein, 9 aa, Neisseria
ELLREGTQH

SEQ ID NO: 32284 - protein, 13 aa, Neisseria
NESDHLRTPDGVA

SEQ ID NO: 32285 - protein, 8 aa, Neisseria
YDYEKVTQ

SEQ ID NO: 32286 - protein, 7 aa, Neisseria
LIIDSKA

SEQ ID NO: 32287 - protein, 5 aa, Neisseria
SDSRI

SEQ ID NO: 32288 - protein, 9 aa, Neisseria
QTEKDGLHN

SEQ ID NO: 32289 - protein, 14 aa, Neisseria
QTFGEKKVFSENGK

SEQ ID NO: 32290 - protein, 16 aa, Neisseria
RARRKGHDETGHREQN

SEQ ID NO: 32291 - protein, 8 aa, Neisseria
EEITRDIS

SEQ ID NO: 32292 - protein, 11 aa, Neisseria
SHSKALSRHAP

SEQ ID NO: 32293 - protein, 20 aa, Neisseria
QGTELPQSNRDNIRTAKSNG

SEQ ID NO: 32294 - protein, 11 aa, Neisseria
YLVETDPRFAN

SEQ ID NO: 32295 - protein, 5 aa, Neisseria
LKLDP

SEQ ID NO: 32296 - protein, 7 aa, Neisseria
NLHKRLG

SEQ ID NO: 32297 - protein, 20 aa, Neisseria
TGHRRLDGYQNDEEQFKALM

SEQ ID NO: 32298 - protein, 6 aa, Neisseria
GATAAR

SEQ ID NO: 32299 - protein, 5 aa, Neisseria
AEQAA

SEQ ID NO: 32300 - protein, 10 aa, Neisseria
KEVKLPDGGT

SEQ ID NO: 32301 - protein, 10 aa, Neisseria
VKNGGIDGKG

SEQ ID NO: 32302 - protein, 5 aa, Neisseria
GSLKN

SEQ ID NO: 32303 - protein, 8 aa, Neisseria
IHAQKSAV

SEQ ID NO: 32304 - protein, 11 aa, Neisseria
STAKSSQNAQG

SEQ ID NO: 32305 - protein, 6 aa, Neisseria
GKEKGV

SEQ ID NO: 32306 - protein, 6 aa, Neisseria
AGKDIN

SEQ ID NO: 32307 - protein, 18 aa, Neisseria
NQSDQGQTRLQAGRDINL

SEQ ID NO: 32308 - protein, 18 aa, Neisseria
HFDADNHTIRGSTNEVGS

SEQ ID NO: 32309 - protein, 7 aa, Neisseria
IQTKGDV

SEQ ID NO: 32310 - protein, 13 aa, Neisseria
LNAKAAEVGSAKG

SEQ ID NO: 32311 - protein, 5 aa, Neisseria
AKNDI

SEQ ID NO: 32312 - protein, 15 aa, Neisseria
QVDDASKHTGRSGGG

SEQ ID NO: 32313 - protein, 14 aa, Neisseria
VITDKAQSHHETAQ

SEQ ID NO: 32314 - protein, 7 aa, Neisseria
STFEGKQ

SEQ ID NO: 32315 - protein, 7 aa, Neisseria
NGTRIQA

SEQ ID NO: 32316 - protein, 6 aa, Neisseria
QSQSET

SEQ ID NO: 32317 - protein, 6 aa, Neisseria
TQKSGL

SEQ ID NO: 32318 - protein, 17 aa, Neisseria
SKTNTQENQSQSNEHTG

SEQ ID NO: 32319 - protein, 5 aa, Neisseria
LKGDT

SEQ ID NO: 32320 - protein, 7 aa, Neisseria
KHYEQTG

SEQ ID NO: 32321 - protein, 5 aa, Neisseria
SSPEG

SEQ ID NO: 32322 - protein, 7 aa, Neisseria
LNSKTTQ

SEQ ID NO: 32323 - protein, 5 aa, Neisseria
YEQKG

SEQ ID NO: 32324 - protein, 21 aa, Neisseria
SDCRSTQSSKQVGQSKNDRVN

SEQ ID NO: 32325 - protein, 7 aa, Neisseria
QTGKGAQ

SEQ ID NO: 32326 - protein, 8 aa, Neisseria
EQQNRQTT

SEQ ID NO: 32327 - protein, 7 aa, Neisseria
RCGEQSN

SEQ ID NO: 32328 - protein, 6 aa, Neisseria
VSGRAG

SEQ ID NO: 32329 - protein, 6 aa, Neisseria
IADKQI

SEQ ID NO: 32330 - protein, 13 aa, Neisseria
SAEQSNTERSQNK

SEQ ID NO: 32331 - protein, 8 aa, Neisseria
SHIGDKGS

SEQ ID NO: 32332 - protein, 8 aa, Neisseria
AQVRGKGV

SEQ ID NO: 32333 - protein, 14 aa, Neisseria
SVQDRETYQSKQQN

SEQ ID NO: 32334 - protein, 12 aa, Neisseria
GDYSQSKIRADH

SEQ ID NO: 32335 - protein, 7 aa, Neisseria
AGEDGYQ

SEQ ID NO: 32336 - protein, 12 aa, Neisseria
QSAKDKGKNRFS

SEQ ID NO: 32337 - protein, 5 aa, Neisseria
YEGKS

SEQ ID NO: 32338 - protein, 15 aa, Neisseria
TLGQGAKNKPQDKHL

SEQ ID NO: 32339 - protein, 7 aa, Neisseria
IADKNGA

SEQ ID NO: 32340 - protein, 10 aa, Neisseria
SDSDSQSSIT

SEQ ID NO: 32341 - protein, 8 aa, Neisseria
QITDEAAQ

SEQ ID NO: 32342 - protein, 7 aa, Neisseria
TKADIDT

SEQ ID NO: 32343 - protein, 13 aa, Neisseria
VTTDTAERHSGSL

SEQ ID NO: 32344 - protein, 19 aa, Neisseria
NIFDKDRVQSELDLQRTVS

SEQ ID NO: 32345 - protein, 5 aa, Neisseria
TNTEI

SEQ ID NO: 32346 - protein, 17 aa, Neisseria
QHLDKLKADKEAAETAA

SEQ ID NO: 32347 - protein, 22 aa, Neisseria
GDMETAKRKAHEAQDAAAKADN

SEQ ID NO: 32348 - protein, 6 aa, Neisseria
LAEPTQ

SEQ ID NO: 32349 - protein, 7 aa, Neisseria
HFKDLAG

SEQ ID NO: 32350 - protein, 11 aa, Neisseria
ANGKLTASQET

SEQ ID NO: 32351 - protein, 6 aa, Neisseria
GGSEAA

SEQ ID NO: 32352 - protein, 15 aa, Neisseria
KGDGGSLNAEEKETV

SEQ ID NO: 32353 - protein, 9 aa, Neisseria
GAAEGNSSA

SEQ ID NO: 32354 - protein, 10 aa, Neisseria
ATCTRAMSKS

SEQ ID NO: 32355 - protein, 5 aa, Neisseria
SSWAR

SEQ ID NO: 32356 - protein, 9 aa, Neisseria
DFMSQLDLT

SEQ ID NO: 32357 - protein, 21 aa, Neisseria
CSNSGETISSCPAMASITKPN

SEQ ID NO: 32358 - protein, 9 aa, Neisseria
ANTTNAFNT

SEQ ID NO: 32359 - protein, 9 aa, Neisseria
MDSTLSKTC

SEQ ID NO: 32360 - protein, 13 aa, Neisseria
FARPRPAASNTSL

SEQ ID NO: 32361 - protein, 9 aa, Neisseria
FASPNDTGS

SEQ ID NO: 32362 - protein, 10 aa, Neisseria
AMSKSSAKYG

SEQ ID NO: 32363 - protein, 18 aa, Neisseria
SWARTRPTVCPPLPKPTI

SEQ ID NO: 32364 - protein, 5 aa, Neisseria
  VARIANT 2: Xaa is any amino acid
TXSDL

SEQ ID NO: 32365 - protein, 10 aa, Neisseria
MLCRSSDFMS

SEQ ID NO: 32366 - protein, 19 aa, Neisseria
DLTKRPTSASLPPKRKGAI

SEQ ID NO: 32367 - protein, 7 aa, Neisseria
IDSRTAA

SEQ ID NO: 32368 - protein, 9 aa, Neisseria
CSNSGETIS

SEQ ID NO: 32369 - protein, 12 aa, Neisseria
ITKPNSPPCARY

SEQ ID NO: 32370 - protein, 7 aa, Neisseria
LRLSPTE

SEQ ID NO: 32371 - protein, 13 aa, Neisseria
SIANSINTCRQPP

SEQ ID NO: 32372 - protein, 7 aa, Neisseria
ARPRPAA

SEQ ID NO: 32373 - protein, 7 aa, Neisseria
SPNDTGS

SEQ ID NO: 32374 - protein, 7 aa, Neisseria
AMSKSSA

SEQ ID NO: 32375 - protein, 5 aa, Neisseria
ARTRP

SEQ ID NO: 32376 - protein, 5 aa, Neisseria
RSSDF

SEQ ID NO: 32377 - protein, 8 aa, Neisseria
DLTKRPTS

SEQ ID NO: 32378 - protein, 9 aa, Neisseria
LPPKRKGAI

SEQ ID NO: 32379 - protein, 5 aa, Neisseria
IDSRT

SEQ ID NO: 32380 - protein, 7 aa, Neisseria
NSGETIS

SEQ ID NO: 32381 - protein, 5 aa, Neisseria
TKPNS

SEQ ID NO: 32382 - protein, 9 aa, Neisseria
GFVGDFHAF

SEQ ID NO: 32383 - protein, 14 aa, Neisseria
PNCGADGTGGKGHA

SEQ ID NO: 32384 - protein, 9 aa, Neisseria
AVGGEEGGV

SEQ ID NO: 32385 - protein, 13 aa, Neisseria
ADGGKADGGRIAR

SEQ ID NO: 32386 - protein, 10 aa, Neisseria
AAERAGDDFA

SEQ ID NO: 32387 - protein, 11 aa, Neisseria
GADGTGGKGHA

SEQ ID NO: 32388 - protein, 7 aa, Neisseria
GGEEGGV

SEQ ID NO: 32389 - protein, 12 aa, Neisseria
DGGKADGGRIAR

SEQ ID NO: 32390 - protein, 10 aa, Neisseria
AAERAGDDFA

SEQ ID NO: 32391 - protein, 10 aa, Neisseria
ELVQEIAREV

SEQ ID NO: 32392 - protein, 5 aa, Neisseria
ALKAV

SEQ ID NO: 32393 - protein, 18 aa, Neisseria
YALEGISDLIATVRKIRQ

SEQ ID NO: 32394 - protein, 5 aa, Neisseria
TGIVR

SEQ ID NO: 32395 - protein, 15 aa, Neisseria
AEVSEQLRSHFGDLL

SEQ ID NO: 32396 - protein, 8 aa, Neisseria
IPRNIRLA

SEQ ID NO: 32397 - protein, 17 aa, Neisseria
MRRRAAASTRRVCSPAF

SEQ ID NO: 32398 - protein, 16 aa, Neisseria
MRTCSRRRYAAKRADT

SEQ ID NO: 32399 - protein, 5 aa, Neisseria
AEIEL

SEQ ID NO: 32400 - protein, 13 aa, Neisseria
QEIAREVRLKNAL

SEQ ID NO: 32401 - protein, 7 aa, Neisseria
AVAEDYD

SEQ ID NO: 32402 - protein, 5 aa, Neisseria
CPPSL

SEQ ID NO: 32403 - protein, 13 aa, Neisseria
RKIRQAVNPDLDI

SEQ ID NO: 32404 - protein, 24 aa, Neisseria
TMYDSRSRLVAEVSEQLRSHFGDL

SEQ ID NO: 32405 - protein, 15 aa, Neisseria
AIPRNIRLAEAPSHG

SEQ ID NO: 32406 - protein, 7 aa, Neisseria
AQAKGAK

SEQ ID NO: 32407 - protein, 10 aa, Neisseria
DELAARVSGK

SEQ ID NO: 32408 - protein, 13 aa, Neisseria
MRRRAAASTRRVC

SEQ ID NO: 32409 - protein, 14 aa, Neisseria
TCSRRRYAAKRADT

SEQ ID NO: 32410 - protein, 5 aa, Neisseria
AEIEL

SEQ ID NO: 32411 - protein, 13 aa, Neisseria
QEIAREVRLKNAL

SEQ ID NO: 32412 - protein, 7 aa, Neisseria
AVAEDYD

SEQ ID NO: 32413 - protein, 5 aa, Neisseria
RKIRQ

SEQ ID NO: 32414 - protein, 5 aa, Neisseria
PDLDI

SEQ ID NO: 32415 - protein, 17 aa, Neisseria
MYDSRSRLVAEVSEQLR

SEQ ID NO: 32416 - protein, 7 aa, Neisseria
RNIRLAE

SEQ ID NO: 32417 - protein, 7 aa, Neisseria
AQAKGAK

SEQ ID NO: 32418 - protein, 5 aa, Neisseria
DELAA

SEQ ID NO: 32419 - protein, 6 aa, Neisseria
NIFRRI

SEQ ID NO: 32420 - protein, 5 aa, Neisseria
KACKN

SEQ ID NO: 32421 - protein, 8 aa, Neisseria
EKANTVRY

SEQ ID NO: 32422 - protein, 7 aa, Neisseria
SLAQCFT

SEQ ID NO: 32423 - protein, 9 aa, Neisseria
RPLPSIITA

SEQ ID NO: 32424 - protein, 5 aa, Neisseria
  VARIANT 2: Xaa is any amino acid
PXDLN

SEQ ID NO: 32425 - protein, 10 aa, Neisseria
LVGQFLNRLF

SEQ ID NO: 32426 - protein, 8 aa, Neisseria
EEFFDVVV

SEQ ID NO: 32427 - protein, 10 aa, Neisseria
DFNQVFAAFL

SEQ ID NO: 32428 - protein, 16 aa, Neisseria
HRHADQIADSCRVQSQ

SEQ ID NO: 32429 - protein, 8 aa, Neisseria
KASASSIP

SEQ ID NO: 32430 - protein, 14 aa, Neisseria
RICRLKRSRLPNIF

SEQ ID NO: 32431 - protein, 37 aa, Neisseria; identical to SEQ ID NO: 6797

SEQ ID NO: 32432 - protein, 8 aa, Neisseria
SNASKPRL

SEQ ID NO: 32433 - protein, 9 aa, Neisseria
IRGRKRFFA

SEQ ID NO: 32434 - protein, 19 aa, Neisseria
  VARIANT 15: Xaa is any amino acid
FRGSAFKCRLNAAPXDLNR

SEQ ID NO: 32435 - protein, 5 aa, Neisseria
GSQNL

SEQ ID NO: 32436 - protein, 7 aa, Neisseria
VADRDAS

SEQ ID NO: 32437 - protein, 20 aa, Neisseria
GQHGHRHADQIADSCRVQSQ

SEQ ID NO: 32438 - protein, 10 aa, Neisseria
RICRLKRSRL

SEQ ID NO: 32439 - protein, 7 aa, Neisseria
CRRRTCF

SEQ ID NO: 32440 - protein, 27 aa, Neisseria
KACKNSPIRNETSSSGRRQFSVEKANT

SEQ ID NO: 32441 - protein, 6 aa, Neisseria
ASKPRL

SEQ ID NO: 32442 - protein, 9 aa, Neisseria
IRGRKRFFA

SEQ ID NO: 32443 - protein, 7 aa, Neisseria
SAFKCRL

SEQ ID NO: 32444 - protein, 8 aa, Neisseria
  VARIANT 4: Xaa is any amino acid
AAPXDLNR

SEQ ID NO: 32445 - protein, 7 aa, Neisseria
VADRDAS

SEQ ID NO: 32446 - protein, 15 aa, Neisseria
HGHRHADQIADSCRV

SEQ ID NO: 32447 - protein, 23 aa, Neisseria
AAFCGLIALTALWEYARMAGLCK

SEQ ID NO: 32448 - protein, 7 aa, Neisseria
FWLAVMP

SEQ ID NO: 32449 - protein, 15 aa, Neisseria
IARAISPGKSWEGAI

SEQ ID NO: 32450 - protein, 6 aa, Neisseria
TVLIGL

SEQ ID NO: 32451 - protein, 16 aa, Neisseria
LTVVSVCGDLLESWLK

SEQ ID NO: 32452 - protein, 7 aa, Neisseria
CKTETNH

SEQ ID NO: 32453 - protein, 8 aa, Neisseria
KWRLNGGW

SEQ ID NO: 32454 - protein, 10 aa, Neisseria
SLRPHPDDAL

SEQ ID NO: 32455 - protein, 10 aa, Neisseria
KALGKHKIAR

SEQ ID NO: 32456 - protein, 8 aa, Neisseria
ISPGKSWE

SEQ ID NO: 32457 - protein, 14 aa, Neisseria
AAGIKDSSNLLPGH

SEQ ID NO: 32458 - protein, 8 aa, Neisseria
GVFDRTDS

SEQ ID NO: 32459 - protein, 5 aa, Neisseria
CKTET

SEQ ID NO: 32460 - protein, 7 aa, Neisseria
PHPDDAL

SEQ ID NO: 32461 - protein, 9 aa, Neisseria
ALGKHKIAR

SEQ ID NO: 32462 - protein, 9 aa, Neisseria
AAGIKDSSN

SEQ ID NO: 32463 - protein, 7 aa, Neisseria
VFDRTDS

SEQ ID NO: 32464 - protein, 10 aa, Neisseria
RAFAAALIGL

SEQ ID NO: 32465 - protein, 12 aa, Neisseria
HADTFQKIGFIN

SEQ ID NO: 32466 - protein, 11 aa, Neisseria
QARNIQKTLDG

SEQ ID NO: 32467 - protein, 7 aa, Neisseria
DELQKLQ

SEQ ID NO: 32468 - protein, 6 aa, Neisseria
LKDAKK

SEQ ID NO: 32469 - protein, 11 aa, Neisseria
EKWRGLVEAFR

SEQ ID NO: 32470 - protein, 12 aa, Neisseria
LQQNANRVIVKI

SEQ ID NO: 32471 - protein, 63 aa, Neisseria
NTERIYLESKQARNIQKTLDGEFSARQDELQKLQREGLDLERQLAGGKLKDAKKAQAEEKWRG

SEQ ID NO: 32472 - protein, 22 aa, Neisseria
AFRKKQAQFEEDYNLRRNEEFA

SEQ ID NO: 32473 - protein, 7 aa, Neisseria
QQNANRV

SEQ ID NO: 32474 - protein, 10 aa, Neisseria
IAKQEGYDVI

SEQ ID NO: 32475 - protein, 17 aa, Neisseria
NTQYDVTDSVIKEMNAR

SEQ ID NO: 32476 - protein, 41 aa, Neisseria
IYLESKQARNIQKTLDGEFSARQDELQKLQREGLDLERQLA

SEQ ID NO: 32477 - protein, 17 aa, Neisseria
GKLKDAKKAQAEEKWRG

SEQ ID NO: 32478 - protein, 22 aa, Neisseria
AFRKKQAQFEEDYNLRRNEEFA

SEQ ID NO: 32479 - protein, 7 aa, Neisseria
IAKQEGY

SEQ ID NO: 32480 - protein, 13 aa, Neisseria
DVTDSVIKEMNAR

SEQ ID NO: 32481 - protein, 13 aa, Neisseria
VVTVFGGGIGSAV

SEQ ID NO: 32482 - protein, 9 aa, Neisseria
AAVADFFAV

SEQ ID NO: 32483 - protein, 6 aa, Neisseria
VEVFKE

SEQ ID NO: 32484 - protein, 7 aa, Neisseria
KQAQADG

SEQ ID NO: 32485 - protein, 14 aa, Neisseria
FRTGHREEQLGGDV

SEQ ID NO: 32486 - protein, 6 aa, Neisseria
RAERAA

SEQ ID NO: 32487 - protein, 7 aa, Neisseria
VFKEGDF

SEQ ID NO: 32488 - protein, 15 aa, Neisseria
RNADFAAEHQREGFA

SEQ ID NO: 32489 - protein, 6 aa, Neisseria
KQAQAD

SEQ ID NO: 32490 - protein, 9 aa, Neisseria
TGHREEQLG

SEQ ID NO: 32491 - protein, 6 aa, Neisseria
RAERAA

SEQ ID NO: 32492 - protein, 7 aa, Neisseria
VFKEGDF

SEQ ID NO: 32493 - protein, 15 aa, Neisseria
RNADFAAEHQREGFA

SEQ ID NO: 32494 - protein, 6 aa, Neisseria
LPSALA

SEQ ID NO: 32495 - protein, 12 aa, Neisseria
QVLPRDYTDRLN

SEQ ID NO: 32496 - protein, 8 aa, Neisseria
STFDSITP

SEQ ID NO: 32497 - protein, 6 aa, Neisseria
IHSMVR

SEQ ID NO: 32498 - protein, 9 aa, Neisseria
GLPERIDSG

SEQ ID NO: 32499 - protein, 5 aa, Neisseria
LSALT

SEQ ID NO: 32500 - protein, 5 aa, Neisseria
QKGKT

SEQ ID NO: 32501 - protein, 6 aa, Neisseria
ANKETL

SEQ ID NO: 32502 - protein, 6 aa, Neisseria
TARANG

SEQ ID NO: 32503 - protein, 6 aa, Neisseria
PVDSEH

SEQ ID NO: 32504 - protein, 15 aa, Neisseria
LPRDYTDRLNEHGID

SEQ ID NO: 32505 - protein, 24 aa, Neisseria
DSITPEQAVKHPNWRMGRKISVDS

SEQ ID NO: 32506 - protein, 9 aa, Neisseria
TMANKGLEL

SEQ ID NO: 32507 - protein, 9 aa, Neisseria
NCPPDKLEV

SEQ ID NO: 32508 - protein, 8 aa, Neisseria
VRYRDGSV

SEQ ID NO: 32509 - protein, 7 aa, Neisseria
GNPDMRT

SEQ ID NO: 32510 - protein, 13 aa, Neisseria
LPERIDSGVGKLD

SEQ ID NO: 32511 - protein, 8 aa, Neisseria
FQKPDFGR

SEQ ID NO: 32512 - protein, 5 aa, Neisseria
NAGGA

SEQ ID NO: 32513 - protein, 5 aa, Neisseria
NKETL

SEQ ID NO: 32514 - protein, 6 aa, Neisseria
TARANG

SEQ ID NO: 32515 - protein, 5 aa, Neisseria
VDSEH

SEQ ID NO: 32516 - protein, 11 aa, Neisseria
DYTDRLNEHGI

SEQ ID NO: 32517 - protein, 8 aa, Neisseria
RMGRKISV

SEQ ID NO: 32518 - protein, 5 aa, Neisseria
KGLEL

SEQ ID NO: 32519 - protein, 6 aa, Neisseria
PPDKLE

SEQ ID NO: 32520 - protein, 7 aa, Neisseria
VRYRDGS

SEQ ID NO: 32521 - protein, 7 aa, Neisseria
GNPDMRT

SEQ ID NO: 32522 - protein, 13 aa, Neisseria
LPERIDSGVGKLD

SEQ ID NO: 32523 - protein, 6 aa, Neisseria
QKPDFG

SEQ ID NO: 32524 - protein, 6 aa, Neisseria
PNSLKK

SEQ ID NO: 32525 - protein, 35 aa, Neisseria; identical to SEQ ID NO: 6914

SEQ ID NO: 32526 - protein, 6 aa, Neisseria
GKLYRQ

SEQ ID NO: 32527 - protein, 7 aa, Neisseria
MLDSPDT

SEQ ID NO: 32528 - protein, 5 aa, Neisseria
EKAVE

SEQ ID NO: 32529 - protein, 12 aa, Neisseria
NVGKALEANKKC

SEQ ID NO: 32530 - protein, 12 aa, Neisseria
FPAAVEAYAAIE

SEQ ID NO: 32531 - protein, 11 aa, Neisseria
MVGEKLYEAYA

SEQ ID NO: 32532 - protein, 20 aa, Neisseria
PEEGLNRLTGYMQTFPELDL

SEQ ID NO: 32533 - protein, 5 aa, Neisseria
NGVYR

SEQ ID NO: 32534 - protein, 11 aa, Neisseria
RSVIGRQLQRS

SEQ ID NO: 32535 - protein, 10 aa, Neisseria
NSLKKADMDN

SEQ ID NO: 32536 - protein, 44 aa, Neisseria; identical to SEQ ID NO: 6925

SEQ ID NO: 32537 - protein, 32 aa, Neisseria; identical to SEQ ID NO: 6926

SEQ ID NO: 32538 - protein, 11 aa, Neisseria
YQSAGLVDRAE

SEQ ID NO: 32539 - protein, 12 aa, Neisseria
LQDGEMAREARQ

SEQ ID NO: 32540 - protein, 12 aa, Neisseria
YQQDRDWEKAVE

SEQ ID NO: 32541 - protein, 7 aa, Neisseria
SHDEQTY

SEQ ID NO: 32542 - protein, 7 aa, Neisseria
SNFDAAR

SEQ ID NO: 32543 - protein, 11 aa, Neisseria
KALEANKKCTR

SEQ ID NO: 32544 - protein, 8 aa, Neisseria
DIEHRQGN

SEQ ID NO: 32545 - protein, 15 aa, Neisseria
AQGKPEEGLNRLTGY

SEQ ID NO: 32546 - protein, 10 aa, Neisseria
LLLKGEKEAA

SEQ ID NO: 32547 - protein, 11 aa, Neisseria
ELVRRKPDLNG

SEQ ID NO: 32548 - protein, 17 aa, Neisseria
KLSDLDPAWKADADMMR

SEQ ID NO: 32549 - protein, 11 aa, Neisseria
VMYRCRNCHFK

SEQ ID NO: 32550 - protein, 17 aa, Neisseria
CPACNKWQTFTPNKIEV

SEQ ID NO: 32551 - protein, 10 aa, Neisseria
NSLKKADMDN

SEQ ID NO: 32552 - protein, 9 aa, Neisseria
TVLKQAKSI

SEQ ID NO: 32553 - protein, 25 aa, Neisseria
DALVDRNSGRAARELAEVVDGRPQS

SEQ ID NO: 32554 - protein, 13 aa, Neisseria
LYRQRGENDKAIN

SEQ ID NO: 32555 - protein, 16 aa, Neisseria
TMLDSPDTVGEKRARV

SEQ ID NO: 32556 - protein, 6 aa, Neisseria
LVDRAE

SEQ ID NO: 32557 - protein, 11 aa, Neisseria
QDGEMAREARQ

SEQ ID NO: 32558 - protein, 11 aa, Neisseria
QQDRDWEKAVE

SEQ ID NO: 32559 - protein, 7 aa, Neisseria
SHDEQTY

SEQ ID NO: 32560 - protein, 6 aa, Neisseria
NFDAAR

SEQ ID NO: 32561 - protein, 11 aa, Neisseria
KALEANKKCTR

SEQ ID NO: 32562 - protein, 8 aa, Neisseria
DIEHRQGN

SEQ ID NO: 32563 - protein, 8 aa, Neisseria
GKPEEGLN

SEQ ID NO: 32564 - protein, 10 aa, Neisseria
LLLKGEKEAA

SEQ ID NO: 32565 - protein, 9 aa, Neisseria
ELVRRKPDL

SEQ ID NO: 32566 - protein, 7 aa, Neisseria
KLSDLDP

SEQ ID NO: 32567 - protein, 9 aa, Neisseria
WKADADMMR

SEQ ID NO: 32568 - protein, 9 aa, Neisseria
VMYRCRNCH

SEQ ID NO: 32569 - protein, 5 aa, Neisseria
NKIEV

SEQ ID NO: 32570 - protein, 6 aa, Neisseria
PVRQVR

SEQ ID NO: 32571 - protein, 10 aa, Neisseria
WRSVAEAGVS

SEQ ID NO: 32572 - protein, 19 aa, Neisseria
TAGLGSGRTAGFSAFASGA

SEQ ID NO: 32573 - protein, 9 aa, Neisseria
TFASGFSTG

SEQ ID NO: 32574 - protein, 11 aa, Neisseria
GSDGMDAVSAL

SEQ ID NO: 32575 - protein, 19 aa, Neisseria
CLRRQAARCTNRRTDRQTV

SEQ ID NO: 32576 - protein, 15 aa, Neisseria
LRQKPVRQVRQRVRR

SEQ ID NO: 32577 - protein, 31 aa, Neisseria
QQVRKRCYRFRRSACRWQKRRLLGGADSAAV

SEQ ID NO: 32578 - protein, 5 aa, Neisseria
TGPGW

SEQ ID NO: 32579 - protein, 14 aa, Neisseria
GVSDTAGLGSGRTA

SEQ ID NO: 32580 - protein, 7 aa, Neisseria
FSTGFST

SEQ ID NO: 32581 - protein, 8 aa, Neisseria
LDGSDGMD

SEQ ID NO: 32582 - protein, 19 aa, Neisseria
CLRRQAARCTNRRTDRQTV

SEQ ID NO: 32583 - protein, 15 aa, Neisseria
LRQKPVRQVRQRVRR

SEQ ID NO: 32584 - protein, 23 aa, Neisseria
QVRKRCYRFRRSACRWQKRRLLG

SEQ ID NO: 32585 - protein, 6 aa, Neisseria
ADSAAV

SEQ ID NO: 32586 - protein, 7 aa, Neisseria
DGSDGMD

SEQ ID NO: 32587 - protein, 7 aa, Neisseria
ASEPAAA

SEQ ID NO: 32588 - protein, 5 aa, Neisseria
SIGST

SEQ ID NO: 32589 - protein, 8 aa, Neisseria
GRSLKQMK

SEQ ID NO: 32590 - protein, 5 aa, Neisseria
TDAMQ

SEQ ID NO: 32591 - protein, 19 aa, Neisseria
QEVMMKFLQEQQAKAVEKH

SEQ ID NO: 32592 - protein, 8 aa, Neisseria
AKDGVKTT

SEQ ID NO: 32593 - protein, 16 aa, Neisseria
QVIPGWTEGVRLLKEG

SEQ ID NO: 32594 - protein, 9 aa, Neisseria
ACGKKEAAP

SEQ ID NO: 32595 - protein, 7 aa, Neisseria
SASEPAA

SEQ ID NO: 32596 - protein, 14 aa, Neisseria
AQGDTSSIGSTMQQ

SEQ ID NO: 32597 - protein, 18 aa, Neisseria
DIGRSLKQMKEQGAEIDL

SEQ ID NO: 32598 - protein, 14 aa, Neisseria
YDGKEIKMTEEQAQ

SEQ ID NO: 32599 - protein, 43 aa, Neisseria; identical to SEQ ID NO: 7006

SEQ ID NO: 32600 - protein, 17 aa, Neisseria
KITKQGEGKQPTKDDIV

SEQ ID NO: 32601 - protein, 8 aa, Neisseria
EYEGRLID

SEQ ID NO: 32602 - protein, 11 aa, Neisseria
VFDSSKANGGP

SEQ ID NO: 32603 - protein, 5 aa, Neisseria
PGWTE

SEQ ID NO: 32604 - protein, 9 aa, Neisseria
VRLLKEGGE

SEQ ID NO: 32605 - protein, 16 aa, Neisseria
SNLAYREQGAGEKIGP

SEQ ID NO: 32606 - protein, 20 aa, Neisseria
GAPENAPAKQPDQVDIKKVN

SEQ ID NO: 32607 - protein, 8 aa, Neisseria
CGKKEAAP

SEQ ID NO: 32608 - protein, 7 aa, Neisseria
SASEPAA

SEQ ID NO: 32609 - protein, 7 aa, Neisseria
AQGDTSS

SEQ ID NO: 32610 - protein, 18 aa, Neisseria
DIGRSLKQMKEQGAEIDL

SEQ ID NO: 32611 - protein, 14 aa, Neisseria
YDGKEIKMTEEQAQ

SEQ ID NO: 32612 - protein, 37 aa, Neisseria; identical to SEQ ID NO: 7019

SEQ ID NO: 32613 - protein, 16 aa, Neisseria
ITKQGEGKQPTKDDIV

SEQ ID NO: 32614 - protein, 8 aa, Neisseria
EYEGRLID

SEQ ID NO: 32615 - protein, 7 aa, Neisseria
DSSKANG

SEQ ID NO: 32616 - protein, 9 aa, Neisseria
VRLLKEGGE

SEQ ID NO: 32617 - protein, 13 aa, Neisseria
AYREQGAGEKIGP

SEQ ID NO: 32618 - protein, 20 aa, Neisseria
GAPENAPAKQPDQVDIKKVN

SEQ ID NO: 32619 - protein, 15 aa, Neisseria
GKIVGNRILRMPSEH

SEQ ID NO: 32620 - protein, 12 aa, Neisseria
FYPKPCKSFKLT

SEQ ID NO: 32621 - protein, 6 aa, Neisseria
TVIKII

SEQ ID NO: 32622 - protein, 6 aa, Neisseria
AFVVGI

SEQ ID NO: 32623 - protein, 8 aa, Neisseria
GMFALFGR

SEQ ID NO: 32624 - protein, 6 aa, Neisseria
MERSGV

SEQ ID NO: 32625 - protein, 9 aa, Neisseria
RILRMPSEH

SEQ ID NO: 32626 - protein, 9 aa, Neisseria
PKPCKSFKL

SEQ ID NO: 32627 - protein, 6 aa, Neisseria
VRSCPC

SEQ ID NO: 32628 - protein, 27 aa, Neisseria
LSLRGENSRLRAEVKKSARLSGQKLTA

SEQ ID NO: 32629 - protein, 9 aa, Neisseria
NAAESAKQP

SEQ ID NO: 32630 - protein, 6 aa, Neisseria
MERSGV

SEQ ID NO: 32631 - protein, 9 aa, Neisseria
RILRMPSEH

SEQ ID NO: 32632 - protein, 7 aa, Neisseria
KPCKSFK

SEQ ID NO: 32633 - protein, 22 aa, Neisseria
LSLRGENSRLRAEVKKSARLSG

SEQ ID NO: 32634 - protein, 9 aa, Neisseria
NAAESAKQP

SEQ ID NO: 32635 - protein, 17 aa, Neisseria
FADFFKDFAPQFGGFQN

SEQ ID NO: 32636 - protein, 16 aa, Neisseria
DFFAAFLGGLEGHVGD

SEQ ID NO: 32637 - protein, 7 aa, Neisseria
FHGVVAF

SEQ ID NO: 32638 - protein, 7 aa, Neisseria
NTDAARF

SEQ ID NO: 32639 - protein, 11 aa, Neisseria
FFKDFAPQFGG

SEQ ID NO: 32640 - protein, 9 aa, Neisseria
LEGHVGDAA

SEQ ID NO: 32641 - protein, 8 aa, Neisseria
NTDAARFA

SEQ ID NO: 32642 - protein, 19 aa, Neisseria
HNQNIQTGNDFRLERGGVG

SEQ ID NO: 32643 - protein, 6 aa, Neisseria
DAARFA

SEQ ID NO: 32644 - protein, 10 aa, Neisseria
NDFRLERGGV

SEQ ID NO: 32645 - protein, 17 aa, Neisseria
FDFLHLISVSGWGHLAE

SEQ ID NO: 32646 - protein, 5 aa, Neisseria
VAVMR

SEQ ID NO: 32647 - protein, 6 aa, Neisseria
ISFLCN

SEQ ID NO: 32648 - protein, 5 aa, Neisseria
LSNFA

SEQ ID NO: 32649 - protein, 21 aa, Neisseria
PFKVGDFIRVGGFEGYVREIK

SEQ ID NO: 32650 - protein, 6 aa, Neisseria
LKAAAE

SEQ ID NO: 32651 - protein, 7 aa, Neisseria
QVVENLR

SEQ ID NO: 32652 - protein, 7 aa, Neisseria
SLKDQLS

SEQ ID NO: 32653 - protein, 5 aa, Neisseria
RPFKV

SEQ ID NO: 32654 - protein, 15 aa, Neisseria
IRVGGFEGYVREIKM

SEQ ID NO: 32655 - protein, 12 aa, Neisseria
SLRTTDNEEVVL

SEQ ID NO: 32656 - protein, 9 aa, Neisseria
IVNRSSLPL

SEQ ID NO: 32657 - protein, 9 aa, Neisseria
LKVAKEAVL

SEQ ID NO: 32658 - protein, 8 aa, Neisseria
VQNEERQP

SEQ ID NO: 32659 - protein, 5 aa, Neisseria
GDNAI

SEQ ID NO: 32660 - protein, 8 aa, Neisseria
NEADRWTL

SEQ ID NO: 32661 - protein, 15 aa, Neisseria
CDLNEQVVENLRKVN

SEQ ID NO: 32662 - protein, 8 aa, Neisseria
PFPQRDIH

SEQ ID NO: 32663 - protein, 6 aa, Neisseria
SLKDQL

SEQ ID NO: 32664 - protein, 7 aa, Neisseria
YVREIKM

SEQ ID NO: 32665 - protein, 10 aa, Neisseria
LRTTDNEEVV

SEQ ID NO: 32666 - protein, 9 aa, Neisseria
LKVAKEAVL

SEQ ID NO: 32667 - protein, 8 aa, Neisseria
VQNEERQP

SEQ ID NO: 32668 - protein, 6 aa, Neisseria
NEADRW

SEQ ID NO: 32669 - protein, 14 aa, Neisseria
DLNEQVVENLRKVN

SEQ ID NO: 32670 - protein, 6 aa, Neisseria
PQRDIH

SEQ ID NO: 32671 - protein, 6 aa, Neisseria
PVSASK

SEQ ID NO: 32672 - protein, 11 aa, Neisseria
SLVKPLSQPLA

SEQ ID NO: 32673 - protein, 9 aa, Neisseria
MDSPKVGCG

SEQ ID NO: 32674 - protein, 5 aa, Neisseria
VSASK

SEQ ID NO: 32675 - protein, 7 aa, Neisseria
ARPEAAH

SEQ ID NO: 32676 - protein, 20 aa, Neisseria
RPDALADNSVSPTHATSGEV

SEQ ID NO: 32677 - protein, 6 aa, Neisseria
MDSPKV

SEQ ID NO: 32678 - protein, 7 aa, Neisseria
ARPEAAH

SEQ ID NO: 32679 - protein, 6 aa, Neisseria
RPDALA

SEQ ID NO: 32680 - protein, 5 aa, Neisseria
TSGEV

SEQ ID NO: 32681 - protein, 6 aa, Neisseria
SHFISL

SEQ ID NO: 32682 - protein, 7 aa, Neisseria
RECFVGF

SEQ ID NO: 32683 - protein, 9 aa, Neisseria
ATAFGRINQ

SEQ ID NO: 32684 - protein, 23 aa, Neisseria
QIHGFLTTFAGRVANPTHCQSQT

SEQ ID NO: 32685 - protein, 26 aa, Neisseria
GQTGIEQNTFCRRGFTRIDMGGNTDV

SEQ ID NO: 32686 - protein, 9 aa, Neisseria
VQADRGLTS

SEQ ID NO: 32687 - protein, 11 aa, Neisseria
SKLETEVRECF

SEQ ID NO: 32688 - protein, 6 aa, Neisseria
FGRINQ

SEQ ID NO: 32689 - protein, 16 aa, Neisseria
FAGRVANPTHCQSQTA

SEQ ID NO: 32690 - protein, 7 aa, Neisseria
VQADRGL

SEQ ID NO: 32691 - protein, 9 aa, Neisseria
SKLETEVRE

SEQ ID NO: 32692 - protein, 8 aa, Neisseria
TDNVTRLA

SEQ ID NO: 32693 - protein, 5 aa, Neisseria
VRSSL

SEQ ID NO: 32694 - protein, 11 aa, Neisseria
GETADIYTPLS

SEQ ID NO: 32695 - protein, 5 aa, Neisseria
SSPTR

SEQ ID NO: 32696 - protein, 6 aa, Neisseria
IAENLF

SEQ ID NO: 32697 - protein, 10 aa, Neisseria
SRSWNRIYAM

SEQ ID NO: 32698 - protein, 15 aa, Neisseria
LTVIPRVWVRAFDQS

SEQ ID NO: 32699 - protein, 7 aa, Neisseria
IADYMGY

SEQ ID NO: 32700 - protein, 13 aa, Neisseria
LKGVVRGFHGYGE

SEQ ID NO: 32701 - protein, 6 aa, Neisseria
LTDNVT

SEQ ID NO: 32702 - protein, 5 aa, Neisseria
ACYDR

SEQ ID NO: 32703 - protein, 14 aa, Neisseria
LPSSAGQEGQESKA

SEQ ID NO: 32704 - protein, 12 aa, Neisseria
ETVRSSLDKGEA

SEQ ID NO: 32705 - protein, 19 aa, Neisseria
VVEKGGDALPADSAGETAD

SEQ ID NO: 32706 - protein, 9 aa, Neisseria
DLDKNDLRG

SEQ ID NO: 32707 - protein, 10 aa, Neisseria
LGVREHNPMY

SEQ ID NO: 32708 - protein, 32 aa, Neisseria
YNNSPNYAPSSPTRGTTVQEKFGQQKRAETKL

SEQ ID NO: 32709 - protein, 6 aa, Neisseria
FKSKIA

SEQ ID NO: 32710 - protein, 6 aa, Neisseria
LFKTRA

SEQ ID NO: 32711 - protein, 27 aa, Neisseria
GYTQRSDWQIYNQGRKSAPFRNTDYKP

SEQ ID NO: 32712 - protein, 14 aa, Neisseria
PVKADLPFGGRLRM

SEQ ID NO: 32713 - protein, 14 aa, Neisseria
QSNGQSRPESRSWN

SEQ ID NO: 32714 - protein, 16 aa, Neisseria
AFDQSGDKNDNPDIAD

SEQ ID NO: 32715 - protein, 17 aa, Neisseria
GYGDVKLQYRLNDRQNV

SEQ ID NO: 32716 - protein, 8 aa, Neisseria
RYNPKTGY

SEQ ID NO: 32717 - protein, 9 aa, Neisseria
IKGKLKGVV

SEQ ID NO: 32718 - protein, 16 aa, Neisseria
HGYGESLIDYNHKQNG

SEQ ID NO: 32719 - protein, 6 aa, Neisseria
NDWDGI

SEQ ID NO: 32720 - protein, 10 aa, Neisseria
AGQEGQESKA

SEQ ID NO: 32721 - protein, 12 aa, Neisseria
ETVRSSLDKGEA

SEQ ID NO: 32722 - protein, 8 aa, Neisseria
EKGGDALP

SEQ ID NO: 32723 - protein, 8 aa, Neisseria
DSAGETAD

SEQ ID NO: 32724 - protein, 9 aa, Neisseria
DLDKNDLRG

SEQ ID NO: 32725 - protein, 7 aa, Neisseria
LGVREHN

SEQ ID NO: 32726 - protein, 22 aa, Neisseria
SPTRGTTVQEKFGQQKRAETKL

SEQ ID NO: 32727 - protein, 6 aa, Neisseria
FKSKIA

SEQ ID NO: 32728 - protein, 6 aa, Neisseria
LFKTRA

SEQ ID NO: 32729 - protein, 15 aa, Neisseria
QGRKSAPFRNTDYKP

SEQ ID NO: 32730 - protein, 5 aa, Neisseria
GRLRM

SEQ ID NO: 32731 - protein, 11 aa, Neisseria
NGQSRPESRSW

SEQ ID NO: 32732 - protein, 15 aa, Neisseria
FDQSGDKNDNPDIAD

SEQ ID NO: 32733 - protein, 5 aa, Neisseria
GDVKL

SEQ ID NO: 32734 - protein, 8 aa, Neisseria
YRLNDRQN

SEQ ID NO: 32735 - protein, 7 aa, Neisseria
GKLKGVV

SEQ ID NO: 32736 - protein, 5 aa, Neisseria
NHKQN

SEQ ID NO: 32737 - protein, 10 aa, Neisseria
HLAFCAFCGI

SEQ ID NO: 32738 - protein, 13 aa, Neisseria
RLHNRMYNAAAAR

SEQ ID NO: 32739 - protein, 5 aa, Neisseria
VTDAQ

SEQ ID NO: 32740 - protein, 8 aa, Neisseria
SKNGDKQI

SEQ ID NO: 32741 - protein, 6 aa, Neisseria
DTHPQP

SEQ ID NO: 32742 - protein, 8 aa, Neisseria
GYAGYCDQ

SEQ ID NO: 32743 - protein, 7 aa, Neisseria
NGGNHTD

SEQ ID NO: 32744 - protein, 10 aa, Neisseria
GYGQCQNQGA

SEQ ID NO: 32745 - protein, 11 aa, Neisseria
TAGNRLHNRMY

SEQ ID NO: 32746 - protein, 74 aa, Neisseria; identical to SEQ ID NO: 7150

SEQ ID NO: 32747 - protein, 66 aa, Neisseria
GYAGYCDQPDGNNRQRAQRHNLADNGGNHTDKHSQQRPSLRLDPVGYGQCQNQGAQYCGNGEGYRF

SEQ ID NO: 32748 - protein, 13 aa, Neisseria
DLRKKDRPEKSEK

SEQ ID NO: 32749 - protein, 5 aa, Neisseria
NRLHN

SEQ ID NO: 32750 - protein, 8 aa, Neisseria
GIGRGNGS

SEQ ID NO: 32751 - protein, 28 aa, Neisseria
QFGKSETVTDAQRFSSKNGDKQISDTHP

SEQ ID NO: 32752 - protein, 31 aa, Neisseria; identical to SEQ ID NO: 7156

SEQ ID NO: 32753 - protein, 38 aa, Neisseria
DQPDGNNRQRAQRHNLADNGGNHTDKHSQQRPSLRLDP

SEQ ID NO: 32754 - protein, 5 aa, Neisseria
EGYRF

SEQ ID NO: 32755 - protein, 13 aa, Neisseria
DLRKKDRPEKSEK

SEQ ID NO: 32756 - protein, 7 aa, Neisseria
EFSESAG

SEQ ID NO: 32757 - protein, 13 aa, Neisseria
AEFVKKFNNFTRK

SEQ ID NO: 32758 - protein, 11 aa, Neisseria
FDALNRFIADV

SEQ ID NO: 32759 - protein, 7 aa, Neisseria
IDQVSKD

SEQ ID NO: 32760 - protein, 6 aa, Neisseria
LAGVLG

SEQ ID NO: 32761 - protein, 7 aa, Neisseria
VAQDTMS

SEQ ID NO: 32762 - protein, 9 aa, Neisseria
AEGRDKNAV

SEQ ID NO: 32763 - protein, 58 aa, Neisseria
EFVKKFNNFTRKSKNGSFKTELVSRSAMPRYQYTNGRRIQTGWEERAEFKAEGRDFDA

SEQ ID NO: 32764 - protein, 32 aa, Neisseria
VQTDASLEDTDFSVSRERRNEVIDQVSKDAVL

SEQ ID NO: 32765 - protein, 9 aa, Neisseria
FKARAEKLA

SEQ ID NO: 32766 - protein, 13 aa, Neisseria
IAGDGAVRAKMLR

SEQ ID NO: 32767 - protein, 16 aa, Neisseria
NMKGTDSAAPGVEEIS

SEQ ID NO: 32768 - protein, 9 aa, Neisseria
AEGRDKNAV

SEQ ID NO: 32769 - protein, 18 aa, Neisseria
NNFTRKSKNGSFKTELVS

SEQ ID NO: 32770 - protein, 24 aa, Neisseria
NGRRIQTGWEERAEFKAEGRDFDA

SEQ ID NO: 32771 - protein, 28 aa, Neisseria
ASLEDTDFSVSRERRNEVIDQVSKDAVL

SEQ ID NO: 32772 - protein, 9 aa, Neisseria
FKARAEKLA

SEQ ID NO: 32773 - protein, 9 aa, Neisseria
GAVRAKMLR

SEQ ID NO: 32774 - protein, 16 aa, Neisseria
NMKGTDSAAPGVEEIS

SEQ ID NO: 32775 - protein, 12 aa, Neisseria
RIFATFCAVIVC

SEQ ID NO: 32776 - protein, 9 aa, Neisseria
TTLMGSIIS

SEQ ID NO: 32777 - protein, 8 aa, Neisseria
REILTEWK

SEQ ID NO: 32778 - protein, 5 aa, Neisseria
NRYID

SEQ ID NO: 32779 - protein, 7 aa, Neisseria
DNHQAQR

SEQ ID NO: 32780 - protein, 6 aa, Neisseria
PLAPIW

SEQ ID NO: 32781 - protein, 23 aa, Neisseria
LAGNIAKPIRILGNGMDRVAERE

SEQ ID NO: 32782 - protein, 10 aa, Neisseria
NQFNQRRTIE

SEQ ID NO: 32783 - protein, 22 aa, Neisseria
FKTRGDNGAREILTEWKNSPVS

SEQ ID NO: 32784 - protein, 9 aa, Neisseria
QGDEKKDIL

SEQ ID NO: 32785 - protein, 8 aa, Neisseria
YTIERARL

SEQ ID NO: 32786 - protein, 8 aa, Neisseria
IEYDRFGE

SEQ ID NO: 32787 - protein, 13 aa, Neisseria
GWDNHQAQRLPSP

SEQ ID NO: 32788 - protein, 30 aa, Neisseria
LGNGMDRVAERELEDRVCQQVRDRDDELAD

SEQ ID NO: 32789 - protein, 7 aa, Neisseria
TMVEKLE

SEQ ID NO: 32790 - protein, 9 aa, Neisseria
QFNQRRTIE

SEQ ID NO: 32791 - protein, 14 aa, Neisseria
FKTRGDNGAREILT

SEQ ID NO: 32792 - protein, 9 aa, Neisseria
QGDEKKDIL

SEQ ID NO: 32793 - protein, 7 aa, Neisseria
TIERARL

SEQ ID NO: 32794 - protein, 8 aa, Neisseria
IEYDRFGE

SEQ ID NO: 32795 - protein, 5 aa, Neisseria
QAQRL

SEQ ID NO: 32796 - protein, 27 aa, Neisseria
GMDRVAERELEDRVCQQVRDRDDELAD

SEQ ID NO: 32797 - protein, 7 aa, Neisseria
TMVEKLE

SEQ ID NO: 32798 - protein, 9 aa, Neisseria
DNFKYFWKT

SEQ ID NO: 32799 - protein, 6 aa, Neisseria
ILAALG

SEQ ID NO: 32800 - protein, 14 aa, Neisseria
VLANIVEKAQNKAP

SEQ ID NO: 32801 - protein, 10 aa, Neisseria
LQQSYPHSIS

SEQ ID NO: 32802 - protein, 22 aa, Neisseria
SQEALKNYGQALEKMPQDSVGR

SEQ ID NO: 32803 - protein, 10 aa, Neisseria
HLEEQQELDN

SEQ ID NO: 32804 - protein, 11 aa, Neisseria
QNRAASQNQEA

SEQ ID NO: 32805 - protein, 23 aa, Neisseria
IVEKAQNKAPQSEINAELSKLQQ

SEQ ID NO: 32806 - protein, 13 aa, Neisseria
TEFDAQRYDVAEG

SEQ ID NO: 32807 - protein, 8 aa, Neisseria
LSNQKDSL

SEQ ID NO: 32808 - protein, 7 aa, Neisseria
QQKKYDA

SEQ ID NO: 32809 - protein, 7 aa, Neisseria
TPVEADF

SEQ ID NO: 32810 - protein, 7 aa, Neisseria
METKGDV

SEQ ID NO: 32811 - protein, 30 aa, Neisseria
AAQEKSQEALKNYGQALEKMPQDSVGRELL

SEQ ID NO: 32812 - protein, 6 aa, Neisseria
KLDSLK

SEQ ID NO: 32813 - protein, 10 aa, Neisseria
HLEEQQELDN

SEQ ID NO: 32814 - protein, 9 aa, Neisseria
RAASQNQEA

SEQ ID NO: 32815 - protein, 21 aa, Neisseria
IVEKAQNKAPQSEINAELSKL

SEQ ID NO: 32816 - protein, 13 aa, Neisseria
TEFDAQRYDVAEG

SEQ ID NO: 32817 - protein, 6 aa, Neisseria
NQKDSL

SEQ ID NO: 32818 - protein, 7 aa, Neisseria
QQKKYDA

SEQ ID NO: 32819 - protein, 7 aa, Neisseria
TPVEADF

SEQ ID NO: 32820 - protein, 7 aa, Neisseria
METKGDV

SEQ ID NO: 32821 - protein, 11 aa, Neisseria
AAQEKSQEALK

SEQ ID NO: 32822 - protein, 15 aa, Neisseria
ALEKMPQDSVGRELL

SEQ ID NO: 32823 - protein, 6 aa, Neisseria
KLDSLK

SEQ ID NO: 32824 - protein, 12 aa, Neisseria
LPALPAILPLSA

SEQ ID NO: 32825 - protein, 12 aa, Neisseria
KRMSDISAGISH

SEQ ID NO: 32826 - protein, 13 aa, Neisseria
DIMTDKGKWKLET

SEQ ID NO: 32827 - protein, 7 aa, Neisseria
NSENSRA

SEQ ID NO: 32828 - protein, 10 aa, Neisseria
TEIQENGSNT

SEQ ID NO: 32829 - protein, 10 aa, Neisseria
GNTDIYGSGS

SEQ ID NO: 32830 - protein, 20 aa, Neisseria
HEERKLDGNGKTRNKRMSDI

SEQ ID NO: 32831 - protein, 9 aa, Neisseria
FLKDGKNPA

SEQ ID NO: 32832 - protein, 19 aa, Neisseria
TVYEKSRNKASLIKKRGLC

SEQ ID NO: 32833 - protein, 11 aa, Neisseria
DIMTDKGKWKL

SEQ ID NO: 32834 - protein, 5 aa, Neisseria
ENSRA

SEQ ID NO: 32835 - protein, 8 aa, Neisseria
EIQENGSN

SEQ ID NO: 32836 - protein, 20 aa, Neisseria
HEERKLDGNGKTRNKRMSDI

SEQ ID NO: 32837 - protein, 7 aa, Neisseria
FLKDGKN

SEQ ID NO: 32838 - protein, 18 aa, Neisseria
TVYEKSRNKASLIKKRGL

SEQ ID NO: 32839 - protein, 6 aa, Neisseria
RGYTGS

SEQ ID NO: 32840 - protein, 47 aa, Neisseria
SPYQETGCTYEGGIGKDGLPSGKGIWRCRDGRGYTGSFKNGKFDGQG

SEQ ID NO: 32841 - protein, 10 aa, Neisseria
FNSDSTKFRN

SEQ ID NO: 32842 - protein, 14 aa, Neisseria
LAHGRFAASQNGET

SEQ ID NO: 32843 - protein, 6 aa, Neisseria
MRTRHD

SEQ ID NO: 32844 - protein, 9 aa, Neisseria
GIGKDGLPS

SEQ ID NO: 32845 - protein, 9 aa, Neisseria
WRCRDGRGY

SEQ ID NO: 32846 - protein, 8 aa, Neisseria
FKNGKFDG

SEQ ID NO: 32847 - protein, 10 aa, Neisseria
FNSDSTKFRN

SEQ ID NO: 32848 - protein, 6 aa, Neisseria
MRTRHD

SEQ ID NO: 32849 - protein, 8 aa, Neisseria
ASRIEKVL

SEQ ID NO: 32850 - protein, 10 aa, Neisseria
VADIAKIIEK

SEQ ID NO: 32851 - protein, 5 aa, Neisseria
MVGMM

SEQ ID NO: 32852 - protein, 11 aa, Neisseria
VLASIVQLWLA

SEQ ID NO: 32853 - protein, 7 aa, Neisseria
MDVLVTI

SEQ ID NO: 32854 - protein, 11 aa, Neisseria
FVSLGKFLEHR

SEQ ID NO: 32855 - protein, 6 aa, Neisseria
VQRNGE

SEQ ID NO: 32856 - protein, 7 aa, Neisseria
QIGDLIR

SEQ ID NO: 32857 - protein, 12 aa, Neisseria
LGDMMNALSEAQ

SEQ ID NO: 32858 - protein, 9 aa, Neisseria
APIARVADK

SEQ ID NO: 32859 - protein, 5 aa, Neisseria
MGKAV

SEQ ID NO: 32860 - protein, 6 aa, Neisseria
IVSAAQ

SEQ ID NO: 32861 - protein, 5 aa, Neisseria
IPAAQ

SEQ ID NO: 32862 - protein, 6 aa, Neisseria
GVGLVK

SEQ ID NO: 32863 - protein, 13 aa, Neisseria
KPIGAFALSDALK

SEQ ID NO: 32864 - protein, 9 aa, Neisseria
DTAEAIGRL

SEQ ID NO: 32865 - protein, 20 aa, Neisseria
AFGNMSPCDKAAEVQKLKAA

SEQ ID NO: 32866 - protein, 9 aa, Neisseria
VGDGINDAP

SEQ ID NO: 32867 - protein, 7 aa, Neisseria
ADVAEHT

SEQ ID NO: 32868 - protein, 7 aa, Neisseria
QHSVNQL

SEQ ID NO: 32869 - protein, 7 aa, Neisseria
AFFYNIL

SEQ ID NO: 32870 - protein, 7 aa, Neisseria
MQQKIRF

SEQ ID NO: 32871 - protein, 17 aa, Neisseria
CASRIEKVLNKKDFVES

SEQ ID NO: 32872 - protein, 16 aa, Neisseria
ASEEAQVTFDGSKTSV

SEQ ID NO: 32873 - protein, 25 aa, Neisseria
KIIEKTGYGAKEKTEDTLPQPEAEH

SEQ ID NO: 32874 - protein, 5 aa, Neisseria
TRHDW

SEQ ID NO: 32875 - protein, 5 aa, Neisseria
IKGGL

SEQ ID NO: 32876 - protein, 11 aa, Neisseria
LEHRTKKSSLN

SEQ ID NO: 32877 - protein, 16 aa, Neisseria
VNVQRNGEWKQLPIDQ

SEQ ID NO: 32878 - protein, 13 aa, Neisseria
DLIRTNHGERIAA

SEQ ID NO: 32879 - protein, 28 aa, Neisseria
GIIESGSGWADESHLTGESNPEEKKAGG

SEQ ID NO: 32880 - protein, 5 aa, Neisseria
TEGSV

SEQ ID NO: 32881 - protein, 10 aa, Neisseria
SEAQGSKAPI

SEQ ID NO: 32882 - protein, 7 aa, Neisseria
RVADKAA

SEQ ID NO: 32883 - protein, 5 aa, Neisseria
IKGDW

SEQ ID NO: 32884 - protein, 6 aa, Neisseria
MGKAVK

SEQ ID NO: 32885 - protein, 9 aa, Neisseria
AAAMEEAAH

SEQ ID NO: 32886 - protein, 15 aa, Neisseria
VLDKTGTLTEGRPQV

SEQ ID NO: 32887 - protein, 10 aa, Neisseria
PDSGFDEDAL

SEQ ID NO: 32888 - protein, 5 aa, Neisseria
VEQNA

SEQ ID NO: 32889 - protein, 5 aa, Neisseria
AEVEG

SEQ ID NO: 32890 - protein, 8 aa, Neisseria
KSGKAEFA

SEQ ID NO: 32891 - protein, 6 aa, Neisseria
KFSDGV

SEQ ID NO: 32892 - protein, 7 aa, Neisseria
SVNGKPI

SEQ ID NO: 32893 - protein, 19 aa, Neisseria
DALKADTAEAIGRLKKHNI

SEQ ID NO: 32894 - protein, 8 aa, Neisseria
SGDNQSTV

SEQ ID NO: 32895 - protein, 16 aa, Neisseria
SPCDKAAEVQKLKAAG

SEQ ID NO: 32896 - protein, 8 aa, Neisseria
VGDGINDA

SEQ ID NO: 32897 - protein, 9 aa, Neisseria
MKGGADVAE

SEQ ID NO: 32898 - protein, 7 aa, Neisseria
MQQKIRF

SEQ ID NO: 32899 - protein, 14 aa, Neisseria
SRIEKVLNKKDFVE

SEQ ID NO: 32900 - protein, 7 aa, Neisseria
ASEEAQV

SEQ ID NO: 32901 - protein, 7 aa, Neisseria
DGSKTSV

SEQ ID NO: 32902 - protein, 20 aa, Neisseria
TGYGAKEKTEDTLPQPEAEH

SEQ ID NO: 32903 - protein, 10 aa, Neisseria
LEHRTKKSSL

SEQ ID NO: 32904 - protein, 9 aa, Neisseria
NVQRNGEWK

SEQ ID NO: 32905 - protein, 8 aa, Neisseria
NHGERIAA

SEQ ID NO: 32906 - protein, 5 aa, Neisseria
GIIES

SEQ ID NO: 32907 - protein, 20 aa, Neisseria
WADESHLTGESNPEEKKAGG

SEQ ID NO: 32908 - protein, 10 aa, Neisseria
SEAQGSKAPI

SEQ ID NO: 32909 - protein, 7 aa, Neisseria
RVADKAA

SEQ ID NO: 32910 - protein, 9 aa, Neisseria
AAAMEEAAH

SEQ ID NO: 32911 - protein, 14 aa, Neisseria
VLDKTGTLTEGRPQ

SEQ ID NO: 32912 - protein, 8 aa, Neisseria
SGFDEDAL

SEQ ID NO: 32913 - protein, 5 aa, Neisseria
VEQNA

SEQ ID NO: 32914 - protein, 5 aa, Neisseria
AEVEG

SEQ ID NO: 32915 - protein, 8 aa, Neisseria
KSGKAEFA

SEQ ID NO: 32916 - protein, 19 aa, Neisseria
DALKADTAEAIGRLKKHNI

SEQ ID NO: 32917 - protein, 5 aa, Neisseria
GDNQS

SEQ ID NO: 32918 - protein, 16 aa, Neisseria
SPCDKAAEVQKLKAAG

SEQ ID NO: 32919 - protein, 7 aa, Neisseria
GGADVAE

SEQ ID NO: 32920 - protein, 9 aa, Neisseria
VTLVNHITH

SEQ ID NO: 32921 - protein, 6 aa, Neisseria
PFAGGF

SEQ ID NO: 32922 - protein, 7 aa, Neisseria
KVLERFF

SEQ ID NO: 32923 - protein, 6 aa, Neisseria
QVPVSL

SEQ ID NO: 32924 - protein, 11 aa, Neisseria
YQKGFKSYRNS

SEQ ID NO: 32925 - protein, 9 aa, Neisseria
ETSDGINPL

SEQ ID NO: 32926 - protein, 7 aa, Neisseria
NELVNLV

SEQ ID NO: 32927 - protein, 5 aa, Neisseria
KRKFA

SEQ ID NO: 32928 - protein, 5 aa, Neisseria
KMLED

SEQ ID NO: 32929 - protein, 9 aa, Neisseria
DINETLRLM

SEQ ID NO: 32930 - protein, 5 aa, Neisseria
DSTVQ

SEQ ID NO: 32931 - protein, 5 aa, Neisseria
MKKPL

SEQ ID NO: 32932 - protein, 17 aa, Neisseria
KAEESLTQQQKILQKTG

SEQ ID NO: 32933 - protein, 23 aa, Neisseria
SHQYDRGWFTSTETTVIRLKPEL

SEQ ID NO: 32934 - protein, 9 aa, Neisseria
QKYLPDNLK

SEQ ID NO: 32935 - protein, 16 aa, Neisseria
IETEFKYAPETEKVLE

SEQ ID NO: 32936 - protein, 6 aa, Neisseria
FFGKQV

SEQ ID NO: 32937 - protein, 8 aa, Neisseria
NGSGKMEV

SEQ ID NO: 32938 - protein, 7 aa, Neisseria
DYEELSG

SEQ ID NO: 32939 - protein, 14 aa, Neisseria
KGFKSYRNSYDAPL

SEQ ID NO: 32940 - protein, 11 aa, Neisseria
KLADKGDAAFE

SEQ ID NO: 32941 - protein, 12 aa, Neisseria
AHFDSETSDGIN

SEQ ID NO: 32942 - protein, 11 aa, Neisseria
FSLEWKEGVDY

SEQ ID NO: 32943 - protein, 14 aa, Neisseria
NPNGSIAPSKIEVG

SEQ ID NO: 32944 - protein, 10 aa, Neisseria
FSTKTGESGA

SEQ ID NO: 32945 - protein, 9 aa, Neisseria
IDSEGRFRF

SEQ ID NO: 32946 - protein, 9 aa, Neisseria
VYGDEKYGP

SEQ ID NO: 32947 - protein, 7 aa, Neisseria
VLKRKFA

SEQ ID NO: 32948 - protein, 14 aa, Neisseria
SAKKMTEEQIRNDL

SEQ ID NO: 32949 - protein, 7 aa, Neisseria
VKGDASG

SEQ ID NO: 32950 - protein, 10 aa, Neisseria
LPQGKIDVGG

SEQ ID NO: 32951 - protein, 9 aa, Neisseria
GMKKEDLNQ

SEQ ID NO: 32952 - protein, 8 aa, Neisseria
LKKTEANI

SEQ ID NO: 32953 - protein, 12 aa, Neisseria
NAEDEAEARASI

SEQ ID NO: 32954 - protein, 6 aa, Neisseria
DINETL

SEQ ID NO: 32955 - protein, 7 aa, Neisseria
MAREKYL

SEQ ID NO: 32956 - protein, 32 aa, Neisseria
LKNNALKLNGKTLQNEPDPDFDEGDMVSGQPH

SEQ ID NO: 32957 - protein, 5 aa, Neisseria
MKKPL

SEQ ID NO: 32958 - protein, 8 aa, Neisseria
KAEESLTQ

SEQ ID NO: 32959 - protein, 9 aa, Neisseria
TVIRLKPEL

SEQ ID NO: 32960 - protein, 6 aa, Neisseria
YLPDNL

SEQ ID NO: 32961 - protein, 16 aa, Neisseria
IETEFKYAPETEKVLE

SEQ ID NO: 32962 - protein, 5 aa, Neisseria
GKMEV

SEQ ID NO: 32963 - protein, 7 aa, Neisseria
DYEELSG

SEQ ID NO: 32964 - protein, 9 aa, Neisseria
GFKSYRNSY

SEQ ID NO: 32965 - protein, 11 aa, Neisseria
KLADKGDAAFE

SEQ ID NO: 32966 - protein, 10 aa, Neisseria
AHFDSETSDG

SEQ ID NO: 32967 - protein, 11 aa, Neisseria
FSLEWKEGVDY

SEQ ID NO: 32968 - protein, 6 aa, Neisseria
SKIEVG

SEQ ID NO: 32969 - protein, 9 aa, Neisseria
IDSEGRFRF

SEQ ID NO: 32970 - protein, 9 aa, Neisseria
VYGDEKYGP

SEQ ID NO: 32971 - protein, 7 aa, Neisseria
VLKRKFA

SEQ ID NO: 32972 - protein, 14 aa, Neisseria
SAKKMTEEQIRNDL

SEQ ID NO: 32973 - protein, 5 aa, Neisseria
VKGDA

SEQ ID NO: 32974 - protein, 7 aa, Neisseria
GKIDVGG

SEQ ID NO: 32975 - protein, 8 aa, Neisseria
GMKKEDLN

SEQ ID NO: 32976 - protein, 8 aa, Neisseria
LKKTEANI

SEQ ID NO: 32977 - protein, 12 aa, Neisseria
NAEDEAEARASI

SEQ ID NO: 32978 - protein, 6 aa, Neisseria
DINETL

SEQ ID NO: 32979 - protein, 7 aa, Neisseria
MAREKYL

SEQ ID NO: 32980 - protein, 17 aa, Neisseria
TLQNEPDPDFDEGDMVS

SEQ ID NO: 32981 - protein, 5 aa, Neisseria
AFIFA

SEQ ID NO: 32982 - protein, 10 aa, Neisseria
LHEFGHYIVA

SEQ ID NO: 32983 - protein, 9 aa, Neisseria
LGGYVKMVD

SEQ ID NO: 32984 - protein, 13 aa, Neisseria
GDKIQSVNGVSVQ

SEQ ID NO: 32985 - protein, 22 aa, Neisseria
SGAQTVRTIDAAGTPEAGKIAK

SEQ ID NO: 32986 - protein, 6 aa, Neisseria
AGGVEK

SEQ ID NO: 32987 - protein, 5 aa, Neisseria
PGDRL

SEQ ID NO: 32988 - protein, 13 aa, Neisseria
PIASWQEWANLTR

SEQ ID NO: 32989 - protein, 7 aa, Neisseria
AWDAQIR

SEQ ID NO: 32990 - protein, 10 aa, Neisseria
YRPSVVRAFG

SEQ ID NO: 32991 - protein, 8 aa, Neisseria
GWEKTVSH

SEQ ID NO: 32992 - protein, 9 aa, Neisseria
TLKFFGKLI

SEQ ID NO: 32993 - protein, 9 aa, Neisseria
HISGPLTIA

SEQ ID NO: 32994 - protein, 7 aa, Neisseria
YLEFLAL

SEQ ID NO: 32995 - protein, 10 aa, Neisseria
FFTRKRGDTE

SEQ ID NO: 32996 - protein, 13 aa, Neisseria
VDTREGEVSEADL

SEQ ID NO: 32997 - protein, 9 aa, Neisseria
FDKQHPAKR

SEQ ID NO: 32998 - protein, 8 aa, Neisseria
TVEPDTVA

SEQ ID NO: 32999 - protein, 10 aa, Neisseria
GFQSGDKIQS

SEQ ID NO: 33000 - protein, 7 aa, Neisseria
DWSSAQT

SEQ ID NO: 33001 - protein, 19 aa, Neisseria
RTIDAAGTPEAGKIAKNQG

SEQ ID NO: 33002 - protein, 28 aa, Neisseria
GGVEKGSPAEKAGLKPGDRLTAADGKPI

SEQ ID NO: 33003 - protein, 11 aa, Neisseria
NLTRQSPGKKI

SEQ ID NO: 33004 - protein, 24 aa, Neisseria
YERAGQTHTADIRPDTVEQPDHTL

SEQ ID NO: 33005 - protein, 11 aa, Neisseria
VGLRPQPDRAW

SEQ ID NO: 33006 - protein, 11 aa, Neisseria
AQIRRSYRPSV

SEQ ID NO: 33007 - protein, 6 aa, Neisseria
KTVSHS

SEQ ID NO: 33008 - protein, 5 aa, Neisseria
ISGNA

SEQ ID NO: 33009 - protein, 5 aa, Neisseria
AGQSA

SEQ ID NO: 33010 - protein, 11 aa, Neisseria
IRGKPLGERVQ

SEQ ID NO: 33011 - protein, 9 aa, Neisseria
FFTRKRGDT

SEQ ID NO: 33012 - protein, 13 aa, Neisseria
VDTREGEVSEADL

SEQ ID NO: 33013 - protein, 9 aa, Neisseria
FDKQHPAKR

SEQ ID NO: 33014 - protein, 7 aa, Neisseria
VEPDTVA

SEQ ID NO: 33015 - protein, 10 aa, Neisseria
GFQSGDKIQS

SEQ ID NO: 33016 - protein, 10 aa, Neisseria
GTPEAGKIAK

SEQ ID NO: 33017 - protein, 26 aa, Neisseria
GVEKGSPAEKAGLKPGDRLTAADGKP

SEQ ID NO: 33018 - protein, 9 aa, Neisseria
TRQSPGKKI

SEQ ID NO: 33019 - protein, 6 aa, Neisseria
YERAGQ

SEQ ID NO: 33020 - protein, 12 aa, Neisseria
ADIRPDTVEQPD

SEQ ID NO: 33021 - protein, 7 aa, Neisseria
PQPDRAW

SEQ ID NO: 33022 - protein, 7 aa, Neisseria
QIRRSYR

SEQ ID NO: 33023 - protein, 5 aa, Neisseria
AGQSA

SEQ ID NO: 33024 - protein, 8 aa, Neisseria
KPLGERVQ

SEQ ID NO: 33025 - protein, 6 aa, Neisseria
FGQIFS

SEQ ID NO: 33026 - protein, 8 aa, Neisseria
GGLLGGLI

SEQ ID NO: 33027 - protein, 8 aa, Neisseria
APNAAAAA

SEQ ID NO: 33028 - protein, 12 aa, Neisseria
QGMIQMLGVFVD

SEQ ID NO: 33029 - protein, 5 aa, Neisseria
PYGDL

SEQ ID NO: 33030 - protein, 7 aa, Neisseria
VSQVGQW

SEQ ID NO: 33031 - protein, 6 aa, Neisseria
TAVFRM

SEQ ID NO: 33032 - protein, 6 aa, Neisseria
YFGAVA

SEQ ID NO: 33033 - protein, 14 aa, Neisseria
IMAWINLVAILLLS

SEQ ID NO: 33034 - protein, 19 aa, Neisseria
GIKRGLYSNEAGMGSAPNA

SEQ ID NO: 33035 - protein, 8 aa, Neisseria
AEVKHPVS

SEQ ID NO: 33036 - protein, 8 aa, Neisseria
QPYGDLSG

SEQ ID NO: 33037 - protein, 7 aa, Neisseria
AYAESNV

SEQ ID NO: 33038 - protein, 32 aa, Neisseria; identical to SEQ ID NO: 5466

SEQ ID NO: 33039 - protein, 7 aa, Neisseria
GIKRGLY

SEQ ID NO: 33040 - protein, 7 aa, Neisseria
AEVKHPV

SEQ ID NO: 33041 - protein, 13 aa, Neisseria
LKMGKDPEFKLSE

SEQ ID NO: 33042 - protein, 9 aa, Neisseria
PGLKRRIKS

SEQ ID NO: 33043 - protein, 8 aa, Neisseria
GLCKCFGG

SEQ ID NO: 33044 - protein, 12 aa, Neisseria
STLLNMIAGIVR

SEQ ID NO: 33045 - protein, 6 aa, Neisseria
HMSALE

SEQ ID NO: 33046 - protein, 6 aa, Neisseria
LSALAE

SEQ ID NO: 33047 - protein, 12 aa, Neisseria
AHRKPEKLSGGE

SEQ ID NO: 33048 - protein, 5 aa, Neisseria
FSSLD

SEQ ID NO: 33049 - protein, 9 aa, Neisseria
HLRDRLRRM

SEQ ID NO: 33050 - protein, 18 aa, Neisseria
ETLIQTPAGVQVARLMGL

SEQ ID NO: 33051 - protein, 12 aa, Neisseria
LLSLVRLPDSLR

SEQ ID NO: 33052 - protein, 5 aa, Neisseria
HTDGI

SEQ ID NO: 33053 - protein, 8 aa, Neisseria
CFGGKTVA

SEQ ID NO: 33054 - protein, 6 aa, Neisseria
VGRGKI

SEQ ID NO: 33055 - protein, 10 aa, Neisseria
LGRSGCGKST

SEQ ID NO: 33056 - protein, 17 aa, Neisseria
IVRPDGGEIRLNGENIT

SEQ ID NO: 33057 - protein, 7 aa, Neisseria
PPEKRRI

SEQ ID NO: 33058 - protein, 14 aa, Neisseria
KMQKMPKAEAERLA

SEQ ID NO: 33059 - protein, 24 aa, Neisseria
VGLENEAHRKPEKLSGGEKQRLAL

SEQ ID NO: 33060 - protein, 6 aa, Neisseria
ESFSSL

SEQ ID NO: 33061 - protein, 20 aa, Neisseria
THLRDRLRRMTAERIRKGGI

SEQ ID NO: 33062 - protein, 15 aa, Neisseria
HSPEEACTAADEIAV

SEQ ID NO: 33063 - protein, 14 aa, Neisseria
HEGKILQCGTPETL

SEQ ID NO: 33064 - protein, 15 aa, Neisseria
GLPNTDDDRHIPQNA

SEQ ID NO: 33065 - protein, 9 aa, Neisseria
LDNHGTECR

SEQ ID NO: 33066 - protein, 8 aa, Neisseria
RLPDSLRL

SEQ ID NO: 33067 - protein, 6 aa, Neisseria
HPEHGE

SEQ ID NO: 33068 - protein, 10 aa, Neisseria
QHTDGISGNG

SEQ ID NO: 33069 - protein, 14 aa, Neisseria
VRIRVDEGRIVRFR

SEQ ID NO: 33070 - protein, 5 aa, Neisseria
GRGKI

SEQ ID NO: 33071 - protein, 5 aa, Neisseria
SGCGK

SEQ ID NO: 33072 - protein, 12 aa, Neisseria
VRPDGGEIRLNG

SEQ ID NO: 33073 - protein, 7 aa, Neisseria
PPEKRRI

SEQ ID NO: 33074 - protein, 14 aa, Neisseria
KMQKMPKAEAERLA

SEQ ID NO: 33075 - protein, 24 aa, Neisseria
VGLENEAHRKPEKLSGGEKQRLAL

SEQ ID NO: 33076 - protein, 19 aa, Neisseria
THLRDRLRRMTAERIRKGG

SEQ ID NO: 33077 - protein, 14 aa, Neisseria
SPEEACTAADEIAV

SEQ ID NO: 33078 - protein, 5 aa, Neisseria
HEGKI

SEQ ID NO: 33079 - protein, 9 aa, Neisseria
NTDDDRHIP

SEQ ID NO: 33080 - protein, 6 aa, Neisseria
HGTECR

SEQ ID NO: 33081 - protein, 7 aa, Neisseria
RLPDSLR

SEQ ID NO: 33082 - protein, 6 aa, Neisseria
HPEHGE

SEQ ID NO: 33083 - protein, 7 aa, Neisseria
QHTDGIS

SEQ ID NO: 33084 - protein, 14 aa, Neisseria
VRIRVDEGRIVRFR

SEQ ID NO: 33085 - protein, 5 aa, Neisseria
SILRL

SEQ ID NO: 33086 - protein, 11 aa, Neisseria
AGRKCQETAAA

SEQ ID NO: 33087 - protein, 8 aa, Neisseria
AIKHCNFT

SEQ ID NO: 33088 - protein, 16 aa, Neisseria
MGADTDGDKDVRLNRT

SEQ ID NO: 33089 - protein, 7 aa, Neisseria
VEHPNRF

SEQ ID NO: 33090 - protein, 8 aa, Neisseria
HLDGSTGG

SEQ ID NO: 33091 - protein, 16 aa, Neisseria
FRREKTGHKRRCHTQC

SEQ ID NO: 33092 - protein, 13 aa, Neisseria
HSARAAGRKCQET

SEQ ID NO: 33093 - protein, 7 aa, Neisseria
RAIKHCN

SEQ ID NO: 33094 - protein, 15 aa, Neisseria
MGADTDGDKDVRLNR

SEQ ID NO: 33095 - protein, 13 aa, Neisseria
FRREKTGHKRRCH

SEQ ID NO: 33096 - protein, 11 aa, Neisseria
ARAAGRKCQET

SEQ ID NO: 33097 - protein, 6 aa, Neisseria
CQPPEA

SEQ ID NO: 33098 - protein, 8 aa, Neisseria
GLSDKMNR

SEQ ID NO: 33099 - protein, 14 aa, Neisseria
ADLEKLPQPLADYK

SEQ ID NO: 33100 - protein, 5 aa, Neisseria
QGEVK

SEQ ID NO: 33101 - protein, 14 aa, Neisseria
FTEAVKAGDIEKAK

SEQ ID NO: 33102 - protein, 25 aa, Neisseria
IEPIAELFSELDPVIDACEDDFKDG

SEQ ID NO: 33103 - protein, 8 aa, Neisseria
AGFTGFHR

SEQ ID NO: 33104 - protein, 18 aa, Neisseria
ETAAKLMTDVEALQKEID

SEQ ID NO: 33105 - protein, 9 aa, Neisseria
VGGASELIE

SEQ ID NO: 33106 - protein, 11 aa, Neisseria
SKKIVDLFRPL

SEQ ID NO: 33107 - protein, 10 aa, Neisseria
FKQVNEILAK

SEQ ID NO: 33108 - protein, 13 aa, Neisseria
DGFETYDKLSEAD

SEQ ID NO: 33109 - protein, 19 aa, Neisseria
APINALAEDLAQLRGILGL

SEQ ID NO: 33110 - protein, 5 aa, Neisseria
MRKFN

SEQ ID NO: 33111 - protein, 10 aa, Neisseria
QPPEAEKAAP

SEQ ID NO: 33112 - protein, 13 aa, Neisseria
ASGETQSANEGGS

SEQ ID NO: 33113 - protein, 10 aa, Neisseria
NDNACEPMNL

SEQ ID NO: 33114 - protein, 13 aa, Neisseria
IKNNSGRKLEWEI

SEQ ID NO: 33115 - protein, 10 aa, Neisseria
MVVDERENIA

SEQ ID NO: 33116 - protein, 17 aa, Neisseria
GLSDKMNRNLLPGEYEM

SEQ ID NO: 33117 - protein, 9 aa, Neisseria
TNPRGKLVV

SEQ ID NO: 33118 - protein, 17 aa, Neisseria
DSGFKDTANEADLEKLP

SEQ ID NO: 33119 - protein, 27 aa, Neisseria
GEVKELAAKTKTFTEAVKAGDIEKAKS

SEQ ID NO: 33120 - protein, 9 aa, Neisseria
VHYERIEPI

SEQ ID NO: 33121 - protein, 22 aa, Neisseria
SELDPVIDACEDDFKDGAKDAG

SEQ ID NO: 33122 - protein, 13 aa, Neisseria
VEKDVSGVKETAA

SEQ ID NO: 33123 - protein, 13 aa, Neisseria
LMTDVEALQKEID

SEQ ID NO: 33124 - protein, 9 aa, Neisseria
PPGKVVGGA

SEQ ID NO: 33125 - protein, 38 aa, Neisseria
ELIEEAAGSKISGEEDRYSHTDLSDFQANADGSKKIVD

SEQ ID NO: 33126 - protein, 20 aa, Neisseria
IEAKNKALLEKTDTNFKQVN

SEQ ID NO: 33127 - protein, 23 aa, Neisseria
AKYRTKDGFETYDKLSEADRKAL

SEQ ID NO: 33128 - protein, 7 aa, Neisseria
LAEDLAQ

SEQ ID NO: 33129 - protein, 5 aa, Neisseria
MRKFN

SEQ ID NO: 33130 - protein, 10 aa, Neisseria
QPPEAEKAAP

SEQ ID NO: 33131 - protein, 13 aa, Neisseria
ASGETQSANEGGS

SEQ ID NO: 33132 - protein, 11 aa, Neisseria
NNSGRKLEWEI

SEQ ID NO: 33133 - protein, 9 aa, Neisseria
MVVDERENI

SEQ ID NO: 33134 - protein, 7 aa, Neisseria
LSDKMNR

SEQ ID NO: 33135 - protein, 5 aa, Neisseria
GEYEM

SEQ ID NO: 33136 - protein, 7 aa, Neisseria
PRGKLVV

SEQ ID NO: 33137 - protein, 16 aa, Neisseria
SGFKDTANEADLEKLP

SEQ ID NO: 33138 - protein, 27 aa, Neisseria
GEVKELAAKTKTFTEAVKAGDIEKAKS

SEQ ID NO: 33139 - protein, 9 aa, Neisseria
VHYERIEPI

SEQ ID NO: 33140 - protein, 22 aa, Neisseria
SELDPVIDACEDDFKDGAKDAG

SEQ ID NO: 33141 - protein, 13 aa, Neisseria
VEKDVSGVKETAA

SEQ ID NO: 33142 - protein, 13 aa, Neisseria
LMTDVEALQKEID

SEQ ID NO: 33143 - protein, 20 aa, Neisseria
ELIEEAAGSKISGEEDRYSH

SEQ ID NO: 33144 - protein, 9 aa, Neisseria
ADGSKKIVD

SEQ ID NO: 33145 - protein, 16 aa, Neisseria
IEAKNKALLEKTDTNF

SEQ ID NO: 33146 - protein, 21 aa, Neisseria
YRTKDGFETYDKLSEADRKAL

SEQ ID NO: 33147 - protein, 7 aa, Neisseria
LAEDLAQ

SEQ ID NO: 33148 - protein, 8 aa, Neisseria
MLRVSKVV

SEQ ID NO: 33149 - protein, 9 aa, Neisseria
LRIMAGVDK

SEQ ID NO: 33150 - protein, 26 aa, Neisseria
VREEVESGLGEVAAAQKRLEEVYAEY

SEQ ID NO: 33151 - protein, 6 aa, Neisseria
PTNHLD

SEQ ID NO: 33152 - protein, 12 aa, Neisseria
EWLEQFLVRFPG

SEQ ID NO: 33153 - protein, 8 aa, Neisseria
RFEEMSNY

SEQ ID NO: 33154 - protein, 15 aa, Neisseria
LGNEVIEFVNVSKSF

SEQ ID NO: 33155 - protein, 6 aa, Neisseria
STLFKM

SEQ ID NO: 33156 - protein, 5 aa, Neisseria
DNIAE

SEQ ID NO: 33157 - protein, 11 aa, Neisseria
DQSKIARQLSG

SEQ ID NO: 33158 - protein, 12 aa, Neisseria
LRALEDALLEFA

SEQ ID NO: 33159 - protein, 12 aa, Neisseria
VPPQKTIIKDIS

SEQ ID NO: 33160 - protein, 9 aa, Neisseria
LNGTGKSTV

SEQ ID NO: 33161 - protein, 11 aa, Neisseria
AGVDKEFEGEA

SEQ ID NO: 33162 - protein, 21 aa, Neisseria
LPQEPELDPEKTVREEVESGL

SEQ ID NO: 33163 - protein, 11 aa, Neisseria
AAAQKRLEEVY

SEQ ID NO: 33164 - protein, 19 aa, Neisseria
YANPDADFDALAEEQGRLE

SEQ ID NO: 33165 - protein, 28 aa, Neisseria
GSSTGGGAEHELEIAADALRLPDWDAKI

SEQ ID NO: 33166 - protein, 11 aa, Neisseria
NLSGGEKRRVA

SEQ ID NO: 33167 - protein, 6 aa, Neisseria
LSKPDM

SEQ ID NO: 33168 - protein, 11 aa, Neisseria
DEPTNHLDAES

SEQ ID NO: 33169 - protein, 6 aa, Neisseria
THDRYF

SEQ ID NO: 33170 - protein, 9 aa, Neisseria
LELDRGHGI

SEQ ID NO: 33171 - protein, 7 aa, Neisseria
WKGNYSS

SEQ ID NO: 33172 - protein, 63 aa, Neisseria
LEQKEKRLENEAKSEAARVKAMKQELEWVRQNAKGRQAKPKARLARFEEMSNYEYQKRNETQE

SEQ ID NO: 33173 - protein, 8 aa, Neisseria
AERLGNEV

SEQ ID NO: 33174 - protein, 9 aa, Neisseria
SKSFGDKVL

SEQ ID NO: 33175 - protein, 9 aa, Neisseria
PNGAGKSTL

SEQ ID NO: 33176 - protein, 13 aa, Neisseria
AGKEQPDSGEVKI

SEQ ID NO: 33177 - protein, 14 aa, Neisseria
DQSREGLQNDKTVF

SEQ ID NO: 33178 - protein, 8 aa, Neisseria
IAEGRDIL

SEQ ID NO: 33179 - protein, 34 aa, Neisseria
IPARQYLGRFNFKGSDQSKIARQLSGGERGRLHL

SEQ ID NO: 33180 - protein, 17 aa, Neisseria
LDEPSNDLDVETLRALE

SEQ ID NO: 33181 - protein, 6 aa, Neisseria
SHDRWF

SEQ ID NO: 33182 - protein, 8 aa, Neisseria
ACEGDSKW

SEQ ID NO: 33183 - protein, 32 aa, Neisseria
DGNYQEYEADKKRRLGKEGAKPKRIKYKPVTR

SEQ ID NO: 33184 - protein, 11 aa, Neisseria
AGVDKEFEGEA

SEQ ID NO: 33185 - protein, 19 aa, Neisseria
QEPELDPEKTVREEVESGL

SEQ ID NO: 33186 - protein, 11 aa, Neisseria
AAAQKRLEEVY

SEQ ID NO: 33187 - protein, 18 aa, Neisseria
ANPDADFDALAEEQGRLE

SEQ ID NO: 33188 - protein, 15 aa, Neisseria
GGAEHELEIAADALR

SEQ ID NO: 33189 - protein, 7 aa, Neisseria
PDWDAKI

SEQ ID NO: 33190 - protein, 9 aa, Neisseria
SGGEKRRVA

SEQ ID NO: 33191 - protein, 5 aa, Neisseria
LSKPD

SEQ ID NO: 33192 - protein, 11 aa, Neisseria
DEPTNHLDAES

SEQ ID NO: 33193 - protein, 7 aa, Neisseria
LELDRGH

SEQ ID NO: 33194 - protein, 28 aa, Neisseria
LEQKEKRLENEAKSEAARVKAMKQELEW

SEQ ID NO: 33195 - protein, 23 aa, Neisseria
RQNAKGRQAKPKARLARFEEMSN

SEQ ID NO: 33196 - protein, 9 aa, Neisseria
EYQKRNETQ

SEQ ID NO: 33197 - protein, 8 aa, Neisseria
AERLGNEV

SEQ ID NO: 33198 - protein, 13 aa, Neisseria
AGKEQPDSGEVKI

SEQ ID NO: 33199 - protein, 14 aa, Neisseria
DQSREGLQNDKTVF

SEQ ID NO: 33200 - protein, 8 aa, Neisseria
IAEGRDIL

SEQ ID NO: 33201 - protein, 12 aa, Neisseria
NFKGSDQSKIAR

SEQ ID NO: 33202 - protein, 11 aa, Neisseria
LSGGERGRLHL

SEQ ID NO: 33203 - protein, 16 aa, Neisseria
DEPSNDLDVETLRALE

SEQ ID NO: 33204 - protein, 5 aa, Neisseria
CEGDS

SEQ ID NO: 33205 - protein, 25 aa, Neisseria
NYQEYEADKKRRLGKEGAKPKRIKY

SEQ ID NO: 33206 - protein, 9 aa, Neisseria
SNSLKQLQE

SEQ ID NO: 33207 - protein, 7 aa, Neisseria
WDKFQKL

SEQ ID NO: 33208 - protein, 8 aa, Neisseria
QISRFVSG

SEQ ID NO: 33209 - protein, 9 aa, Neisseria
LRYTRYVNA

SEQ ID NO: 33210 - protein, 12 aa, Neisseria
NREVVKDLEKQQ

SEQ ID NO: 33211 - protein, 10 aa, Neisseria
INNELARLKK

SEQ ID NO: 33212 - protein, 6 aa, Neisseria
ANVQSL

SEQ ID NO: 33213 - protein, 7 aa, Neisseria
DAAEQTE

SEQ ID NO: 33214 - protein, 7 aa, Neisseria
KISKDAR

SEQ ID NO: 33215 - protein, 5 aa, Neisseria
NKLLS

SEQ ID NO: 33216 - protein, 29 aa, Neisseria
PSVMGIGSADGFSRMQGRLKKPVDGVPTG

SEQ ID NO: 33217 - protein, 8 aa, Neisseria
PATVESIA

SEQ ID NO: 33218 - protein, 12 aa, Neisseria
SYADELDGYGKV

SEQ ID NO: 33219 - protein, 13 aa, Neisseria
SIYAGLSEISAGK

SEQ ID NO: 33220 - protein, 28 aa, Neisseria
NSLKQLQEERIRQERIRQERIRQARGNL

SEQ ID NO: 33221 - protein, 29 aa, Neisseria
SVNRKQREAWDKFQKLNTELNRLKTEVAA

SEQ ID NO: 33222 - protein, 11 aa, Neisseria
SGNYKNSRPNA

SEQ ID NO: 33223 - protein, 10 aa, Neisseria
NAEPGQKNRF

SEQ ID NO: 33224 - protein, 17 aa, Neisseria
VNASNREVVKDLEKQQK

SEQ ID NO: 33225 - protein, 16 aa, Neisseria
QEQKINNELARLKKIQ

SEQ ID NO: 33226 - protein, 40 aa, Neisseria
LLKKQGVTDAAEQTESRRQNAKISKDARKLLEQKGNEQQL

SEQ ID NO: 33227 - protein, 64 aa, Neisseria
LLSNLEKKKAEHRIQDAEAKRKLAEAKLAAAEKARKEAAQQKAEARRAEMSNLTAEDRNIQAPS

SEQ ID NO: 33228 - protein, 22 aa, Neisseria
GSADGFSRMQGRLKKPVDGVPT

SEQ ID NO: 33229 - protein, 9 aa, Neisseria
GQNRSGGDV

SEQ ID NO: 33230 - protein, 10 aa, Neisseria
SYADELDGYG

SEQ ID NO: 33231 - protein, 6 aa, Neisseria
DHGENY

SEQ ID NO: 33232 - protein, 9 aa, Neisseria
EISAGKGYT

SEQ ID NO: 33233 - protein, 18 aa, Neisseria
AGSKIGTSGSLPDGEEGL

SEQ ID NO: 33234 - protein, 13 aa, Neisseria
IRYRGQVLNPSGW

SEQ ID NO: 33235 - protein, 27 aa, Neisseria
NSLKQLQEERIRQERIRQERIRQARGN

SEQ ID NO: 33236 - protein, 28 aa, Neisseria
VNRKQREAWDKFQKLNTELNRLKTEVAA

SEQ ID NO: 33237 - protein, 7 aa, Neisseria
YKNSRPN

SEQ ID NO: 33238 - protein, 10 aa, Neisseria
NAEPGQKNRF

SEQ ID NO: 33239 - protein, 14 aa, Neisseria
SNREVVKDLEKQQK

SEQ ID NO: 33240 - protein, 16 aa, Neisseria
QEQKINNELARLKKIQ

SEQ ID NO: 33241 - protein, 40 aa, Neisseria; identical to SEQ ID NO: 33226

SEQ ID NO: 33242 - protein, 48 aa, Neisseria
SNLEKKKAEHRIQDAEAKRKLAEAKLAAAEKARKEAAQQKAEARRAEM

SEQ ID NO: 33243 - protein, 8 aa, Neisseria
TAEDRNIQ

SEQ ID NO: 33244 - protein, 10 aa, Neisseria
MQGRLKKPVD

SEQ ID NO: 33245 - protein, 7 aa, Neisseria
NRSGGDV

SEQ ID NO: 33246 - protein, 9 aa, Neisseria
YADELDGYG

SEQ ID NO: 33247 - protein, 5 aa, Neisseria
SKIGT

SEQ ID NO: 33248 - protein, 9 aa, Neisseria
SLPDGEEGL

SEQ ID NO: 33249 - protein, 12 aa, Neisseria
LVDEIDVPNIGR

SEQ ID NO: 33250 - protein, 7 aa, Neisseria
AGIPTVF

SEQ ID NO: 33251 - protein, 27 aa, Neisseria
GKELQDDINNDAAALEKFETIRAYGAL

SEQ ID NO: 33252 - protein, 9 aa, Neisseria
MGLISDVSE

SEQ ID NO: 33253 - protein, 7 aa, Neisseria
SSGKTVN

SEQ ID NO: 33254 - protein, 11 aa, Neisseria
AVLGTLVNLAA

SEQ ID NO: 33255 - protein, 5 aa, Neisseria
GAAAE

SEQ ID NO: 33256 - protein, 18 aa, Neisseria
PTGNLVDEIDVPNIGRLK

SEQ ID NO: 33257 - protein, 23 aa, Neisseria
GYTGKELQDDINNDAAALEKFET

SEQ ID NO: 33258 - protein, 16 aa, Neisseria
DVSEAAARARTPKPAF

SEQ ID NO: 33259 - protein, 10 aa, Neisseria
YTASSGKTVN

SEQ ID NO: 33260 - protein, 7 aa, Neisseria
ADIDLPV

SEQ ID NO: 33261 - protein, 19 aa, Neisseria
AGGGTRKEVRFGHPSGTLR

SEQ ID NO: 33262 - protein, 7 aa, Neisseria
AECQDGQ

SEQ ID NO: 33263 - protein, 9 aa, Neisseria
VMSRSARVI

SEQ ID NO: 33264 - protein, 8 aa, Neisseria
VRVPDDCF

SEQ ID NO: 33265 - protein, 7 aa, Neisseria
LVDEIDV

SEQ ID NO: 33266 - protein, 22 aa, Neisseria
YTGKELQDDINNDAAALEKFET

SEQ ID NO: 33267 - protein, 13 aa, Neisseria
DVSEAAARARTPK

SEQ ID NO: 33268 - protein, 8 aa, Neisseria
ASSGKTVN

SEQ ID NO: 33269 - protein, 7 aa, Neisseria
ADIDLPV

SEQ ID NO: 33270 - protein, 9 aa, Neisseria
GGTRKEVRF

SEQ ID NO: 33271 - protein, 5 aa, Neisseria
AECQD

SEQ ID NO: 33272 - protein, 6 aa, Neisseria
RSARVI

SEQ ID NO: 33273 - protein, 6 aa, Neisseria
VPDDCF

SEQ ID NO: 33274 - protein, 6 aa, Neisseria
RQVAQI

SEQ ID NO: 33275 - protein, 9 aa, Neisseria
AGLHVCNGV

SEQ ID NO: 33276 - protein, 10 aa, Neisseria
QCDKARHMRP

SEQ ID NO: 33277 - protein, 17 aa, Neisseria
LGGQINRHRQASNRGLC

SEQ ID NO: 33278 - protein, 11 aa, Neisseria
FGGFQGNREAQ

SEQ ID NO: 33279 - protein, 6 aa, Neisseria
LIDRQV

SEQ ID NO: 33280 - protein, 10 aa, Neisseria
GRQMPSEKTL

SEQ ID NO: 33281 - protein, 5 aa, Neisseria
QMRDY

SEQ ID NO: 33282 - protein, 8 aa, Neisseria
QCDKARHM

SEQ ID NO: 33283 - protein, 11 aa, Neisseria
INRHRQASNRG

SEQ ID NO: 33284 - protein, 7 aa, Neisseria
QGNREAQ

SEQ ID NO: 33285 - protein, 6 aa, Neisseria
LIDRQV

SEQ ID NO: 33286 - protein, 7 aa, Neisseria
MPSEKTL

SEQ ID NO: 33287 - protein, 8 aa, Neisseria
MLLNELEK

SEQ ID NO: 33288 - protein, 17 aa, Neisseria
DRIKAIGRRIAHGGEKY

SEQ ID NO: 33289 - protein, 10 aa, Neisseria
VLDELKACIP

SEQ ID NO: 33290 - protein, 11 aa, Neisseria
HNPANISGILA

SEQ ID NO: 33291 - protein, 9 aa, Neisseria
HFPGLPNVG

SEQ ID NO: 33292 - protein, 7 aa, Neisseria
SFHQTMP

SEQ ID NO: 33293 - protein, 6 aa, Neisseria
AVPREL

SEQ ID NO: 33294 - protein, 19 aa, Neisseria
EAARILGKPLEDIRMIIAH

SEQ ID NO: 33295 - protein, 14 aa, Neisseria
NGASITAVKNGKSV

SEQ ID NO: 33296 - protein, 5 aa, Neisseria
TPIEG

SEQ ID NO: 33297 - protein, 5 aa, Neisseria
YSYPT

SEQ ID NO: 33298 - protein, 12 aa, Neisseria
PGISELPNDCRT

SEQ ID NO: 33299 - protein, 10 aa, Neisseria
RLAKYIASMA

SEQ ID NO: 33300 - protein, 5 aa, Neisseria
VSYLD

SEQ ID NO: 33301 - protein, 14 aa, Neisseria
MDSRLRGNDARKYG

SEQ ID NO: 33302 - protein, 36 aa, Neisseria
FAQRGRLKHTPPNAHPFSDGPAPKKQPQTTRRNIMS

SEQ ID NO: 33303 - protein, 14 aa, Neisseria
SSLKGAVIDRKSGS

SEQ ID NO: 33304 - protein, 10 aa, Neisseria
LGERLTTPEA

SEQ ID NO: 33305 - protein, 19 aa, Neisseria
TFNKDGNKRQVPLSGRNCH

SEQ ID NO: 33306 - protein, 27 aa, Neisseria
ELEKHGLHDRIKAIGRRIAHGGEKYHE

SEQ ID NO: 33307 - protein, 13 aa, Neisseria
VLIDQDVLDELKA

SEQ ID NO: 33308 - protein, 7 aa, Neisseria
TMPERAY

SEQ ID NO: 33309 - protein, 19 aa, Neisseria
RELRKKYAFRRYGFHGTGM

SEQ ID NO: 33310 - protein, 14 aa, Neisseria
EAARILGKPLEDIR

SEQ ID NO: 33311 - protein, 5 aa, Neisseria
LGNGA

SEQ ID NO: 33312 - protein, 13 aa, Neisseria
TAVKNGKSVDTGM

SEQ ID NO: 33313 - protein, 10 aa, Neisseria
TRCGDTDPGV

SEQ ID NO: 33314 - protein, 39 aa, Neisseria
AQVDEMLNEKSGFPGISELPNDCRTLEIAADEGREGARL

SEQ ID NO: 33315 - protein, 13 aa, Neisseria
GIGENSRNIRAKT

SEQ ID NO: 33316 - protein, 16 aa, Neisseria
IDTKANMEKRYGNSGI

SEQ ID NO: 33317 - protein, 7 aa, Neisseria
SPTDSSP

SEQ ID NO: 33318 - protein, 6 aa, Neisseria
PTNEEL

SEQ ID NO: 33319 - protein, 14 aa, Neisseria
MDSRLRGNDARKYG

SEQ ID NO: 33320 - protein, 11 aa, Neisseria
FAQRGRLKHTP

SEQ ID NO: 33321 - protein, 18 aa, Neisseria
SDGPAPKKQPQTTRRNIM

SEQ ID NO: 33322 - protein, 8 aa, Neisseria
AVIDRKSG

SEQ ID NO: 33323 - protein, 7 aa, Neisseria
LGERLTT

SEQ ID NO: 33324 - protein, 18 aa, Neisseria
FNKDGNKRQVPLSGRNCH

SEQ ID NO: 33325 - protein, 27 aa, Neisseria
ELEKHGLHDRIKAIGRRIAHGGEKYHE

SEQ ID NO: 33326 - protein, 8 aa, Neisseria
DVLDELKA

SEQ ID NO: 33327 - protein, 6 aa, Neisseria
MPERAY

SEQ ID NO: 33328 - protein, 9 aa, Neisseria
RELRKKYAF

SEQ ID NO: 33329 - protein, 14 aa, Neisseria
EAARILGKPLEDIR

SEQ ID NO: 33330 - protein, 8 aa, Neisseria
KNGKSVDT

SEQ ID NO: 33331 - protein, 7 aa, Neisseria
RCGDTDP

SEQ ID NO: 33332 - protein, 12 aa, Neisseria
AQVDEMLNEKSG

SEQ ID NO: 33333 - protein, 21 aa, Neisseria
LPNDCRTLEIAADEGREGARL

SEQ ID NO: 33334 - protein, 12 aa, Neisseria
IGENSRNIRAKT

SEQ ID NO: 33335 - protein, 12 aa, Neisseria
IDTKANMEKRYG

SEQ ID NO: 33336 - protein, 5 aa, Neisseria
TNEEL

SEQ ID NO: 33337 - protein, 6 aa, Neisseria
SVVQFA

SEQ ID NO: 33338 - protein, 8 aa, Neisseria
IDVGGVYG

SEQ ID NO: 33339 - protein, 7 aa, Neisseria
DGFKFFQ

SEQ ID NO: 33340 - protein, 19 aa, Neisseria
DVVLQLFARVAQVGGVQEN

SEQ ID NO: 33341 - protein, 13 aa, Neisseria
RHINFVDQIAGWE

SEQ ID NO: 33342 - protein, 24 aa, Neisseria
SAACGKVDQRTEHGGGDGDRGDAH

SEQ ID NO: 33343 - protein, 8 aa, Neisseria
GAYRQIDV

SEQ ID NO: 33344 - protein, 18 aa, Neisseria
GGGRDEGGFRRARAGGGF

SEQ ID NO: 33345 - protein, 5 aa, Neisseria
ICADG

SEQ ID NO: 33346 - protein, 8 aa, Neisseria
KFFQRGGI

SEQ ID NO: 33347 - protein, 17 aa, Neisseria
GVQENGRNARVDERGFQ

SEQ ID NO: 33348 - protein, 20 aa, Neisseria
GKVDQRTEHGGGDGDRGDAH

SEQ ID NO: 33349 - protein, 13 aa, Neisseria
GGRDEGGFRRARA

SEQ ID NO: 33350 - protein, 16 aa, Neisseria
GVQENGRNARVDERGF

SEQ ID NO: 33351 - protein, 8 aa, Neisseria
RQIWKIAD

SEQ ID NO: 33352 - protein, 16 aa, Neisseria
TLFYRFISENFTDYMQ

SEQ ID NO: 33353 - protein, 9 aa, Neisseria
KLKEIFTAI

SEQ ID NO: 33354 - protein, 11 aa, Neisseria
QGIKGLFDDFD

SEQ ID NO: 33355 - protein, 5 aa, Neisseria
RLGST

SEQ ID NO: 33356 - protein, 9 aa, Neisseria
AVLKGVAEL

SEQ ID NO: 33357 - protein, 9 aa, Neisseria
DAYEYLISN

SEQ ID NO: 33358 - protein, 6 aa, Neisseria
AANAGK

SEQ ID NO: 33359 - protein, 7 aa, Neisseria
VSKLIAR

SEQ ID NO: 33360 - protein, 9 aa, Neisseria
EKVNKIYDP

SEQ ID NO: 33361 - protein, 5 aa, Neisseria
FDEHI

SEQ ID NO: 33362 - protein, 11 aa, Neisseria
DSKPFDAVVSN

SEQ ID NO: 33363 - protein, 5 aa, Neisseria
HALNY

SEQ ID NO: 33364 - protein, 5 aa, Neisseria
VSFPG

SEQ ID NO: 33365 - protein, 11 aa, Neisseria
EHIAEIVKLFA

SEQ ID NO: 33366 - protein, 8 aa, Neisseria
AQNAAQQT

SEQ ID NO: 33367 - protein, 7 aa, Neisseria
TREVIDI

SEQ ID NO: 33368 - protein, 25 aa, Neisseria
AEISETVAKIERLRREIDEVIAEIE

SEQ ID NO: 33369 - protein, 7 aa, Neisseria
MQQRAQL

SEQ ID NO: 33370 - protein, 13 aa, Neisseria
IADEVRGAVDGWD

SEQ ID NO: 33371 - protein, 17 aa, Neisseria
ISENFTDYMQAGDSSID

SEQ ID NO: 33372 - protein, 5 aa, Neisseria
AMPDS

SEQ ID NO: 33373 - protein, 10 aa, Neisseria
PEIKDDAVKV

SEQ ID NO: 33374 - protein, 13 aa, Neisseria
AHQNEELNTKLKE

SEQ ID NO: 33375 - protein, 27 aa, Neisseria
ESSASGYPSEQGIKGLFDDFDTTSSRL

SEQ ID NO: 33376 - protein, 8 aa, Neisseria
VADKNKRL

SEQ ID NO: 33377 - protein, 10 aa, Neisseria
DFGNFEDHRI

SEQ ID NO: 33378 - protein, 11 aa, Neisseria
NAGKSGGEFFT

SEQ ID NO: 33379 - protein, 17 aa, Neisseria
GQEKVNKIYDPACGSGS

SEQ ID NO: 33380 - protein, 7 aa, Neisseria
QAKKQFD

SEQ ID NO: 33381 - protein, 8 aa, Neisseria
EINHTTYN

SEQ ID NO: 33382 - protein, 18 aa, Neisseria
LGDTLTNPKLKDSKPFDA

SEQ ID NO: 33383 - protein, 16 aa, Neisseria
IGSDDPTLINDDRFAP

SEQ ID NO: 33384 - protein, 6 aa, Neisseria
PKSKAD

SEQ ID NO: 33385 - protein, 9 aa, Neisseria
YLSGRGRAA

SEQ ID NO: 33386 - protein, 10 aa, Neisseria
YRGGAEQKIR

SEQ ID NO: 33387 - protein, 9 aa, Neisseria
LSKHKDNTD

SEQ ID NO: 33388 - protein, 17 aa, Neisseria
GFFKKETNNNVLTEEHI

SEQ ID NO: 33389 - protein, 7 aa, Neisseria
FADKADV

SEQ ID NO: 33390 - protein, 8 aa, Neisseria
QTVKDNGY

SEQ ID NO: 33391 - protein, 11 aa, Neisseria
VEAEDTREVID

SEQ ID NO: 33392 - protein, 25 aa, Neisseria
EISETVAKIERLRREIDEVIAEIET

SEQ ID NO: 33393 - protein, 10 aa, Neisseria
IADEVRGAVD

SEQ ID NO: 33394 - protein, 5 aa, Neisseria
GDSSI

SEQ ID NO: 33395 - protein, 10 aa, Neisseria
PEIKDDAVKV

SEQ ID NO: 33396 - protein, 13 aa, Neisseria
AHQNEELNTKLKE

SEQ ID NO: 33397 - protein, 12 aa, Neisseria
LFDDFDTTSSRL

SEQ ID NO: 33398 - protein, 8 aa, Neisseria
VADKNKRL

SEQ ID NO: 33399 - protein, 7 aa, Neisseria
NFEDHRI

SEQ ID NO: 33400 - protein, 6 aa, Neisseria
AGKSGG

SEQ ID NO: 33401 - protein, 10 aa, Neisseria
GQEKVNKIYD

SEQ ID NO: 33402 - protein, 7 aa, Neisseria
QAKKQFD

SEQ ID NO: 33403 - protein, 9 aa, Neisseria
PKLKDSKPF

SEQ ID NO: 33404 - protein, 14 aa, Neisseria
GSDDPTLINDDRFA

SEQ ID NO: 33405 - protein, 6 aa, Neisseria
PKSKAD

SEQ ID NO: 33406 - protein, 5 aa, Neisseria
GRGRA

SEQ ID NO: 33407 - protein, 8 aa, Neisseria
GGAEQKIR

SEQ ID NO: 33408 - protein, 8 aa, Neisseria
SKHKDNTD

SEQ ID NO: 33409 - protein, 8 aa, Neisseria
GFFKKETN

SEQ ID NO: 33410 - protein, 6 aa, Neisseria
LTEEHI

SEQ ID NO: 33411 - protein, 7 aa, Neisseria
FADKADV

SEQ ID NO: 33412 - protein, 7 aa, Neisseria
QTVKDNG

SEQ ID NO: 33413 - protein, 11 aa, Neisseria
VEAEDTREVID

SEQ ID NO: 33414 - protein, 25 aa, Neisseria
EISETVAKIERLRREIDEVIAEIET

SEQ ID NO: 33415 - protein, 9 aa, Neisseria
LLDHMTRDE

SEQ ID NO: 33416 - protein, 7 aa, Neisseria
AHVGNGD

SEQ ID NO: 33417 - protein, 11 aa, Neisseria
LTLIQGVVNTF

SEQ ID NO: 33418 - protein, 5 aa, Neisseria
RIIAN

SEQ ID NO: 33419 - protein, 16 aa, Neisseria
SMVFQILFGFLASLIV

SEQ ID NO: 33420 - protein, 14 aa, Neisseria
KLVGAPKMISALQR

SEQ ID NO: 33421 - protein, 8 aa, Neisseria
DLPEEMNA

SEQ ID NO: 33422 - protein, 12 aa, Neisseria
EVIDTPRTEEEA

SEQ ID NO: 33423 - protein, 13 aa, Neisseria
EAQARQWNLKTPE

SEQ ID NO: 33424 - protein, 7 aa, Neisseria
HSPEPNA

SEQ ID NO: 33425 - protein, 8 aa, Neisseria
TGASRNSS

SEQ ID NO: 33426 - protein, 9 aa, Neisseria
HMTRDEVEA

SEQ ID NO: 33427 - protein, 5 aa, Neisseria
VGNGD

SEQ ID NO: 33428 - protein, 13 aa, Neisseria
IARNNDGSQSQGT

SEQ ID NO: 33429 - protein, 11 aa, Neisseria
RQREYRADAGA

SEQ ID NO: 33430 - protein, 16 aa, Neisseria
LQRLKGNPVDLPEEMN

SEQ ID NO: 33431 - protein, 23 aa, Neisseria
GDTRDSLLSTHPSLDNRIARLKS

SEQ ID NO: 33432 - protein, 12 aa, Neisseria
EVIDTPRTEEEA

SEQ ID NO: 33433 - protein, 5 aa, Neisseria
ASRNS

SEQ ID NO: 33434 - protein, 9 aa, Neisseria
HMTRDEVEA

SEQ ID NO: 33435 - protein, 8 aa, Neisseria
RNNDGSQS

SEQ ID NO: 33436 - protein, 11 aa, Neisseria
RQREYRADAGA

SEQ ID NO: 33437 - protein, 7 aa, Neisseria
QRLKGNP

SEQ ID NO: 33438 - protein, 7 aa, Neisseria
DLPEEMN

SEQ ID NO: 33439 - protein, 7 aa, Neisseria
GDTRDSL

SEQ ID NO: 33440 - protein, 12 aa, Neisseria
PSLDNRIARLKS

SEQ ID NO: 33441 - protein, 11 aa, Neisseria
KEIRLLTALAL

SEQ ID NO: 33442 - protein, 14 aa, Neisseria
FMGIMAALNPMIAQ

SEQ ID NO: 33443 - protein, 6 aa, Neisseria
TGEAGE

SEQ ID NO: 33444 - protein, 33 aa, Neisseria
GLILGIFGMILMWAAITPFRNWLTLSDYVEGTM

SEQ ID NO: 33445 - protein, 12 aa, Neisseria
MVHRALHAYASS

SEQ ID NO: 33446 - protein, 6 aa, Neisseria
FFRPFG

SEQ ID NO: 33447 - protein, 9 aa, Neisseria
FKQIWKIGA

SEQ ID NO: 33448 - protein, 9 aa, Neisseria
ARYISGVSL

SEQ ID NO: 33449 - protein, 7 aa, Neisseria
ITVLSLV

SEQ ID NO: 33450 - protein, 6 aa, Neisseria
PLASMY

SEQ ID NO: 33451 - protein, 14 aa, Neisseria
FQPADFTQCIASYA

SEQ ID NO: 33452 - protein, 9 aa, Neisseria
YGFWTALIA

SEQ ID NO: 33453 - protein, 6 aa, Neisseria
DLDRFS

SEQ ID NO: 33454 - protein, 8 aa, Neisseria
GAGKEDLA

SEQ ID NO: 33455 - protein, 14 aa, Neisseria
GAGKTGEAGETGRQ

SEQ ID NO: 33456 - protein, 5 aa, Neisseria
PFRNW

SEQ ID NO: 33457 - protein, 8 aa, Neisseria
LSDYVEGT

SEQ ID NO: 33458 - protein, 9 aa, Neisseria
ASSLNRPRL

SEQ ID NO: 33459 - protein, 7 aa, Neisseria
AKEKFFR

SEQ ID NO: 33460 - protein, 8 aa, Neisseria
AKFGKPDW

SEQ ID NO: 33461 - protein, 14 aa, Neisseria
SLGRREFSRARYIS

SEQ ID NO: 33462 - protein, 11 aa, Neisseria
PLASMYNDDPA

SEQ ID NO: 33463 - protein, 7 aa, Neisseria
RGYKVTK

SEQ ID NO: 33464 - protein, 8 aa, Neisseria
LVKSHKAV

SEQ ID NO: 33465 - protein, 8 aa, Neisseria
GAGKEDLA

SEQ ID NO: 33466 - protein, 10 aa, Neisseria
KTGEAGETGR

SEQ ID NO: 33467 - protein, 5 aa, Neisseria
LNRPR

SEQ ID NO: 33468 - protein, 6 aa, Neisseria
AKEKFF

SEQ ID NO: 33469 - protein, 8 aa, Neisseria
LGRREFSR

SEQ ID NO: 33470 - protein, 6 aa, Neisseria
YNDDPA

SEQ ID NO: 33471 - protein, 5 aa, Neisseria
YKVTK

SEQ ID NO: 33472 - protein, 8 aa, Neisseria
LVKSHKAV

SEQ ID NO: 33473 - protein, 7 aa, Neisseria
AIRKILQ

SEQ ID NO: 33474 - protein, 5 aa, Neisseria
VLSLL

SEQ ID NO: 33475 - protein, 12 aa, Neisseria
RASDELARIFGT

SEQ ID NO: 33476 - protein, 58 aa, Neisseria
DIGHGIKQIGRNIAEQIGGFSREPESANTGNEALADCLDEISRLRDGVERLNERLDRL

SEQ ID NO: 33477 - protein, 11 aa, Neisseria
LQSPDSRSELT

SEQ ID NO: 33478 - protein, 47 aa, Neisseria
LAGRITEDGLLSAGNGFADTEITFRNSAIRKILQGGEPGAGDIRLEG

SEQ ID NO: 33479 - protein, 12 aa, Neisseria
GSLRSRASDELA

SEQ ID NO: 33480 - protein, 10 aa, Neisseria
AGIGSRATDI

SEQ ID NO: 33481 - protein, 8 aa, Neisseria
KQIGRNIA

SEQ ID NO: 33482 - protein, 47 aa, Neisseria
IGGFSREPESANTGNEALADCLDEISRLRDGVERLNERLDRLERDIW

SEQ ID NO: 33483 - protein, 8 aa, Neisseria
SPDSRSEL

SEQ ID NO: 33484 - protein, 10 aa, Neisseria
LAGRITEDGL

SEQ ID NO: 33485 - protein, 7 aa, Neisseria
ADTEITF

SEQ ID NO: 33486 - protein, 8 aa, Neisseria
SAIRKILQ

SEQ ID NO: 33487 - protein, 12 aa, Neisseria
GEPGAGDIRLEG

SEQ ID NO: 33488 - protein, 10 aa, Neisseria
LRSRASDELA

SEQ ID NO: 33489 - protein, 7 aa, Neisseria
IGSRATD

SEQ ID NO: 33490 - protein, 44 aa, Neisseria
FSREPESANTGNEALADCLDEISRLRDGVERLNERLDRLERDIW

SEQ ID NO: 33491 - protein, 6 aa, Neisseria
TLDAFV

SEQ ID NO: 33492 - protein, 14 aa, Neisseria
HHIFHEFRVFVGLF

SEQ ID NO: 33493 - protein, 6 aa, Neisseria
FEQAVE

SEQ ID NO: 33494 - protein, 5 aa, Neisseria
IDNFL

SEQ ID NO: 33495 - protein, 6 aa, Neisseria
VAVCPV

SEQ ID NO: 33496 - protein, 7 aa, Neisseria
ALDDETL

SEQ ID NO: 33497 - protein, 10 aa, Neisseria
VGNQRSSDIA

SEQ ID NO: 33498 - protein, 16 aa, Neisseria
LDTDFGIGSQADGNVR

SEQ ID NO: 33499 - protein, 13 aa, Neisseria
GTRAKRGYGNHDL

SEQ ID NO: 33500 - protein, 5 aa, Neisseria
READI

SEQ ID NO: 33501 - protein, 7 aa, Neisseria
ALDDETL

SEQ ID NO: 33502 - protein, 6 aa, Neisseria
QRSSDI

SEQ ID NO: 33503 - protein, 7 aa, Neisseria
SQADGNV

SEQ ID NO: 33504 - protein, 8 aa, Neisseria
TRAKRGYG

SEQ ID NO: 33505 - protein, 5 aa, Neisseria
READI

SEQ ID NO: 33506 - protein, 6 aa, Neisseria
MQFPYR

SEQ ID NO: 33507 - protein, 6 aa, Neisseria
MRRMRR

SEQ ID NO: 33508 - protein, 8 aa, Neisseria
TGRAQEAY

SEQ ID NO: 33509 - protein, 10 aa, Neisseria
PSTVRALRER

SEQ ID NO: 33510 - protein, 6 aa, Neisseria
IREALE

SEQ ID NO: 33511 - protein, 11 aa, Neisseria
YASAFYGPFRD

SEQ ID NO: 33512 - protein, 8 aa, Neisseria
SGNLGKAD

SEQ ID NO: 33513 - protein, 10 aa, Neisseria
LDVVRRVKDE

SEQ ID NO: 33514 - protein, 5 aa, Neisseria
AAVAN

SEQ ID NO: 33515 - protein, 22 aa, Neisseria
RNVPASRMRRMRRDDFSRRLMR

SEQ ID NO: 33516 - protein, 7 aa, Neisseria
HMLTADD

SEQ ID NO: 33517 - protein, 20 aa, Neisseria
GAAREEDVPSMPGVKRQSLD

SEQ ID NO: 33518 - protein, 6 aa, Neisseria
AEEAVK

SEQ ID NO: 33519 - protein, 18 aa, Neisseria
TANKTGRAQEAYNPEGLV

SEQ ID NO: 33520 - protein, 8 aa, Neisseria
RALRERFP

SEQ ID NO: 33521 - protein, 18 aa, Neisseria
GQDGLTDENGYVMNDETV

SEQ ID NO: 33522 - protein, 22 aa, Neisseria
APSDMMDGRIGAIREALEDAGH

SEQ ID NO: 33523 - protein, 32 aa, Neisseria; identical to SEQ ID NO: 8005

SEQ ID NO: 33524 - protein, 8 aa, Neisseria
LDIQEGAD

SEQ ID NO: 33525 - protein, 11 aa, Neisseria
VVRRVKDEFGV

SEQ ID NO: 33526 - protein, 8 aa, Neisseria
WLDGGKVV

SEQ ID NO: 33527 - protein, 7 aa, Neisseria
KRAGADG

SEQ ID NO: 33528 - protein, 8 aa, Neisseria
EAAKMLKR

SEQ ID NO: 33529 - protein, 19 aa, Neisseria
PASRMRRMRRDDFSRRLMR

SEQ ID NO: 33530 - protein, 5 aa, Neisseria
HMLTA

SEQ ID NO: 33531 - protein, 10 aa, Neisseria
GAAREEDVPS

SEQ ID NO: 33532 - protein, 9 aa, Neisseria
PGVKRQSLD

SEQ ID NO: 33533 - protein, 6 aa, Neisseria
AEEAVK

SEQ ID NO: 33534 - protein, 11 aa, Neisseria
NKTGRAQEAYN

SEQ ID NO: 33535 - protein, 8 aa, Neisseria
RALRERFP

SEQ ID NO: 33536 - protein, 8 aa, Neisseria
DGLTDENG

SEQ ID NO: 33537 - protein, 6 aa, Neisseria
MNDETV

SEQ ID NO: 33538 - protein, 18 aa, Neisseria
DMMDGRIGAIREALEDAG

SEQ ID NO: 33539 - protein, 6 aa, Neisseria
FRDAVG

SEQ ID NO: 33540 - protein, 11 aa, Neisseria
NLGKADKKTYQ

SEQ ID NO: 33541 - protein, 9 aa, Neisseria
PANTDEALH

SEQ ID NO: 33542 - protein, 8 aa, Neisseria
LDIQEGAD

SEQ ID NO: 33543 - protein, 10 aa, Neisseria
VVRRVKDEFG

SEQ ID NO: 33544 - protein, 5 aa, Neisseria
KRAGA

SEQ ID NO: 33545 - protein, 8 aa, Neisseria
EAAKMLKR

SEQ ID NO: 33546 - protein, 9 aa, Neisseria
CRLFGKLSL

SEQ ID NO: 33547 - protein, 9 aa, Neisseria
RLLPGLCRG

SEQ ID NO: 33548 - protein, 7 aa, Neisseria
RSVRRVI

SEQ ID NO: 33549 - protein, 5 aa, Neisseria
QVVAV

SEQ ID NO: 33550 - protein, 7 aa, Neisseria
VFIEDFV

SEQ ID NO: 33551 - protein, 9 aa, Neisseria
GFLGNVLRT

SEQ ID NO: 33552 - protein, 13 aa, Neisseria
MPSENGMGKRQLA

SEQ ID NO: 33553 - protein, 13 aa, Neisseria
PGLCRGGVCRGRC

SEQ ID NO: 33554 - protein, 16 aa, Neisseria
FPSRSVRRVIFRRVRI

SEQ ID NO: 33555 - protein, 7 aa, Neisseria
NPADFRV

SEQ ID NO: 33556 - protein, 5 aa, Neisseria
APQED

SEQ ID NO: 33557 - protein, 13 aa, Neisseria
MPSENGMGKRQLA

SEQ ID NO: 33558 - protein, 7 aa, Neisseria
GVCRGRC

SEQ ID NO: 33559 - protein, 8 aa, Neisseria
VIFRRVRI

SEQ ID NO: 33560 - protein, 5 aa, Neisseria
ADFRV

SEQ ID NO: 33561 - protein, 9 aa, Neisseria
NIAKKLAGV

SEQ ID NO: 33562 - protein, 11 aa, Neisseria
KAVEKCAENVL

SEQ ID NO: 33563 - protein, 6 aa, Neisseria
VGDFPN

SEQ ID NO: 33564 - protein, 9 aa, Neisseria
IAKKLAGVD

SEQ ID NO: 33565 - protein, 7 aa, Neisseria
IAFDFDG

SEQ ID NO: 33566 - protein, 13 aa, Neisseria
DFGRDDAVRHSGV

SEQ ID NO: 33567 - protein, 8 aa, Neisseria
KAVEKCAE

SEQ ID NO: 33568 - protein, 19 aa, Neisseria
HHRNPYIKLNKSKSPDIFR

SEQ ID NO: 33569 - protein, 6 aa, Neisseria
FYGHSN

SEQ ID NO: 33570 - protein, 9 aa, Neisseria
IAKKLAGVD

SEQ ID NO: 33571 - protein, 8 aa, Neisseria
FGRDDAVR

SEQ ID NO: 33572 - protein, 8 aa, Neisseria
KAVEKCAE

SEQ ID NO: 33573 - protein, 11 aa, Neisseria
KLNKSKSPDIF

SEQ ID NO: 33574 - protein, 14 aa, Neisseria
MPRMRSPSSLMSPA

SEQ ID NO: 33575 - protein, 7 aa, Neisseria
SSVMRPA

SEQ ID NO: 33576 - protein, 9 aa, Neisseria
ERLSGLCRI

SEQ ID NO: 33577 - protein, 7 aa, Neisseria
DIFSDWG

SEQ ID NO: 33578 - protein, 18 aa, Neisseria
MSRSSLSRRSLRRSTPSR

SEQ ID NO: 33579 - protein, 8 aa, Neisseria
SSRQSARA

SEQ ID NO: 33580 - protein, 13 aa, Neisseria
ADSGSRENPPICS

SEQ ID NO: 33581 - protein, 22 aa, Neisseria
PKIRANSSDARERRLPSRDSTA

SEQ ID NO: 33582 - protein, 9 aa, Neisseria
PRMRSPSSL

SEQ ID NO: 33583 - protein, 7 aa, Neisseria
PAPGSPP

SEQ ID NO: 33584 - protein, 18 aa, Neisseria
AKPFPAESKPSSVMRPAS

SEQ ID NO: 33585 - protein, 18 aa, Neisseria
PAKEVSSERLSGLCRIRR

SEQ ID NO: 33586 - protein, 16 aa, Neisseria
MMGRRADIFSDWGGEC

SEQ ID NO: 33587 - protein, 17 aa, Neisseria
MSRSSLSRRSLRRSTPS

SEQ ID NO: 33588 - protein, 7 aa, Neisseria
SRQSARA

SEQ ID NO: 33589 - protein, 8 aa, Neisseria
SGSRENPP

SEQ ID NO: 33590 - protein, 22 aa, Neisseria
PKIRANSSDARERRLPSRDSTA

SEQ ID NO: 33591 - protein, 7 aa, Neisseria
PRMRSPS

SEQ ID NO: 33592 - protein, 12 aa, Neisseria
FPAESKPSSVMR

SEQ ID NO: 33593 - protein, 12 aa, Neisseria
PAKEVSSERLSG

SEQ ID NO: 33594 - protein, 5 aa, Neisseria
CRIRR

SEQ ID NO: 33595 - protein, 8 aa, Neisseria
MMGRRADI

SEQ ID NO: 33596 - protein, 10 aa, Neisseria
SQFIRQVNNG

SEQ ID NO: 33597 - protein, 8 aa, Neisseria
NLIQTLLN

SEQ ID NO: 33598 - protein, 10 aa, Neisseria
ALFYSLLPVL

SEQ ID NO: 33599 - protein, 27 aa, Neisseria
VAGCDEAKEEVQEIVDYLKAPNRYQSL

SEQ ID NO: 33600 - protein, 7 aa, Neisseria
DFVEMFV

SEQ ID NO: 33601 - protein, 8 aa, Neisseria
RVRDMFEQ

SEQ ID NO: 33602 - protein, 7 aa, Neisseria
EIDAVGR

SEQ ID NO: 33603 - protein, 10 aa, Neisseria
PALQRPGRFD

SEQ ID NO: 33604 - protein, 8 aa, Neisseria
SVDLLSLA

SEQ ID NO: 33605 - protein, 7 aa, Neisseria
ADLAKLV

SEQ ID NO: 33606 - protein, 12 aa, Neisseria
LDGKKEDNGQIE

SEQ ID NO: 33607 - protein, 9 aa, Neisseria
QVNNGEVSG

SEQ ID NO: 33608 - protein, 12 aa, Neisseria
LIKGERTDKSTF

SEQ ID NO: 33609 - protein, 8 aa, Neisseria
NAPLDDNL

SEQ ID NO: 33610 - protein, 18 aa, Neisseria
LLNKNVRVKVTPEEKPSA

SEQ ID NO: 33611 - protein, 9 aa, Neisseria
QAGGGGKGG

SEQ ID NO: 33612 - protein, 16 aa, Neisseria
SFGKSRARLLDKDANK

SEQ ID NO: 33613 - protein, 12 aa, Neisseria
AGCDEAKEEVQE

SEQ ID NO: 33614 - protein, 17 aa, Neisseria
LKAPNRYQSLGGRVPRG

SEQ ID NO: 33615 - protein, 10 aa, Neisseria
GSPGTGKTLL

SEQ ID NO: 33616 - protein, 5 aa, Neisseria
SGSDF

SEQ ID NO: 33617 - protein, 16 aa, Neisseria
GASRVRDMFEQAKKNA

SEQ ID NO: 33618 - protein, 25 aa, Neisseria
DEIDAVGRQRGAGLGGGNDEREQTL

SEQ ID NO: 33619 - protein, 8 aa, Neisseria
MDGFESNQ

SEQ ID NO: 33620 - protein, 19 aa, Neisseria
TNRPDVLDPALQRPGRFDR

SEQ ID NO: 33621 - protein, 10 aa, Neisseria
  VARIANT 10: Xaa is any amino acid
LPDIRGREQX

SEQ ID NO: 33622 - protein, 13 aa, Neisseria
VHSKKVPLDESVD

SEQ ID NO: 33623 - protein, 8 aa, Neisseria
RGTPGFSG

SEQ ID NO: 33624 - protein, 21 aa, Neisseria
AGRRNKVKVDQSDLKTPKTKS

SEQ ID NO: 33625 - protein, 10 aa, Neisseria
LDGKKEDNGQ

SEQ ID NO: 33626 - protein, 7 aa, Neisseria
VNNGEVS

SEQ ID NO: 33627 - protein, 10 aa, Neisseria
IKGERTDKST

SEQ ID NO: 33628 - protein, 6 aa, Neisseria
PLDDNL

SEQ ID NO: 33629 - protein, 15 aa, Neisseria
KNVRVKVTPEEKPSA

SEQ ID NO: 33630 - protein, 6 aa, Neisseria
GGGKGG

SEQ ID NO: 33631 - protein, 14 aa, Neisseria
GKSRARLLDKDANK

SEQ ID NO: 33632 - protein, 12 aa, Neisseria
AGCDEAKEEVQE

SEQ ID NO: 33633 - protein, 5 aa, Neisseria
KAPNR

SEQ ID NO: 33634 - protein, 6 aa, Neisseria
GGRVPR

SEQ ID NO: 33635 - protein, 14 aa, Neisseria
SRVRDMFEQAKKNA

SEQ ID NO: 33636 - protein, 13 aa, Neisseria
DEIDAVGRQRGAG

SEQ ID NO: 33637 - protein, 9 aa, Neisseria
GGNDEREQT

SEQ ID NO: 33638 - protein, 5 aa, Neisseria
DGFES

SEQ ID NO: 33639 - protein, 8 aa, Neisseria
TNRPDVLD

SEQ ID NO: 33640 - protein, 10 aa, Neisseria
ALQRPGRFDR

SEQ ID NO: 33641 - protein, 9 aa, Neisseria
  VARIANT 9: Xaa is any amino acid
PDIRGREQX

SEQ ID NO: 33642 - protein, 12 aa, Neisseria
HSKKVPLDESVD

SEQ ID NO: 33643 - protein, 20 aa, Neisseria
AGRRNKVKVDQSDLKTPKTK

SEQ ID NO: 33644 - protein, 6 aa, Neisseria
KMVVGL

SEQ ID NO: 33645 - protein, 7 aa, Neisseria
NPGKEYE

SEQ ID NO: 33646 - protein, 7 aa, Neisseria
FGEVARA

SEQ ID NO: 33647 - protein, 9 aa, Neisseria
VAALAQFYK

SEQ ID NO: 33648 - protein, 8 aa, Neisseria
GHNGLKDI

SEQ ID NO: 33649 - protein, 6 aa, Neisseria
LNKPSA

SEQ ID NO: 33650 - protein, 8 aa, Neisseria
HHFRQMGR

SEQ ID NO: 33651 - protein, 8 aa, Neisseria
TAFSRFPY

SEQ ID NO: 33652 - protein, 10 aa, Neisseria
APVQNLPNVA

SEQ ID NO: 33653 - protein, 8 aa, Neisseria
GGIYSLLF

SEQ ID NO: 33654 - protein, 5 aa, Neisseria
FDKAA

SEQ ID NO: 33655 - protein, 6 aa, Neisseria
ECAQAW

SEQ ID NO: 33656 - protein, 12 aa, Neisseria
TGSLGDVLADLT

SEQ ID NO: 33657 - protein, 17 aa, Neisseria
LGNPGKEYEQTRHNAGF

SEQ ID NO: 33658 - protein, 10 aa, Neisseria
ASFKEEKKFF

SEQ ID NO: 33659 - protein, 5 aa, Neisseria
ALPDG

SEQ ID NO: 33660 - protein, 7 aa, Neisseria
MNRSGQA

SEQ ID NO: 33661 - protein, 5 aa, Neisseria
IKPEE

SEQ ID NO: 33662 - protein, 12 aa, Neisseria
DELDIPCGRIKF

SEQ ID NO: 33663 - protein, 16 aa, Neisseria
LGGGNGGHNGLKDIQA

SEQ ID NO: 33664 - protein, 9 aa, Neisseria
IGHPGDRNL

SEQ ID NO: 33665 - protein, 37 aa, Neisseria
LNKPSAEAPPANRRCRRQIPAGRTRHHFRQMGRGNAL

SEQ ID NO: 33666 - protein, 8 aa, Neisseria
RLKPFQTA

SEQ ID NO: 33667 - protein, 11 aa, Neisseria
PYPNSHERTQA

SEQ ID NO: 33668 - protein, 17 aa, Neisseria
YPNGIHPRHRRNPRFPA

SEQ ID NO: 33669 - protein, 27 aa, Neisseria
RMQHRRSTVRRRSGTMARHTCRTRRQI

SEQ ID NO: 33670 - protein, 15 aa, Neisseria
VAGRGGGMKLPRNRF

SEQ ID NO: 33671 - protein, 8 aa, Neisseria
AADTAPPP

SEQ ID NO: 33672 - protein, 7 aa, Neisseria
PHFDKAA

SEQ ID NO: 33673 - protein, 10 aa, Neisseria
AFKTGKLPIP

SEQ ID NO: 33674 - protein, 8 aa, Neisseria
ATRTGSLG

SEQ ID NO: 33675 - protein, 8 aa, Neisseria
ARSACRPD

SEQ ID NO: 33676 - protein, 11 aa, Neisseria
NPGKEYEQTRH

SEQ ID NO: 33677 - protein, 10 aa, Neisseria
ASFKEEKKFF

SEQ ID NO: 33678 - protein, 5 aa, Neisseria
IKPEE

SEQ ID NO: 33679 - protein, 12 aa, Neisseria
DELDIPCGRIKF

SEQ ID NO: 33680 - protein, 8 aa, Neisseria
NGLKDIQA

SEQ ID NO: 33681 - protein, 7 aa, Neisseria
HPGDRNL

SEQ ID NO: 33682 - protein, 25 aa, Neisseria
PSAEAPPANRRCRRQIPAGRTRHHF

SEQ ID NO: 33683 - protein, 7 aa, Neisseria
NSHERTQ

SEQ ID NO: 33684 - protein, 10 aa, Neisseria
IHPRHRRNPR

SEQ ID NO: 33685 - protein, 15 aa, Neisseria
MQHRRSTVRRRSGTM

SEQ ID NO: 33686 - protein, 9 aa, Neisseria
HTCRTRRQI

SEQ ID NO: 33687 - protein, 6 aa, Neisseria
AGRGGG

SEQ ID NO: 33688 - protein, 7 aa, Neisseria
KLPRNRF

SEQ ID NO: 33689 - protein, 5 aa, Neisseria
AADTA

SEQ ID NO: 33690 - protein, 6 aa, Neisseria
HFDKAA

SEQ ID NO: 33691 - protein, 6 aa, Neisseria
AFKTGK

SEQ ID NO: 33692 - protein, 6 aa, Neisseria
SACRPD

SEQ ID NO: 33693 - protein, 6 aa, Neisseria
KLAALL

SEQ ID NO: 33694 - protein, 8 aa, Neisseria
QLFQTLTN

SEQ ID NO: 33695 - protein, 17 aa, Neisseria
GVIFGILFRSLSSLLSR

SEQ ID NO: 33696 - protein, 5 aa, Neisseria
DPEEF

SEQ ID NO: 33697 - protein, 7 aa, Neisseria
NMFAGFN

SEQ ID NO: 33698 - protein, 21 aa, Neisseria
AVVGPVSFFGLLAASLANHFS

SEQ ID NO: 33699 - protein, 7 aa, Neisseria
LSVVVEF

SEQ ID NO: 33700 - protein, 7 aa, Neisseria
MPSEKNI

SEQ ID NO: 33701 - protein, 7 aa, Neisseria
GSSRPLR

SEQ ID NO: 33702 - protein, 7 aa, Neisseria
NVKGDWD

SEQ ID NO: 33703 - protein, 9 aa, Neisseria
IRQGGRDLP

SEQ ID NO: 33704 - protein, 8 aa, Neisseria
MIDPEEFT

SEQ ID NO: 33705 - protein, 6 aa, Neisseria
TVRSEL

SEQ ID NO: 33706 - protein, 16 aa, Neisseria
ERYRSDVHLLGRDQAV

SEQ ID NO: 33707 - protein, 9 aa, Neisseria
FSPSVRHSV

SEQ ID NO: 33708 - protein, 7 aa, Neisseria
MPSEKNI

SEQ ID NO: 33709 - protein, 5 aa, Neisseria
SSRPL

SEQ ID NO: 33710 - protein, 7 aa, Neisseria
QGGRDLP

SEQ ID NO: 33711 - protein, 8 aa, Neisseria
MIDPEEFT

SEQ ID NO: 33712 - protein, 5 aa, Neisseria
VRSEL

SEQ ID NO: 33713 - protein, 7 aa, Neisseria
ERYRSDV

SEQ ID NO: 33714 - protein, 7 aa, Neisseria
LLGRDQA

SEQ ID NO: 33715 - protein, 5 aa, Neisseria
VRHSV

SEQ ID NO: 33716 - protein, 9 aa, Neisseria
IVAVFALSA

SEQ ID NO: 33717 - protein, 6 aa, Neisseria
ISDRSV

SEQ ID NO: 33718 - protein, 32 aa, Neisseria
VKQMFGYTKLPEEPKGIRVIYVTDMGNVTDWT

SEQ ID NO: 33719 - protein, 5 aa, Neisseria
QAEKF

SEQ ID NO: 33720 - protein, 37 aa, Neisseria
ACRQAEEAPPPLPRQISDRSVGHYCSMNLTEHNGPKA

SEQ ID NO: 33721 - protein, 9 aa, Neisseria
LNGKPDQPV

SEQ ID NO: 33722 - protein, 11 aa, Neisseria
YTKLPEEPKGI

SEQ ID NO: 33723 - protein, 22 aa, Neisseria
DMGNVTDWTNPNADTEWIDAKK

SEQ ID NO: 33724 - protein, 29 aa, Neisseria
GMGAEDALPFGNKEQAEKFAKDKGGKVVG

SEQ ID NO: 33725 - protein, 5 aa, Neisseria
DDMPD

SEQ ID NO: 33726 - protein, 10 aa, Neisseria
RQAEEAPPPL

SEQ ID NO: 33727 - protein, 7 aa, Neisseria
QISDRSV

SEQ ID NO: 33728 - protein, 6 aa, Neisseria
EHNGPK

SEQ ID NO: 33729 - protein, 5 aa, Neisseria
GKPDQ

SEQ ID NO: 33730 - protein, 9 aa, Neisseria
KLPEEPKGI

SEQ ID NO: 33731 - protein, 11 aa, Neisseria
NADTEWIDAKK

SEQ ID NO: 33732 - protein, 6 aa, Neisseria
GAEDAL

SEQ ID NO: 33733 - protein, 16 aa, Neisseria
GNKEQAEKFAKDKGGK

SEQ ID NO: 33734 - protein, 5 aa, Neisseria
DDMPD

SEQ ID NO: 33735 - protein, 10 aa, Neisseria
LPEAVRNLAR

SEQ ID NO: 33736 - protein, 9 aa, Neisseria
EEIIRWLAD

SEQ ID NO: 33737 - protein, 14 aa, Neisseria
ILGQIKDAVRAAQE

SEQ ID NO: 33738 - protein, 8 aa, Neisseria
KLNALFQK

SEQ ID NO: 33739 - protein, 6 aa, Neisseria
SVAKEV

SEQ ID NO: 33740 - protein, 9 aa, Neisseria
EQIFPDIGD

SEQ ID NO: 33741 - protein, 7 aa, Neisseria
EMIELVA

SEQ ID NO: 33742 - protein, 7 aa, Neisseria
AQELCDK

SEQ ID NO: 33743 - protein, 7 aa, Neisseria
DLPAILH

SEQ ID NO: 33744 - protein, 5 aa, Neisseria
DLNDA

SEQ ID NO: 33745 - protein, 11 aa, Neisseria
VDDMVNIVQSG

SEQ ID NO: 33746 - protein, 10 aa, Neisseria
EKVAEFVRQQ

SEQ ID NO: 33747 - protein, 7 aa, Neisseria
LRDEGEK

SEQ ID NO: 33748 - protein, 13 aa, Neisseria
KQVLENAMKQLAK

SEQ ID NO: 33749 - protein, 11 aa, Neisseria
EVLERLSVQLT

SEQ ID NO: 33750 - protein, 15 aa, Neisseria
KLLHSPTQTLNKAGE

SEQ ID NO: 33751 - protein, 7 aa, Neisseria
SIREKLA

SEQ ID NO: 33752 - protein, 12 aa, Neisseria
EAVRNLARSNAA

SEQ ID NO: 33753 - protein, 6 aa, Neisseria
TCNRTE

SEQ ID NO: 33754 - protein, 9 aa, Neisseria
CVGDSEEII

SEQ ID NO: 33755 - protein, 8 aa, Neisseria
PIEEIRPY

SEQ ID NO: 33756 - protein, 8 aa, Neisseria
DMQETVRH

SEQ ID NO: 33757 - protein, 17 aa, Neisseria
QIKDAVRAAQEQESMGA

SEQ ID NO: 33758 - protein, 17 aa, Neisseria
SVAKEVRTDTAVGENSV

SEQ ID NO: 33759 - protein, 6 aa, Neisseria
DIGDLN

SEQ ID NO: 33760 - protein, 5 aa, Neisseria
KNPRL

SEQ ID NO: 33761 - protein, 17 aa, Neisseria
TLARAQELCDKLGVNAE

SEQ ID NO: 33762 - protein, 12 aa, Neisseria
GMVERALKQRQS

SEQ ID NO: 33763 - protein, 15 aa, Neisseria
AVPRDIEAEVGDLND

SEQ ID NO: 33764 - protein, 13 aa, Neisseria
QSGKEARQKAAAA

SEQ ID NO: 33765 - protein, 19 aa, Neisseria
LVSEKVAEFVRQQQGRQSV

SEQ ID NO: 33766 - protein, 15 aa, Neisseria
KALRDEGEKARKQVL

SEQ ID NO: 33767 - protein, 8 aa, Neisseria
ATAEEVLE

SEQ ID NO: 33768 - protein, 24 aa, Neisseria
LTNKLLHSPTQTLNKAGEEDKDLV

SEQ ID NO: 33769 - protein, 7 aa, Neisseria
SIREKLA

SEQ ID NO: 33770 - protein, 12 aa, Neisseria
EAVRNLARSNAA

SEQ ID NO: 33771 - protein, 7 aa, Neisseria
GDSEEII

SEQ ID NO: 33772 - protein, 6 aa, Neisseria
PIEEIR

SEQ ID NO: 33773 - protein, 8 aa, Neisseria
DMQETVRH

SEQ ID NO: 33774 - protein, 16 aa, Neisseria
QIKDAVRAAQEQESMG

SEQ ID NO: 33775 - protein, 13 aa, Neisseria
SVAKEVRTDTAVG

SEQ ID NO: 33776 - protein, 10 aa, Neisseria
TLARAQELCD

SEQ ID NO: 33777 - protein, 12 aa, Neisseria
GMVERALKQRQS

SEQ ID NO: 33778 - protein, 14 aa, Neisseria
AVPRDIEAEVGDLN

SEQ ID NO: 33779 - protein, 13 aa, Neisseria
QSGKEARQKAAAA

SEQ ID NO: 33780 - protein, 11 aa, Neisseria
LVSEKVAEFVR

SEQ ID NO: 33781 - protein, 6 aa, Neisseria
QQGRQS

SEQ ID NO: 33782 - protein, 15 aa, Neisseria
KALRDEGEKARKQVL

SEQ ID NO: 33783 - protein, 8 aa, Neisseria
ATAEEVLE

SEQ ID NO: 33784 - protein, 13 aa, Neisseria
TLNKAGEEDKDLV

SEQ ID NO: 33785 - protein, 8 aa, Neisseria
GIIGIFLP

SEQ ID NO: 33786 - protein, 7 aa, Neisseria
RFHRWLH

SEQ ID NO: 33787 - protein, 5 aa, Neisseria
PMVHN

SEQ ID NO: 33788 - protein, 5 aa, Neisseria
SSVFC

SEQ ID NO: 33789 - protein, 9 aa, Neisseria
KASPRFHRW

SEQ ID NO: 33790 - protein, 9 aa, Neisseria
HRHRYFGPM

SEQ ID NO: 33791 - protein, 12 aa, Neisseria
WEQNGAVPRKAK

SEQ ID NO: 33792 - protein, 6 aa, Neisseria
WHRPES

SEQ ID NO: 33793 - protein, 8 aa, Neisseria
GAVPRKAK

SEQ ID NO: 33794 - protein, 5 aa, Neisseria
HRPES

SEQ ID NO: 33795 - protein, 9 aa, Neisseria
TRRVRSWLA

SEQ ID NO: 33796 - protein, 10 aa, Neisseria
SSGRIISIAA

SEQ ID NO: 33797 - protein, 10 aa, Neisseria
KMPPEMVYRA

SEQ ID NO: 33798 - protein, 6 aa, Neisseria
MKGIYS

SEQ ID NO: 33799 - protein, 14 aa, Neisseria
RKMKKMTMCTRRVR

SEQ ID NO: 33800 - protein, 11 aa, Neisseria
PFKSPQTKMPP

SEQ ID NO: 33801 - protein, 8 aa, Neisseria
ASSSRMKG

SEQ ID NO: 33802 - protein, 16 aa, Neisseria
DAPKTKLNGMRKSNVQ

SEQ ID NO: 33803 - protein, 14 aa, Neisseria
RKMKKMTMCTRRVR

SEQ ID NO: 33804 - protein, 8 aa, Neisseria
SPQTKMPP

SEQ ID NO: 33805 - protein, 7 aa, Neisseria
SSSRMKG

SEQ ID NO: 33806 - protein, 16 aa, Neisseria
DAPKTKLNGMRKSNVQ

SEQ ID NO: 33807 - protein, 5 aa, Neisseria
LQNLV

SEQ ID NO: 33808 - protein, 44 aa, Neisseria
IAEVGKLFLGIFITIFPVLSILKAGEAGALGGVVSLVHDTAGHP

SEQ ID NO: 33809 - protein, 10 aa, Neisseria
GILSAFLDNA

SEQ ID NO: 33810 - protein, 17 aa, Neisseria
FMGALTYIGNAPNFMVK

SEQ ID NO: 33811 - protein, 6 aa, Neisseria
PTFFRY

SEQ ID NO: 33812 - protein, 10 aa, Neisseria
GLWKPEHPGF

SEQ ID NO: 33813 - protein, 13 aa, Neisseria
TPKQVRAGNEFNF

SEQ ID NO: 33814 - protein, 5 aa, Neisseria
DTAGH

SEQ ID NO: 33815 - protein, 5 aa, Neisseria
AGGDA

SEQ ID NO: 33816 - protein, 9 aa, Neisseria
AIAEQRGVP

SEQ ID NO: 33817 - protein, 7 aa, Neisseria
WKPEHPG

SEQ ID NO: 33818 - protein, 7 aa, Neisseria
KQVRAGN

SEQ ID NO: 33819 - protein, 8 aa, Neisseria
AIAEQRGV

SEQ ID NO: 33820 - protein, 14 aa, Neisseria
CGPPNSCVSILAAF

SEQ ID NO: 33821 - protein, 8 aa, Neisseria
DGTSAPAA

SEQ ID NO: 33822 - protein, 7 aa, Neisseria
HTWILRS

SEQ ID NO: 33823 - protein, 10 aa, Neisseria
KPAGCGPPNS

SEQ ID NO: 33824 - protein, 7 aa, Neisseria
FSDGTSA

SEQ ID NO: 33825 - protein, 16 aa, Neisseria
SVRRLNTNRPRLKSSA

SEQ ID NO: 33826 - protein, 8 aa, Neisseria
MANGSAST

SEQ ID NO: 33827 - protein, 16 aa, Neisseria
GRVRSAVHKPDIRLRR

SEQ ID NO: 33828 - protein, 5 aa, Neisseria
SASGT

SEQ ID NO: 33829 - protein, 16 aa, Neisseria
SVRRLNTNRPRLKSSA

SEQ ID NO: 33830 - protein, 16 aa, Neisseria
GRVRSAVHKPDIRLRR

SEQ ID NO: 33831 - protein, 7 aa, Neisseria
RWSDVFS

SEQ ID NO: 33832 - protein, 8 aa, Neisseria
ISRLPRTF

SEQ ID NO: 33833 - protein, 8 aa, Neisseria
VAALIGML

SEQ ID NO: 33834 - protein, 13 aa, Neisseria
  VARIANT 1: Xaa is any amino acid
XIFGGVVEAVATF

SEQ ID NO: 33835 - protein, 12 aa, Neisseria
MLQMLGVWQQGD

SEQ ID NO: 33836 - protein, 6 aa, Neisseria
ILGLGE

SEQ ID NO: 33837 - protein, 16 aa, Neisseria
VPNIVSRLMGDRLRQS

SEQ ID NO: 33838 - protein, 5 aa, Neisseria
IIGRM

SEQ ID NO: 33839 - protein, 6 aa, Neisseria
TVFGVL

SEQ ID NO: 33840 - protein, 6 aa, Neisseria
SLSDSQ

SEQ ID NO: 33841 - protein, 5 aa, Neisseria
RLPRT

SEQ ID NO: 33842 - protein, 13 aa, Neisseria
NRFVEPSMAGAGQ

SEQ ID NO: 33843 - protein, 7 aa, Neisseria
RRLPPTA

SEQ ID NO: 33844 - protein, 9 aa, Neisseria
LMGDRLRQS

SEQ ID NO: 33845 - protein, 8 aa, Neisseria
LMGDRLRQ

SEQ ID NO: 33846 - protein, 6 aa, Neisseria
PDLLQQ

SEQ ID NO: 33847 - protein, 9 aa, Neisseria
GGFWEVLFA

SEQ ID NO: 33848 - protein, 8 aa, Neisseria
FGGTGKNF

SEQ ID NO: 33849 - protein, 14 aa, Neisseria
AVDGYSGATALAQW

SEQ ID NO: 33850 - protein, 8 aa, Neisseria
ADGLKNAV

SEQ ID NO: 33851 - protein, 15 aa, Neisseria
DAFIGKLPGSIGEVS

SEQ ID NO: 33852 - protein, 14 aa, Neisseria
FARIASWRIIAGVM

SEQ ID NO: 33853 - protein, 9 aa, Neisseria
IAMSSLINF

SEQ ID NO: 33854 - protein, 7 aa, Neisseria
IAHDGNY

SEQ ID NO: 33855 - protein, 5 aa, Neisseria
MSPEA

SEQ ID NO: 33856 - protein, 9 aa, Neisseria
SVRKHEINE

SEQ ID NO: 33857 - protein, 11 aa, Neisseria
EVFGGTGKNFM

SEQ ID NO: 33858 - protein, 9 aa, Neisseria
YPANLSGDA

SEQ ID NO: 33859 - protein, 6 aa, Neisseria
GADGLK

SEQ ID NO: 33860 - protein, 6 aa, Neisseria
LPGSIG

SEQ ID NO: 33861 - protein, 6 aa, Neisseria
GSDTKA

SEQ ID NO: 33862 - protein, 11 aa, Neisseria
GTWWKDDYHSL

SEQ ID NO: 33863 - protein, 8 aa, Neisseria
SVRKHEIN

SEQ ID NO: 33864 - protein, 5 aa, Neisseria
SDTKA

SEQ ID NO: 33865 - protein, 8 aa, Neisseria
LARFVDNI

SEQ ID NO: 33866 - protein, 6 aa, Neisseria
IVDIVE

SEQ ID NO: 33867 - protein, 11 aa, Neisseria
DIVEHFEPFGK

SEQ ID NO: 33868 - protein, 8 aa, Neisseria
PFGNVVAD

SEQ ID NO: 33869 - protein, 6 aa, Neisseria
RAGRVP

SEQ ID NO: 33870 - protein, 14 aa, Neisseria
RIGRTMKVYAERII

SEQ ID NO: 33871 - protein, 9 aa, Neisseria
ERYVRRVYG

SEQ ID NO: 33872 - protein, 12 aa, Neisseria
LVPFDGCGTVGR

SEQ ID NO: 33873 - protein, 24 aa, Neisseria
SQFDRIARPGAGKNFGKVVLRGNV

SEQ ID NO: 33874 - protein, 8 aa, Neisseria
WPNKIKHH

SEQ ID NO: 33875 - protein, 5 aa, Neisseria
GKNAL

SEQ ID NO: 33876 - protein, 5 aa, Neisseria
ADGDI

SEQ ID NO: 33877 - protein, 5 aa, Neisseria
EPFGK

SEQ ID NO: 33878 - protein, 7 aa, Neisseria
VDGETQV

SEQ ID NO: 33879 - protein, 8 aa, Neisseria
AGIGKNAV

SEQ ID NO: 33880 - protein, 14 aa, Neisseria
VADDLRAGRVPNGN

SEQ ID NO: 33881 - protein, 6 aa, Neisseria
RIGRTM

SEQ ID NO: 33882 - protein, 7 aa, Neisseria
QGARGGF

SEQ ID NO: 33883 - protein, 15 aa, Neisseria
HTGTGNGQVAERYVR

SEQ ID NO: 33884 - protein, 17 aa, Neisseria
DGCGTVGRPFNRNRFVD

SEQ ID NO: 33885 - protein, 18 aa, Neisseria
AGSQFDRIARPGAGKNFG

SEQ ID NO: 33886 - protein, 24 aa, Neisseria
VLRGNVDDGCRCRLKNAAGGKYQH

SEQ ID NO: 33887 - protein, 9 aa, Neisseria
LQPYTERGC

SEQ ID NO: 33888 - protein, 10 aa, Neisseria
WPNKIKHHSN

SEQ ID NO: 33889 - protein, 8 aa, Neisseria
AKPPETVR

SEQ ID NO: 33890 - protein, 5 aa, Neisseria
ADGDI

SEQ ID NO: 33891 - protein, 7 aa, Neisseria
VDGETQV

SEQ ID NO: 33892 - protein, 12 aa, Neisseria
VADDLRAGRVPN

SEQ ID NO: 33893 - protein, 6 aa, Neisseria
RIGRTM

SEQ ID NO: 33894 - protein, 8 aa, Neisseria
QVAERYVR

SEQ ID NO: 33895 - protein, 15 aa, Neisseria
QFDRIARPGAGKNFG

SEQ ID NO: 33896 - protein, 15 aa, Neisseria
GNVDDGCRCRLKNAA

SEQ ID NO: 33897 - protein, 6 aa, Neisseria
YTERGC

SEQ ID NO: 33898 - protein, 7 aa, Neisseria
KPPETVR

SEQ ID NO: 33899 - protein, 5 aa, Neisseria
YKNNR

SEQ ID NO: 33900 - protein, 7 aa, Neisseria
LKVFDNI

SEQ ID NO: 33901 - protein, 14 aa, Neisseria
VNYSDIHDNIINKA

SEQ ID NO: 33902 - protein, 5 aa, Neisseria
APVSR

SEQ ID NO: 33903 - protein, 8 aa, Neisseria
QFPAVLPG

SEQ ID NO: 33904 - protein, 7 aa, Neisseria
NIFDNSF

SEQ ID NO: 33905 - protein, 10 aa, Neisseria
AMVRENKIVG

SEQ ID NO: 33906 - protein, 11 aa, Neisseria
ATLRVNERGNG

SEQ ID NO: 33907 - protein, 28 aa, Neisseria
GNDISKGRDGIFSNTSTHNTYKNNRFSD

SEQ ID NO: 33908 - protein, 9 aa, Neisseria
YTNDSEVSG

SEQ ID NO: 33909 - protein, 5 aa, Neisseria
ERLKV

SEQ ID NO: 33910 - protein, 7 aa, Neisseria
VGSRDGI

SEQ ID NO: 33911 - protein, 13 aa, Neisseria
SDIHDNIINKAGK

SEQ ID NO: 33912 - protein, 10 aa, Neisseria
ANYDKLSANH

SEQ ID NO: 33913 - protein, 9 aa, Neisseria
EGTSLHDNS

SEQ ID NO: 33914 - protein, 11 aa, Neisseria
INNGSQVKYVS

SEQ ID NO: 33915 - protein, 17 aa, Neisseria
DWSEGGHGNYWSDNSPF

SEQ ID NO: 33916 - protein, 17 aa, Neisseria
LNGDGFGDSAYRPDGII

SEQ ID NO: 33917 - protein, 19 aa, Neisseria
GGVVDSKPLMKPYAPKIQT

SEQ ID NO: 33918 - protein, 27 aa, Neisseria
QAMKDELLKEAETRQSERGRAENGSLN

SEQ ID NO: 33919 - protein, 10 aa, Neisseria
AMVRENKIVG

SEQ ID NO: 33920 - protein, 10 aa, Neisseria
ATLRVNERGN

SEQ ID NO: 33921 - protein, 9 aa, Neisseria
DISKGRDGI

SEQ ID NO: 33922 - protein, 8 aa, Neisseria
YKNNRFSD

SEQ ID NO: 33923 - protein, 7 aa, Neisseria
NDSEVSG

SEQ ID NO: 33924 - protein, 5 aa, Neisseria
ERLKV

SEQ ID NO: 33925 - protein, 6 aa, Neisseria
GSRDGI

SEQ ID NO: 33926 - protein, 6 aa, Neisseria
NYDKLS

SEQ ID NO: 33927 - protein, 9 aa, Neisseria
SAYRPDGII

SEQ ID NO: 33928 - protein, 8 aa, Neisseria
VVDSKPLM

SEQ ID NO: 33929 - protein, 25 aa, Neisseria
QAMKDELLKEAETRQSERGRAENGS

SEQ ID NO: 33930 - protein, 7 aa, Neisseria
SILKSIG

SEQ ID NO: 33931 - protein, 6 aa, Neisseria
SIRRMS

SEQ ID NO: 33932 - protein, 17 aa, Neisseria
LPAYAERLPDFLAKIQP

SEQ ID NO: 33933 - protein, 5 aa, Neisseria
RYGKP

SEQ ID NO: 33934 - protein, 9 aa, Neisseria
SKPIDTLMA

SEQ ID NO: 33935 - protein, 7 aa, Neisseria
AKLVDHH

SEQ ID NO: 33936 - protein, 7 aa, Neisseria
RVDKFID

SEQ ID NO: 33937 - protein, 10 aa, Neisseria
GLNFIKNPPT

SEQ ID NO: 33938 - protein, 8 aa, Neisseria
IQRSYKVI

SEQ ID NO: 33939 - protein, 5 aa, Neisseria
ASASD

SEQ ID NO: 33940 - protein, 9 aa, Neisseria
RPRRMANPD

SEQ ID NO: 33941 - protein, 11 aa, Neisseria
LDQINKLFEKG

SEQ ID NO: 33942 - protein, 11 aa, Neisseria
KAGVADHAEQG

SEQ ID NO: 33943 - protein, 8 aa, Neisseria
DTFIDLYV

SEQ ID NO: 33944 - protein, 8 aa, Neisseria
MIQGENSF

SEQ ID NO: 33945 - protein, 15 aa, Neisseria
QHERVVELSAADAPR

SEQ ID NO: 33946 - protein, 10 aa, Neisseria
RRMSAFRARI

SEQ ID NO: 33947 - protein, 8 aa, Neisseria
YAERLPDF

SEQ ID NO: 33948 - protein, 24 aa, Neisseria
AKIQPSEIFPGADRYGKPEGKPMV

SEQ ID NO: 33949 - protein, 9 aa, Neisseria
RVYKGDEQL

SEQ ID NO: 33950 - protein, 13 aa, Neisseria
AVNTRGYSSKPID

SEQ ID NO: 33951 - protein, 7 aa, Neisseria
KLVDHHE

SEQ ID NO: 33952 - protein, 10 aa, Neisseria
PQSRVDKFID

SEQ ID NO: 33953 - protein, 13 aa, Neisseria
IKNPPTPSVAPGD

SEQ ID NO: 33954 - protein, 9 aa, Neisseria
NDSIQRSYK

SEQ ID NO: 33955 - protein, 12 aa, Neisseria
NQYRLGSDKALQ

SEQ ID NO: 33956 - protein, 28 aa, Neisseria
ASASDVREAAPASETRPRRMANPDKQDI

SEQ ID NO: 33957 - protein, 7 aa, Neisseria
ELLKQKA

SEQ ID NO: 33958 - protein, 14 aa, Neisseria
QINKLFEKGGKAGV

SEQ ID NO: 33959 - protein, 13 aa, Neisseria
DHAEQGDPDDTFI

SEQ ID NO: 33960 - protein, 13 aa, Neisseria
PSIGKSLLGEDGW

SEQ ID NO: 33961 - protein, 9 aa, Neisseria
LQKRLKPGQ

SEQ ID NO: 33962 - protein, 16 aa, Neisseria
VAGEGRYSWKGSGYVR

SEQ ID NO: 33963 - protein, 24 aa, Neisseria
DRIEMIQGENSFRFTDAQHERVVE

SEQ ID NO: 33964 - protein, 10 aa, Neisseria
SAADAPRFKE

SEQ ID NO: 33965 - protein, 6 aa, Neisseria
IPEGVA

SEQ ID NO: 33966 - protein, 7 aa, Neisseria
DGAEPWR

SEQ ID NO: 33967 - protein, 10 aa, Neisseria
RRMSAFRARI

SEQ ID NO: 33968 - protein, 6 aa, Neisseria
YAERLP

SEQ ID NO: 33969 - protein, 15 aa, Neisseria
PGADRYGKPEGKPMV

SEQ ID NO: 33970 - protein, 8 aa, Neisseria
VYKGDEQL

SEQ ID NO: 33971 - protein, 7 aa, Neisseria
KLVDHHE

SEQ ID NO: 33972 - protein, 9 aa, Neisseria
QSRVDKFID

SEQ ID NO: 33973 - protein, 7 aa, Neisseria
SIQRSYK

SEQ ID NO: 33974 - protein, 8 aa, Neisseria
LGSDKALQ

SEQ ID NO: 33975 - protein, 26 aa, Neisseria
SASDVREAAPASETRPRRMANPDKQD

SEQ ID NO: 33976 - protein, 7 aa, Neisseria
ELLKQKA

SEQ ID NO: 33977 - protein, 14 aa, Neisseria
QINKLFEKGGKAGV

SEQ ID NO: 33978 - protein, 12 aa, Neisseria
DHAEQGDPDDTF

SEQ ID NO: 33979 - protein, 9 aa, Neisseria
LQKRLKPGQ

SEQ ID NO: 33980 - protein, 7 aa, Neisseria
GEGRYSW

SEQ ID NO: 33981 - protein, 8 aa, Neisseria
DRIEMIQG

SEQ ID NO: 33982 - protein, 15 aa, Neisseria
NSFRFTDAQHERVVE

SEQ ID NO: 33983 - protein, 10 aa, Neisseria
SAADAPRFKE

SEQ ID NO: 33984 - protein, 5 aa, Neisseria
KSACR

SEQ ID NO: 33985 - protein, 10 aa, Neisseria
ICPLSAISAV

SEQ ID NO: 33986 - protein, 5 aa, Neisseria
SGDDF

SEQ ID NO: 33987 - protein, 8 aa, Neisseria
IKHIVRAF

SEQ ID NO: 33988 - protein, 25 aa, Neisseria
DIAGWVSAFKTLRAQEFLQHLRGGV

SEQ ID NO: 33989 - protein, 5 aa, Neisseria
FRGEG

SEQ ID NO: 33990 - protein, 5 aa, Neisseria
DDVRL

SEQ ID NO: 33991 - protein, 16 aa, Neisseria
ADVAVKDFGNLMAALD

SEQ ID NO: 33992 - protein, 19 aa, Neisseria
VQVVKDVFHNAVRHADQLQ

SEQ ID NO: 33993 - protein, 8 aa, Neisseria
VDGVTDGA

SEQ ID NO: 33994 - protein, 11 aa, Neisseria
QVDDFGEFAVF

SEQ ID NO: 33995 - protein, 6 aa, Neisseria
FRGVDV

SEQ ID NO: 33996 - protein, 5 aa, Neisseria
ELLQR

SEQ ID NO: 33997 - protein, 9 aa, Neisseria
HQRAFDAGT

SEQ ID NO: 33998 - protein, 5 aa, Neisseria
MRYPP

SEQ ID NO: 33999 - protein, 15 aa, Neisseria
CLLRRPKSACRRICP

SEQ ID NO: 34000 - protein, 7 aa, Neisseria
VQQEGCG

SEQ ID NO: 34001 - protein, 16 aa, Neisseria
YEDKKSGDDFADEDFL

SEQ ID NO: 34002 - protein, 5 aa, Neisseria
GAGVG

SEQ ID NO: 34003 - protein, 8 aa, Neisseria
GNGGKADI

SEQ ID NO: 34004 - protein, 8 aa, Neisseria
FGGGADEL

SEQ ID NO: 34005 - protein, 13 aa, Neisseria
FKNREGADIDGDI

SEQ ID NO: 34006 - protein, 5 aa, Neisseria
KTLRA

SEQ ID NO: 34007 - protein, 11 aa, Neisseria
FRGEGFDDVRL

SEQ ID NO: 34008 - protein, 11 aa, Neisseria
MGDGRDGRNGM

SEQ ID NO: 34009 - protein, 8 aa, Neisseria
IDESDIVA

SEQ ID NO: 34010 - protein, 27 aa, Neisseria
RHADQLQAAADKDVLERAQTGSVAPGE

SEQ ID NO: 34011 - protein, 6 aa, Neisseria
HHGGCR

SEQ ID NO: 34012 - protein, 12 aa, Neisseria
FGIDAVDGVTDG

SEQ ID NO: 34013 - protein, 12 aa, Neisseria
CFGDEQQVDDFG

SEQ ID NO: 34014 - protein, 9 aa, Neisseria
FGGNEEEVA

SEQ ID NO: 34015 - protein, 8 aa, Neisseria
CNRRAGGF

SEQ ID NO: 34016 - protein, 11 aa, Neisseria
RAFDAGTQRNG

SEQ ID NO: 34017 - protein, 6 aa, Neisseria
VMPRNP

SEQ ID NO: 34018 - protein, 14 aa, Neisseria
CLLRRPKSACRRIC

SEQ ID NO: 34019 - protein, 16 aa, Neisseria
YEDKKSGDDFADEDFL

SEQ ID NO: 34020 - protein, 7 aa, Neisseria
NGGKADI

SEQ ID NO: 34021 - protein, 5 aa, Neisseria
GADEL

SEQ ID NO: 34022 - protein, 13 aa, Neisseria
FKNREGADIDGDI

SEQ ID NO: 34023 - protein, 5 aa, Neisseria
KTLRA

SEQ ID NO: 34024 - protein, 8 aa, Neisseria
EGFDDVRL

SEQ ID NO: 34025 - protein, 10 aa, Neisseria
GDGRDGRNGM

SEQ ID NO: 34026 - protein, 8 aa, Neisseria
IDESDIVA

SEQ ID NO: 34027 - protein, 20 aa, Neisseria
RHADQLQAAADKDVLERAQT

SEQ ID NO: 34028 - protein, 8 aa, Neisseria
AVDGVTDG

SEQ ID NO: 34029 - protein, 12 aa, Neisseria
CFGDEQQVDDFG

SEQ ID NO: 34030 - protein, 7 aa, Neisseria
GNEEEVA

SEQ ID NO: 34031 - protein, 6 aa, Neisseria
CNRRAG

SEQ ID NO: 34032 - protein, 6 aa, Neisseria
GTQRNG

SEQ ID NO: 34033 - protein, 7 aa, Neisseria
GRRFDRP

SEQ ID NO: 34034 - protein, 28 aa, Neisseria
MDTAAFLKHIESAFPRIFSDGIDLMRYL

SEQ ID NO: 34035 - protein, 12 aa, Neisseria
QFEIQEVLRIAG

SEQ ID NO: 34036 - protein, 8 aa, Neisseria
QPLQEFGG

SEQ ID NO: 34037 - protein, 9 aa, Neisseria
REMQSCYEY

SEQ ID NO: 34038 - protein, 5 aa, Neisseria
YWQGN

SEQ ID NO: 34039 - protein, 8 aa, Neisseria
LAKVIDLL

SEQ ID NO: 34040 - protein, 6 aa, Neisseria
VMKLSR

SEQ ID NO: 34041 - protein, 6 aa, Neisseria
LRAFQN

SEQ ID NO: 34042 - protein, 19 aa, Neisseria
MTHGIMEYILDNLNRYVRN

SEQ ID NO: 34043 - protein, 9 aa, Neisseria
EILYRYVCH

SEQ ID NO: 34044 - protein, 9 aa, Neisseria
VSPVAPVAH

SEQ ID NO: 34045 - protein, 8 aa, Neisseria
ANIVKTLA

SEQ ID NO: 34046 - protein, 5 aa, Neisseria
QMLQK

SEQ ID NO: 34047 - protein, 8 aa, Neisseria
FTIFEGPN

SEQ ID NO: 34048 - protein, 13 aa, Neisseria
MLYAEIYDQFVRA

SEQ ID NO: 34049 - protein, 8 aa, Neisseria
LPEDIRSF

SEQ ID NO: 34050 - protein, 7 aa, Neisseria
GKIIARL

SEQ ID NO: 34051 - protein, 10 aa, Neisseria
MPSERPADCC

SEQ ID NO: 34052 - protein, 35 aa, Neisseria
TLNCGRRFDRPPINGNRQRKPMIHTEPSAQPSTMD

SEQ ID NO: 34053 - protein, 9 aa, Neisseria
RIFSDGIDL

SEQ ID NO: 34054 - protein, 7 aa, Neisseria
LPEDKWL

SEQ ID NO: 34055 - protein, 12 aa, Neisseria
LDKKHGGRKGSQ

SEQ ID NO: 34056 - protein, 17 aa, Neisseria
FKGESRRLGVTEPETSG

SEQ ID NO: 34057 - protein, 17 aa, Neisseria
AIAREMQSCYEYTDEQT

SEQ ID NO: 34058 - protein, 10 aa, Neisseria
YWQGNSQSDF

SEQ ID NO: 34059 - protein, 11 aa, Neisseria
AKERKNGKLAK

SEQ ID NO: 34060 - protein, 5 aa, Neisseria
KTYIR

SEQ ID NO: 34061 - protein, 9 aa, Neisseria
ETLASEGLR

SEQ ID NO: 34062 - protein, 9 aa, Neisseria
AVNRIDAEM

SEQ ID NO: 34063 - protein, 9 aa, Neisseria
KLSRGDAAG

SEQ ID NO: 34064 - protein, 26 aa, Neisseria
NLNRYVRNDIRFVDYERREIQRRHQV

SEQ ID NO: 34065 - protein, 10 aa, Neisseria
KGFERGHPAG

SEQ ID NO: 34066 - protein, 7 aa, Neisseria
EGPNDML

SEQ ID NO: 34067 - protein, 17 aa, Neisseria
ATAEEKEAGIKLDKNQT

SEQ ID NO: 34068 - protein, 6 aa, Neisseria
VQTDVR

SEQ ID NO: 34069 - protein, 8 aa, Neisseria
AVARDYAL

SEQ ID NO: 34070 - protein, 7 aa, Neisseria
EDIRSFL

SEQ ID NO: 34071 - protein, 8 aa, Neisseria
QEEHEDTT

SEQ ID NO: 34072 - protein, 13 aa, Neisseria
DIRKDILDCRYCG

SEQ ID NO: 34073 - protein, 8 aa, Neisseria
MPSERPAD

SEQ ID NO: 34074 - protein, 20 aa, Neisseria
CGRRFDRPPINGNRQRKPMI

SEQ ID NO: 34075 - protein, 6 aa, Neisseria
FSDGID

SEQ ID NO: 34076 - protein, 7 aa, Neisseria
LPEDKWL

SEQ ID NO: 34077 - protein, 12 aa, Neisseria
LDKKHGGRKGSQ

SEQ ID NO: 34078 - protein, 17 aa, Neisseria
FKGESRRLGVTEPETSG

SEQ ID NO: 34079 - protein, 8 aa, Neisseria
AIAREMQS

SEQ ID NO: 34080 - protein, 7 aa, Neisseria
EYTDEQT

SEQ ID NO: 34081 - protein, 11 aa, Neisseria
AKERKNGKLAK

SEQ ID NO: 34082 - protein, 9 aa, Neisseria
AVNRIDAEM

SEQ ID NO: 34083 - protein, 9 aa, Neisseria
KLSRGDAAG

SEQ ID NO: 34084 - protein, 26 aa, Neisseria
NLNRYVRNDIRFVDYERREIQRRHQV

SEQ ID NO: 34085 - protein, 8 aa, Neisseria
KGFERGHP

SEQ ID NO: 34086 - protein, 17 aa, Neisseria
ATAEEKEAGIKLDKNQT

SEQ ID NO: 34087 - protein, 6 aa, Neisseria
VQTDVR

SEQ ID NO: 34088 - protein, 7 aa, Neisseria
EDIRSFL

SEQ ID NO: 34089 - protein, 8 aa, Neisseria
QEEHEDTT

SEQ ID NO: 34090 - protein, 8 aa, Neisseria
DIRKDILD

SEQ ID NO: 34091 - protein, 11 aa, Neisseria
RTLPSLNGLTK

SEQ ID NO: 34092 - protein, 10 aa, Neisseria
RTPKRCSSSI

SEQ ID NO: 34093 - protein, 14 aa, Neisseria
PKFLNFMSSCTNLC

SEQ ID NO: 34094 - protein, 5 aa, Neisseria
SAKRS

SEQ ID NO: 34095 - protein, 13 aa, Neisseria
SVLPKPTSPHTSR

SEQ ID NO: 34096 - protein, 21 aa, Neisseria
NLCCKKSRMTCSSSRSRSCPC

SEQ ID NO: 34097 - protein, 15 aa, Neisseria
PIRASGSRVSSRSRI

SEQ ID NO: 34098 - protein, 24 aa, Neisseria
SLCRKNTCPPRLSSRNTASRTLPS

SEQ ID NO: 34099 - protein, 8 aa, Neisseria
FTARRRLG

SEQ ID NO: 34100 - protein, 14 aa, Neisseria
ISEKSRRPSSAMLR

SEQ ID NO: 34101 - protein, 20 aa, Neisseria
TLARRRLSCSFCRTPKRCSS

SEQ ID NO: 34102 - protein, 9 aa, Neisseria
IINKPKFLN

SEQ ID NO: 34103 - protein, 6 aa, Neisseria
MSSCTN

SEQ ID NO: 34104 - protein, 7 aa, Neisseria
LKRERLA

SEQ ID NO: 34105 - protein, 10 aa, Neisseria
TGKSAKRSAK

SEQ ID NO: 34106 - protein, 9 aa, Neisseria
CSTRSVVGA

SEQ ID NO: 34107 - protein, 7 aa, Neisseria
NAARRAT

SEQ ID NO: 34108 - protein, 12 aa, Neisseria
VLPKPTSPHTSR

SEQ ID NO: 34109 - protein, 18 aa, Neisseria
CCKKSRMTCSSSRSRSCP

SEQ ID NO: 34110 - protein, 14 aa, Neisseria
IRASGSRVSSRSRI

SEQ ID NO: 34111 - protein, 20 aa, Neisseria
LCRKNTCPPRLSSRNTASRT

SEQ ID NO: 34112 - protein, 8 aa, Neisseria
FTARRRLG

SEQ ID NO: 34113 - protein, 9 aa, Neisseria
ISEKSRRPS

SEQ ID NO: 34114 - protein, 8 aa, Neisseria
TLARRRLS

SEQ ID NO: 34115 - protein, 7 aa, Neisseria
RTPKRCS

SEQ ID NO: 34116 - protein, 6 aa, Neisseria
IINKPK

SEQ ID NO: 34117 - protein, 7 aa, Neisseria
LKRERLA

SEQ ID NO: 34118 - protein, 8 aa, Neisseria
KSAKRSAK

SEQ ID NO: 34119 - protein, 7 aa, Neisseria
NAARRAT

SEQ ID NO: 34120 - protein, 10 aa, Neisseria
GKVCRCFEQV

SEQ ID NO: 34121 - protein, 10 aa, Neisseria
TVFRQIVGVV

SEQ ID NO: 34122 - protein, 8 aa, Neisseria
GLVKERAR

SEQ ID NO: 34123 - protein, 6 aa, Neisseria
KVCRCF

SEQ ID NO: 34124 - protein, 10 aa, Neisseria
GTVGQTERGT

SEQ ID NO: 34125 - protein, 19 aa, Neisseria
VDDTDAERTAVHSRGTRGF

SEQ ID NO: 34126 - protein, 8 aa, Neisseria
GLVKERAR

SEQ ID NO: 34127 - protein, 5 aa, Neisseria
VCRCF

SEQ ID NO: 34128 - protein, 8 aa, Neisseria
VGQTERGT

SEQ ID NO: 34129 - protein, 18 aa, Neisseria
VDDTDAERTAVHSRGTRG

SEQ ID NO: 34130 - protein, 7 aa, Neisseria
RIERAVR

SEQ ID NO: 34131 - protein, 7 aa, Neisseria
AVIDVLN

SEQ ID NO: 34132 - protein, 13 aa, Neisseria
AVDLHAIIKLADT

SEQ ID NO: 34133 - protein, 6 aa, Neisseria
QGVEQG

SEQ ID NO: 34134 - protein, 10 aa, Neisseria
RLKHLKEGNA

SEQ ID NO: 34135 - protein, 9 aa, Neisseria
ARALGNVFH

SEQ ID NO: 34136 - protein, 17 aa, Neisseria
GSGIDGIQTIVAFNQHT

SEQ ID NO: 34137 - protein, 13 aa, Neisseria
MNRRNARIERAVR

SEQ ID NO: 34138 - protein, 5 aa, Neisseria
APGPG

SEQ ID NO: 34139 - protein, 17 aa, Neisseria
LLHQRGKQVGSRNDTLA

SEQ ID NO: 34140 - protein, 18 aa, Neisseria
GKKRFVQPRNLVGRKQRN

SEQ ID NO: 34141 - protein, 12 aa, Neisseria
FNMPQGVEQGCR

SEQ ID NO: 34142 - protein, 17 aa, Neisseria
LRTRFDRRLKHLKEGNA

SEQ ID NO: 34143 - protein, 15 aa, Neisseria
VQPADTSGIDADARA

SEQ ID NO: 34144 - protein, 9 aa, Neisseria
NRAGSGIDG

SEQ ID NO: 34145 - protein, 13 aa, Neisseria
MNRRNARIERAVR

SEQ ID NO: 34146 - protein, 12 aa, Neisseria
QRGKQVGSRNDT

SEQ ID NO: 34147 - protein, 7 aa, Neisseria
GKKRFVQ

SEQ ID NO: 34148 - protein, 9 aa, Neisseria
NLVGRKQRN

SEQ ID NO: 34149 - protein, 8 aa, Neisseria
QGVEQGCR

SEQ ID NO: 34150 - protein, 17 aa, Neisseria
LRTRFDRRLKHLKEGNA

SEQ ID NO: 34151 - protein, 13 aa, Neisseria
PADTSGIDADARA

SEQ ID NO: 34152 - protein, 8 aa, Neisseria
LSAILGLV

SEQ ID NO: 34153 - protein, 12 aa, Neisseria
PAHRHTKHISKA

SEQ ID NO: 34154 - protein, 5 aa, Neisseria
SQGNV

SEQ ID NO: 34155 - protein, 6 aa, Neisseria
ELRENK

SEQ ID NO: 34156 - protein, 8 aa, Neisseria
RKAFRTLP

SEQ ID NO: 34157 - protein, 18 aa, Neisseria
GTSEPAHRHTKHISKANK

SEQ ID NO: 34158 - protein, 14 aa, Neisseria
LHPECRKYLERRAA

SEQ ID NO: 34159 - protein, 20 aa, Neisseria
RSQGNVQELRENKKARKAFR

SEQ ID NO: 34160 - protein, 7 aa, Neisseria
AEQKIQC

SEQ ID NO: 34161 - protein, 12 aa, Neisseria
AFDDFDGGRFRR

SEQ ID NO: 34162 - protein, 18 aa, Neisseria
GTSEPAHRHTKHISKANK

SEQ ID NO: 34163 - protein, 12 aa, Neisseria
PECRKYLERRAA

SEQ ID NO: 34164 - protein, 17 aa, Neisseria
GNVQELRENKKARKAFR

SEQ ID NO: 34165 - protein, 7 aa, Neisseria
AEQKIQC

SEQ ID NO: 34166 - protein, 12 aa, Neisseria
AFDDFDGGRFRR

SEQ ID NO: 34167 - protein, 5 aa, Neisseria
SVCPG

SEQ ID NO: 34168 - protein, 8 aa, Neisseria
LWDELRQG

SEQ ID NO: 34169 - protein, 8 aa, Neisseria
PELVRRHE

SEQ ID NO: 34170 - protein, 6 aa, Neisseria
FDRVVN

SEQ ID NO: 34171 - protein, 5 aa, Neisseria
SGLWQ

SEQ ID NO: 34172 - protein, 14 aa, Neisseria
NYLQYLYGLFGDWP

SEQ ID NO: 34173 - protein, 10 aa, Neisseria
NVGRAVNRAR

SEQ ID NO: 34174 - protein, 7 aa, Neisseria
LRMPNET

SEQ ID NO: 34175 - protein, 7 aa, Neisseria
VEPGRPL

SEQ ID NO: 34176 - protein, 12 aa, Neisseria
EAIARLAGITQS

SEQ ID NO: 34177 - protein, 9 aa, Neisseria
SNYLNAAPD

SEQ ID NO: 34178 - protein, 7 aa, Neisseria
ISTATGM

SEQ ID NO: 34179 - protein, 10 aa, Neisseria
IADIKRLNNL

SEQ ID NO: 34180 - protein, 7 aa, Neisseria
VRTGTRS

SEQ ID NO: 34181 - protein, 5 aa, Neisseria
MSKLK

SEQ ID NO: 34182 - protein, 6 aa, Neisseria
QNTSSH

SEQ ID NO: 34183 - protein, 15 aa, Neisseria
LNSSILDLPPTKQYF

SEQ ID NO: 34184 - protein, 31 aa, Neisseria
SGSLWDELRQGFRMGEVNPELVRRHESKFIA

SEQ ID NO: 34185 - protein, 12 aa, Neisseria
SYFDRVVNRSRP

SEQ ID NO: 34186 - protein, 10 aa, Neisseria
NEVKKRNMPA

SEQ ID NO: 34187 - protein, 11 aa, Neisseria
TKAKSHVGASG

SEQ ID NO: 34188 - protein, 20 aa, Neisseria
ATGRHYGLEKTPVYDGRHDV

SEQ ID NO: 34189 - protein, 37 aa, Neisseria
YNWGEGNVGRAVNRARDQGLEPTYENLRMPNETRNYV

SEQ ID NO: 34190 - protein, 10 aa, Neisseria
NISDIDNKPY

SEQ ID NO: 34191 - protein, 14 aa, Neisseria
AVEPGRPLDNEAIA

SEQ ID NO: 34192 - protein, 9 aa, Neisseria
FIPKNKRKL

SEQ ID NO: 34193 - protein, 6 aa, Neisseria
NAAPDS

SEQ ID NO: 34194 - protein, 12 aa, Neisseria
PAAKTSLSDIST

SEQ ID NO: 34195 - protein, 11 aa, Neisseria
ADIKRLNNLNG

SEQ ID NO: 34196 - protein, 9 aa, Neisseria
LVAKNGKTL

SEQ ID NO: 34197 - protein, 16 aa, Neisseria
IDIDNTPDTYRSNMPA

SEQ ID NO: 34198 - protein, 34 aa, Neisseria
ETVRTGTRSPCPHYRTRPCDSRSATSNRKTDCHA

SEQ ID NO: 34199 - protein, 5 aa, Neisseria
MSKLK

SEQ ID NO: 34200 - protein, 26 aa, Neisseria
DELRQGFRMGEVNPELVRRHESKFIA

SEQ ID NO: 34201 - protein, 7 aa, Neisseria
VVNRSRP

SEQ ID NO: 34202 - protein, 10 aa, Neisseria
NEVKKRNMPA

SEQ ID NO: 34203 - protein, 7 aa, Neisseria
TKAKSHV

SEQ ID NO: 34204 - protein, 15 aa, Neisseria
YGLEKTPVYDGRHDV

SEQ ID NO: 34205 - protein, 10 aa, Neisseria
AVNRARDQGL

SEQ ID NO: 34206 - protein, 16 aa, Neisseria
PTYENLRMPNETRNYV

SEQ ID NO: 34207 - protein, 5 aa, Neisseria
SDIDN

SEQ ID NO: 34208 - protein, 12 aa, Neisseria
EPGRPLDNEAIA

SEQ ID NO: 34209 - protein, 7 aa, Neisseria
PKNKRKL

SEQ ID NO: 34210 - protein, 5 aa, Neisseria
AKTSL

SEQ ID NO: 34211 - protein, 7 aa, Neisseria
ADIKRLN

SEQ ID NO: 34212 - protein, 5 aa, Neisseria
KNGKT

SEQ ID NO: 34213 - protein, 10 aa, Neisseria
DIDNTPDTYR

SEQ ID NO: 34214 - protein, 10 aa, Neisseria
ETVRTGTRSP

SEQ ID NO: 34215 - protein, 19 aa, Neisseria
YRTRPCDSRSATSNRKTDC

SEQ ID NO: 34216 - protein, 5 aa, Neisseria
DIFAR

SEQ ID NO: 34217 - protein, 5 aa, Neisseria
RDGDK

SEQ ID NO: 34218 - protein, 17 aa, Neisseria
KGVLKAVEHVNNQIAQA

SEQ ID NO: 34219 - protein, 10 aa, Neisseria
LYRYLGGAGP

SEQ ID NO: 34220 - protein, 5 aa, Neisseria
VINGG

SEQ ID NO: 34221 - protein, 9 aa, Neisseria
KSFREALRC

SEQ ID NO: 34222 - protein, 8 aa, Neisseria
EIFHALKK

SEQ ID NO: 34223 - protein, 12 aa, Neisseria
AEFAEYLEGLVN

SEQ ID NO: 34224 - protein, 5 aa, Neisseria
LTEKL

SEQ ID NO: 34225 - protein, 8 aa, Neisseria
AEGIEKGV

SEQ ID NO: 34226 - protein, 24 aa, Neisseria
VNQIGTLSETLKAVDLAKCNRYAS

SEQ ID NO: 34227 - protein, 5 aa, Neisseria
DLAVA

SEQ ID NO: 34228 - protein, 19 aa, Neisseria
SLSRSDRMAKYNQLLRIEE

SEQ ID NO: 34229 - protein, 12 aa, Neisseria
EILDSRGNPTVE

SEQ ID NO: 34230 - protein, 37 aa, Neisseria; identical to SEQ ID NO: 8723

SEQ ID NO: 34231 - protein, 7 aa, Neisseria
DANEQSY

SEQ ID NO: 34232 - protein, 11 aa, Neisseria
LDGTENKGNLG

SEQ ID NO: 34233 - protein, 9 aa, Neisseria
AAAEDSGLP

SEQ ID NO: 34234 - protein, 6 aa, Neisseria
GGAGPM

SEQ ID NO: 34235 - protein, 9 aa, Neisseria
NGGEHANNS

SEQ ID NO: 34236 - protein, 11 aa, Neisseria
KSFREALRCGA

SEQ ID NO: 34237 - protein, 19 aa, Neisseria
KKLCDSKGFPTTVGDEGGF

SEQ ID NO: 34238 - protein, 9 aa, Neisseria
NLNSHKEAL

SEQ ID NO: 34239 - protein, 23 aa, Neisseria
CASSEFYKDGKYHLEAEGRSYTN

SEQ ID NO: 34240 - protein, 13 aa, Neisseria
SIEDGMDENDWEG

SEQ ID NO: 34241 - protein, 16 aa, Neisseria
LTEKLGKKVQLVGDDL

SEQ ID NO: 34242 - protein, 13 aa, Neisseria
NPKILAEGIEKGV

SEQ ID NO: 34243 - protein, 8 aa, Neisseria
DLAKCNRY

SEQ ID NO: 34244 - protein, 13 aa, Neisseria
MSHRSGETEDSTI

SEQ ID NO: 34245 - protein, 13 aa, Neisseria
KTGSLSRSDRMAK

SEQ ID NO: 34246 - protein, 9 aa, Neisseria
LRIEEELAE

SEQ ID NO: 34247 - protein, 12 aa, Neisseria
EILDSRGNPTVE

SEQ ID NO: 34248 - protein, 19 aa, Neisseria
TGQKEALELRDGDKSRYSG

SEQ ID NO: 34249 - protein, 7 aa, Neisseria
GVLKAVE

SEQ ID NO: 34250 - protein, 10 aa, Neisseria
LDGTENKGNL

SEQ ID NO: 34251 - protein, 7 aa, Neisseria
AAAEDSG

SEQ ID NO: 34252 - protein, 5 aa, Neisseria
GEHAN

SEQ ID NO: 34253 - protein, 11 aa, Neisseria
KSFREALRCGA

SEQ ID NO: 34254 - protein, 8 aa, Neisseria
KKLCDSKG

SEQ ID NO: 34255 - protein, 7 aa, Neisseria
VGDEGGF

SEQ ID NO: 34256 - protein, 7 aa, Neisseria
NSHKEAL

SEQ ID NO: 34257 - protein, 18 aa, Neisseria
EFYKDGKYHLEAEGRSYT

SEQ ID NO: 34258 - protein, 13 aa, Neisseria
SIEDGMDENDWEG

SEQ ID NO: 34259 - protein, 13 aa, Neisseria
LTEKLGKKVQLVG

SEQ ID NO: 34260 - protein, 10 aa, Neisseria
ILAEGIEKGV

SEQ ID NO: 34261 - protein, 7 aa, Neisseria
DLAKCNR

SEQ ID NO: 34262 - protein, 12 aa, Neisseria
SHRSGETEDSTI

SEQ ID NO: 34263 - protein, 10 aa, Neisseria
SLSRSDRMAK

SEQ ID NO: 34264 - protein, 9 aa, Neisseria
LRIEEELAE

SEQ ID NO: 34265 - protein, 8 aa, Neisseria
TMRKPRLT

SEQ ID NO: 34266 - protein, 8 aa, Neisseria
ALIFTCFA

SEQ ID NO: 34267 - protein, 9 aa, Neisseria
TALAAITCI

SEQ ID NO: 34268 - protein, 8 aa, Neisseria
LGKMEEFS

SEQ ID NO: 34269 - protein, 7 aa, Neisseria
EPMRMPE

SEQ ID NO: 34270 - protein, 5 aa, Neisseria
GFSGS

SEQ ID NO: 34271 - protein, 8 aa, Neisseria
GCRSTRKT

SEQ ID NO: 34272 - protein, 16 aa, Neisseria
VRPETMRKPRLTNSSA

SEQ ID NO: 34273 - protein, 6 aa, Neisseria
NSGCNA

SEQ ID NO: 34274 - protein, 14 aa, Neisseria
CINGPPCRLGKMEE

SEQ ID NO: 34275 - protein, 14 aa, Neisseria
SRHKITPPRGPRRV

SEQ ID NO: 34276 - protein, 8 aa, Neisseria
TKSQNGTG

SEQ ID NO: 34277 - protein, 8 aa, Neisseria
SPPATSPA

SEQ ID NO: 34278 - protein, 7 aa, Neisseria
EPMRMPE

SEQ ID NO: 34279 - protein, 6 aa, Neisseria
RSTRKT

SEQ ID NO: 34280 - protein, 12 aa, Neisseria
RPETMRKPRLTN

SEQ ID NO: 34281 - protein, 10 aa, Neisseria
PPCRLGKMEE

SEQ ID NO: 34282 - protein, 11 aa, Neisseria
RHKITPPRGPR

SEQ ID NO: 34283 - protein, 17 aa, Neisseria
GSISSMISIARTFGAPE

SEQ ID NO: 34284 - protein, 5 aa, Neisseria
KQPST

SEQ ID NO: 34285 - protein, 8 aa, Neisseria
LASLNKSC

SEQ ID NO: 34286 - protein, 5 aa, Neisseria
FSGSI

SEQ ID NO: 34287 - protein, 13 aa, Neisseria
GAPESVPAGKVAA

SEQ ID NO: 34288 - protein, 9 aa, Neisseria
SFKQPSTLE

SEQ ID NO: 34289 - protein, 10 aa, Neisseria
RPTSLRPKSI

SEQ ID NO: 34290 - protein, 23 aa, Neisseria
SLNKSCSLARSSAGVLPRRRVPA

SEQ ID NO: 34291 - protein, 25 aa, Neisseria
TMTSSRSRRTRISGEEPTMWKSPKS

SEQ ID NO: 34292 - protein, 7 aa, Neisseria
TSLRPKS

SEQ ID NO: 34293 - protein, 7 aa, Neisseria
CSLARSS

SEQ ID NO: 34294 - protein, 8 aa, Neisseria
LPRRRVPA

SEQ ID NO: 34295 - protein, 18 aa, Neisseria
MTSSRSRRTRISGEEPTM

SEQ ID NO: 34296 - protein, 5 aa, Neisseria
KSPKS

SEQ ID NO: 34297 - protein, 6 aa, Neisseria
LGRMFA

SEQ ID NO: 34298 - protein, 8 aa, Neisseria
DELAKCAA

SEQ ID NO: 34299 - protein, 11 aa, Neisseria
DAMRSLAKHTN

SEQ ID NO: 34300 - protein, 10 aa, Neisseria
CKAEDITEAS

SEQ ID NO: 34301 - protein, 9 aa, Neisseria
QFLPGILKT

SEQ ID NO: 34302 - protein, 9 aa, Neisseria
KTLDELKAA

SEQ ID NO: 34303 - protein, 8 aa, Neisseria
CVLEKMVD

SEQ ID NO: 34304 - protein, 7 aa, Neisseria
FDPAENI

SEQ ID NO: 34305 - protein, 20 aa, Neisseria
QQARQTAQRLADELDYVGVL

SEQ ID NO: 34306 - protein, 9 aa, Neisseria
VLDPDPNAP

SEQ ID NO: 34307 - protein, 13 aa, Neisseria
PFDDRAALDELAK

SEQ ID NO: 34308 - protein, 27 aa, Neisseria
TEFENVNADAMRSLAKHTNVSPSGDCV

SEQ ID NO: 34309 - protein, 11 aa, Neisseria
AQNRIQEKAWI

SEQ ID NO: 34310 - protein, 9 aa, Neisseria
CKAEDITEA

SEQ ID NO: 34311 - protein, 21 aa, Neisseria
LGYDGKGQIRVKTLDELKAAF

SEQ ID NO: 34312 - protein, 9 aa, Neisseria
KMVDLRGEI

SEQ ID NO: 34313 - protein, 8 aa, Neisseria
RLNDENVQ

SEQ ID NO: 34314 - protein, 11 aa, Neisseria
FDPAENIHENG

SEQ ID NO: 34315 - protein, 17 aa, Neisseria
VQQQARQTAQRLADELD

SEQ ID NO: 34316 - protein, 12 aa, Neisseria
ETAPRTHNSGHH

SEQ ID NO: 34317 - protein, 5 aa, Neisseria
QFQQQ

SEQ ID NO: 34318 - protein, 9 aa, Neisseria
PPADTKLLS

SEQ ID NO: 34319 - protein, 11 aa, Neisseria
VWQEDGGEPDW

SEQ ID NO: 34320 - protein, 7 aa, Neisseria
LQSRPNA

SEQ ID NO: 34321 - protein, 12 aa, Neisseria
GKKTAQKGRKMG

SEQ ID NO: 34322 - protein, 15 aa, Neisseria
TTDSDTAFQEAKKLH

SEQ ID NO: 34323 - protein, 9 aa, Neisseria
VLDPDPNAP

SEQ ID NO: 34324 - protein, 13 aa, Neisseria
PFDDRAALDELAK

SEQ ID NO: 34325 - protein, 7 aa, Neisseria
TEFENVN

SEQ ID NO: 34326 - protein, 8 aa, Neisseria
DAMRSLAK

SEQ ID NO: 34327 - protein, 9 aa, Neisseria
CKAEDITEA

SEQ ID NO: 34328 - protein, 19 aa, Neisseria
YDGKGQIRVKTLDELKAAF

SEQ ID NO: 34329 - protein, 9 aa, Neisseria
KMVDLRGEI

SEQ ID NO: 34330 - protein, 8 aa, Neisseria
RLNDENVQ

SEQ ID NO: 34331 - protein, 7 aa, Neisseria
DPAENIH

SEQ ID NO: 34332 - protein, 17 aa, Neisseria
VQQQARQTAQRLADELD

SEQ ID NO: 34333 - protein, 7 aa, Neisseria
TAPRTHN

SEQ ID NO: 34334 - protein, 6 aa, Neisseria
PADTKL

SEQ ID NO: 34335 - protein, 9 aa, Neisseria
WQEDGGEPD

SEQ ID NO: 34336 - protein, 12 aa, Neisseria
GKKTAQKGRKMG

SEQ ID NO: 34337 - protein, 14 aa, Neisseria
TDSDTAFQEAKKLH

SEQ ID NO: 34338 - protein, 22 aa, Neisseria
RQYADIIQFVRQALRRLPRLLL

SEQ ID NO: 34339 - protein, 9 aa, Neisseria
VDVFGGVEG

SEQ ID NO: 34340 - protein, 13 aa, Neisseria
AQVHHFFQNAIHA

SEQ ID NO: 34341 - protein, 12 aa, Neisseria
QKLRACFSNVFG

SEQ ID NO: 34342 - protein, 7 aa, Neisseria
LIRRGLQ

SEQ ID NO: 34343 - protein, 9 aa, Neisseria
VRARGGFID

SEQ ID NO: 34344 - protein, 6 aa, Neisseria
ADNKHF

SEQ ID NO: 34345 - protein, 6 aa, Neisseria
ALRRLP

SEQ ID NO: 34346 - protein, 14 aa, Neisseria
TQPRGDDGISQDAV

SEQ ID NO: 34347 - protein, 5 aa, Neisseria
YDHGN

SEQ ID NO: 34348 - protein, 9 aa, Neisseria
VFGKRGFEF

SEQ ID NO: 34349 - protein, 14 aa, Neisseria
QRSRFQDAGQKLRA

SEQ ID NO: 34350 - protein, 8 aa, Neisseria
RLIRRGLQ

SEQ ID NO: 34351 - protein, 6 aa, Neisseria
RAHRVG

SEQ ID NO: 34352 - protein, 9 aa, Neisseria
FKFGRNRRA

SEQ ID NO: 34353 - protein, 11 aa, Neisseria
QRGPVVKRRAQ

SEQ ID NO: 34354 - protein, 15 aa, Neisseria
GKFRRRRIRVGIENG

SEQ ID NO: 34355 - protein, 9 aa, Neisseria
FSGNGKHSA

SEQ ID NO: 34356 - protein, 8 aa, Neisseria
VRARGGFI

SEQ ID NO: 34357 - protein, 6 aa, Neisseria
ADNKHF

SEQ ID NO: 34358 - protein, 6 aa, Neisseria
ALRRLP

SEQ ID NO: 34359 - protein, 10 aa, Neisseria
TQPRGDDGIS

SEQ ID NO: 34360 - protein, 14 aa, Neisseria
QRSRFQDAGQKLRA

SEQ ID NO: 34361 - protein, 7 aa, Neisseria
RLIRRGL

SEQ ID NO: 34362 - protein, 6 aa, Neisseria
RAHRVG

SEQ ID NO: 34363 - protein, 6 aa, Neisseria
GRNRRA

SEQ ID NO: 34364 - protein, 8 aa, Neisseria
PVVKRRAQ

SEQ ID NO: 34365 - protein, 12 aa, Neisseria
GKFRRRRIRVGI

SEQ ID NO: 34366 - protein, 7 aa, Neisseria
GNGKHSA

SEQ ID NO: 34367 - protein, 16 aa, Neisseria
GIADKPFRRLCRAFGA

SEQ ID NO: 34368 - protein, 8 aa, Neisseria
LRNTGKTL

SEQ ID NO: 34369 - protein, 6 aa, Neisseria
PEQMAD

SEQ ID NO: 34370 - protein, 9 aa, Neisseria
AAILEAVVK

SEQ ID NO: 34371 - protein, 8 aa, Neisseria
PAVAKIAE

SEQ ID NO: 34372 - protein, 5 aa, Neisseria
HDRAR

SEQ ID NO: 34373 - protein, 6 aa, Neisseria
FEALCR

SEQ ID NO: 34374 - protein, 7 aa, Neisseria
FTACLEF

SEQ ID NO: 34375 - protein, 11 aa, Neisseria
IADKPFRRLCR

SEQ ID NO: 34376 - protein, 21 aa, Neisseria
DPTLRNTGKTLHRSDFADEGG

SEQ ID NO: 34377 - protein, 13 aa, Neisseria
AGSDPEQMADAAR

SEQ ID NO: 34378 - protein, 10 aa, Neisseria
NMGCPAKKVC

SEQ ID NO: 34379 - protein, 6 aa, Neisseria
MQDEPL

SEQ ID NO: 34380 - protein, 9 aa, Neisseria
GWHDDDQNL

SEQ ID NO: 34381 - protein, 7 aa, Neisseria
KIAEDCG

SEQ ID NO: 34382 - protein, 5 aa, Neisseria
PRARA

SEQ ID NO: 34383 - protein, 56 aa, Neisseria
ANVQRRGALRTHRRDQKPSEHPGLGQRRHHFAAKSRRRPQTNRRRRHHDRARRARQ

SEQ ID NO: 34384 - protein, 6 aa, Neisseria
CRTRRF

SEQ ID NO: 34385 - protein, 16 aa, Neisseria
GRMQSRHFEPHPRHAR

SEQ ID NO: 34386 - protein, 28 aa, Neisseria
  VARIANT 2: Xaa is any amino acid
WXDRRCAHRTQTHRLVHRRNARRRTGAA

SEQ ID NO: 34387 - protein, 11 aa, Neisseria
IADKPFRRLCR

SEQ ID NO: 34388 - protein, 20 aa, Neisseria
PTLRNTGKTLHRSDFADEGG

SEQ ID NO: 34389 - protein, 12 aa, Neisseria
GSDPEQMADAAR

SEQ ID NO: 34390 - protein, 7 aa, Neisseria
CPAKKVC

SEQ ID NO: 34391 - protein, 6 aa, Neisseria
MQDEPL

SEQ ID NO: 34392 - protein, 7 aa, Neisseria
WHDDDQN

SEQ ID NO: 34393 - protein, 7 aa, Neisseria
KIAEDCG

SEQ ID NO: 34394 - protein, 5 aa, Neisseria
PRARA

SEQ ID NO: 34395 - protein, 31 aa, Neisseria
ANVQRRGALRTHRRDQKPSEHPGLGQRRHHF

SEQ ID NO: 34396 - protein, 24 aa, Neisseria
AKSRRRPQTNRRRRHHDRARRARQ

SEQ ID NO: 34397 - protein, 6 aa, Neisseria
CRTRRF

SEQ ID NO: 34398 - protein, 15 aa, Neisseria
GRMQSRHFEPHPRHA

SEQ ID NO: 34399 - protein, 12 aa, Neisseria
  VARIANT 2: Xaa is any amino acid
WXDRRCAHRTQT

SEQ ID NO: 34400 - protein, 13 aa, Neisseria
LVHRRNARRRTGA

SEQ ID NO: 34401 - protein, 17 aa, Neisseria
PFALLHKIAGLIGSLAY

SEQ ID NO: 34402 - protein, 10 aa, Neisseria
KQHFKHMAKL

SEQ ID NO: 34403 - protein, 10 aa, Neisseria
SAKCLKSLVR

SEQ ID NO: 34404 - protein, 12 aa, Neisseria
EGLRALVKQFRK

SEQ ID NO: 34405 - protein, 13 aa, Neisseria
TITGLSRIAALAN

SEQ ID NO: 34406 - protein, 5 aa, Neisseria
PAWKS

SEQ ID NO: 34407 - protein, 14 aa, Neisseria
QRMNRFIEERVREH

SEQ ID NO: 34408 - protein, 9 aa, Neisseria
VKPRRRIGE

SEQ ID NO: 34409 - protein, 12 aa, Neisseria
PEWDEEKRKTVL

SEQ ID NO: 34410 - protein, 6 aa, Neisseria
AKCLKS

SEQ ID NO: 34411 - protein, 10 aa, Neisseria
VRYRNKHYLD

SEQ ID NO: 34412 - protein, 7 aa, Neisseria
ALAAGEK

SEQ ID NO: 34413 - protein, 10 aa, Neisseria
YSHQKNKILD

SEQ ID NO: 34414 - protein, 9 aa, Neisseria
QILKGRNRY

SEQ ID NO: 34415 - protein, 8 aa, Neisseria
RTEGLRAL

SEQ ID NO: 34416 - protein, 8 aa, Neisseria
KQFRKSSA

SEQ ID NO: 34417 - protein, 10 aa, Neisseria
PDQDFGRNNS

SEQ ID NO: 34418 - protein, 9 aa, Neisseria
PVREADNTV

SEQ ID NO: 34419 - protein, 31 aa, Neisseria
PAWKSFPSEDAQADAQRMNRFIEERVREHPE

SEQ ID NO: 34420 - protein, 14 aa, Neisseria
KRFKTRPEGSPDFY

SEQ ID NO: 34421 - protein, 8 aa, Neisseria
KPRRRIGE

SEQ ID NO: 34422 - protein, 12 aa, Neisseria
PEWDEEKRKTVL

SEQ ID NO: 34423 - protein, 5 aa, Neisseria
KCLKS

SEQ ID NO: 34424 - protein, 5 aa, Neisseria
VRYRN

SEQ ID NO: 34425 - protein, 7 aa, Neisseria
ALAAGEK

SEQ ID NO: 34426 - protein, 7 aa, Neisseria
QKNKILD

SEQ ID NO: 34427 - protein, 9 aa, Neisseria
QILKGRNRY

SEQ ID NO: 34428 - protein, 8 aa, Neisseria
RTEGLRAL

SEQ ID NO: 34429 - protein, 6 aa, Neisseria
QFRKSS

SEQ ID NO: 34430 - protein, 5 aa, Neisseria
QDFGR

SEQ ID NO: 34431 - protein, 7 aa, Neisseria
PVREADN

SEQ ID NO: 34432 - protein, 26 aa, Neisseria
FPSEDAQADAQRMNRFIEERVREHPE

SEQ ID NO: 34433 - protein, 11 aa, Neisseria
KRFKTRPEGSP

SEQ ID NO: 34434 - protein, 5 aa, Neisseria
AHRMG

SEQ ID NO: 34435 - protein, 12 aa, Neisseria
ADVLDAAHGAAG

SEQ ID NO: 34436 - protein, 5 aa, Neisseria
PVVEI

SEQ ID NO: 34437 - protein, 10 aa, Neisseria
LHRVFSTIPR

SEQ ID NO: 34438 - protein, 10 aa, Neisseria
DGAHRMGGRA

SEQ ID NO: 34439 - protein, 8 aa, Neisseria
FLQRKLEP

SEQ ID NO: 34440 - protein, 9 aa, Neisseria
AVGEDELGV

SEQ ID NO: 34441 - protein, 7 aa, Neisseria
YGDDHEN

SEQ ID NO: 34442 - protein, 10 aa, Neisseria
STIPRQSRPW

SEQ ID NO: 34443 - protein, 9 aa, Neisseria
PLRWCKTRF

SEQ ID NO: 34444 - protein, 7 aa, Neisseria
GAHRMGG

SEQ ID NO: 34445 - protein, 7 aa, Neisseria
LQRKLEP

SEQ ID NO: 34446 - protein, 9 aa, Neisseria
AVGEDELGV

SEQ ID NO: 34447 - protein, 7 aa, Neisseria
YGDDHEN

SEQ ID NO: 34448 - protein, 5 aa, Neisseria
PRQSR

SEQ ID NO: 34449 - protein, 7 aa, Neisseria
RYLKDYQ

SEQ ID NO: 34450 - protein, 11 aa, Neisseria
QCEPEGFRKIT

SEQ ID NO: 34451 - protein, 9 aa, Neisseria
DVMSKFTTT

SEQ ID NO: 34452 - protein, 10 aa, Neisseria
RHWVKWEDPF

SEQ ID NO: 34453 - protein, 7 aa, Neisseria
SLKNAMK

SEQ ID NO: 34454 - protein, 6 aa, Neisseria
GIESVV

SEQ ID NO: 34455 - protein, 7 aa, Neisseria
EYFHNWT

SEQ ID NO: 34456 - protein, 8 aa, Neisseria
RDWFQLSL

SEQ ID NO: 34457 - protein, 18 aa, Neisseria
DRAGRAVRRIENIRLLRQ

SEQ ID NO: 34458 - protein, 16 aa, Neisseria
HPVRPVSYEEMNNFYT

SEQ ID NO: 34459 - protein, 11 aa, Neisseria
GAEVVRMYHTL

SEQ ID NO: 34460 - protein, 6 aa, Neisseria
FQKGMK

SEQ ID NO: 34461 - protein, 19 aa, Neisseria
EGVTEAVVPSLLRGFSAPV

SEQ ID NO: 34462 - protein, 5 aa, Neisseria
CWEAA

SEQ ID NO: 34463 - protein, 8 aa, Neisseria
LAALSDGI

SEQ ID NO: 34464 - protein, 7 aa, Neisseria
KLLAAVE

SEQ ID NO: 34465 - protein, 8 aa, Neisseria
LDNAFKAL

SEQ ID NO: 34466 - protein, 9 aa, Neisseria
DGTENIDPL

SEQ ID NO: 34467 - protein, 5 aa, Neisseria
TLAVR

SEQ ID NO: 34468 - protein, 9 aa, Neisseria
LPKWHELDR

SEQ ID NO: 34469 - protein, 11 aa, Neisseria
DWRTLRNVCRA

SEQ ID NO: 34470 - protein, 13 aa, Neisseria
TVAEKYGEMAQNM

SEQ ID NO: 34471 - protein, 5 aa, Neisseria
WGILS

SEQ ID NO: 34472 - protein, 9 aa, Neisseria
LAQFADKFS

SEQ ID NO: 34473 - protein, 9 aa, Neisseria
DTLQQVQTA

SEQ ID NO: 34474 - protein, 10 aa, Neisseria
SLIGSFSRNV

SEQ ID NO: 34475 - protein, 12 aa, Neisseria
RLVQAFNLCNKL

SEQ ID NO: 34476 - protein, 15 aa, Neisseria
MSKTVRYLKDYQTPA

SEQ ID NO: 34477 - protein, 16 aa, Neisseria
TVVKSRLTVEPQRAGE

SEQ ID NO: 34478 - protein, 7 aa, Neisseria
LVLDGSA

SEQ ID NO: 34479 - protein, 10 aa, Neisseria
ADVPSERFTV

SEQ ID NO: 34480 - protein, 13 aa, Neisseria
VETEILPAENKSL

SEQ ID NO: 34481 - protein, 9 aa, Neisseria
QCEPEGFRK

SEQ ID NO: 34482 - protein, 8 aa, Neisseria
IDRPDVMS

SEQ ID NO: 34483 - protein, 8 aa, Neisseria
VADKKRYP

SEQ ID NO: 34484 - protein, 28 aa, Neisseria
SNGNKIDGGEFSDGRHWVKWEDPFAKPS

SEQ ID NO: 34485 - protein, 17 aa, Neisseria
AVTEDRFTTMSGRNVKI

SEQ ID NO: 34486 - protein, 9 aa, Neisseria
TTEADKPKV

SEQ ID NO: 34487 - protein, 8 aa, Neisseria
MKWDETRF

SEQ ID NO: 34488 - protein, 10 aa, Neisseria
NMGAMENKGL

SEQ ID NO: 34489 - protein, 14 aa, Neisseria
DSRTATDTDFEGIE

SEQ ID NO: 34490 - protein, 15 aa, Neisseria
YFHNWTGNRVTCRDW

SEQ ID NO: 34491 - protein, 5 aa, Neisseria
SLKEG

SEQ ID NO: 34492 - protein, 19 aa, Neisseria
RDQEFSGDRAGRAVRRIEN

SEQ ID NO: 34493 - protein, 28 aa, Neisseria
RLLRQNQFPEDAGPTAHPVRPVSYEEMN

SEQ ID NO: 34494 - protein, 8 aa, Neisseria
VYEKGAEV

SEQ ID NO: 34495 - protein, 7 aa, Neisseria
EGFQKGM

SEQ ID NO: 34496 - protein, 18 aa, Neisseria
FQRHDGQAVTCDDFRAAM

SEQ ID NO: 34497 - protein, 6 aa, Neisseria
SQAGTP

SEQ ID NO: 34498 - protein, 11 aa, Neisseria
LEAEGRLKNNV

SEQ ID NO: 34499 - protein, 16 aa, Neisseria
IKQTVPPTPDMADKQP

SEQ ID NO: 34500 - protein, 9 aa, Neisseria
LLNRNGEAV

SEQ ID NO: 34501 - protein, 9 aa, Neisseria
DYQGKRATE

SEQ ID NO: 34502 - protein, 5 aa, Neisseria
TEAEQ

SEQ ID NO: 34503 - protein, 9 aa, Neisseria
NYPYSDDDL

SEQ ID NO: 34504 - protein, 5 aa, Neisseria
HDSDA

SEQ ID NO: 34505 - protein, 13 aa, Neisseria
LSDGIGLPKHEKL

SEQ ID NO: 34506 - protein, 10 aa, Neisseria
VEKVISDDLL

SEQ ID NO: 34507 - protein, 18 aa, Neisseria
VPSEAELWDGTENIDPLR

SEQ ID NO: 34508 - protein, 7 aa, Neisseria
HQAREAL

SEQ ID NO: 34509 - protein, 23 aa, Neisseria
HELDRQAAKQENQSYEYSPETAD

SEQ ID NO: 34510 - protein, 7 aa, Neisseria
RTLRNVC

SEQ ID NO: 34511 - protein, 5 aa, Neisseria
ADPAH

SEQ ID NO: 34512 - protein, 8 aa, Neisseria
TVAEKYGE

SEQ ID NO: 34513 - protein, 11 aa, Neisseria
VNGNESDTRNC

SEQ ID NO: 34514 - protein, 11 aa, Neisseria
FADKFSDDALV

SEQ ID NO: 34515 - protein, 10 aa, Neisseria
GSSRRSDTLQ

SEQ ID NO: 34516 - protein, 15 aa, Neisseria
QHPKFSLENPNKARS

SEQ ID NO: 34517 - protein, 8 aa, Neisseria
GSFSRNVP

SEQ ID NO: 34518 - protein, 11 aa, Neisseria
AQDGSGYRFIA

SEQ ID NO: 34519 - protein, 12 aa, Neisseria
KVIEIDRFNPQV

SEQ ID NO: 34520 - protein, 17 aa, Neisseria
NKLEPHRKNLVKQELQC

SEQ ID NO: 34521 - protein, 14 aa, Neisseria
RAQEGLSKDVGEIV

SEQ ID NO: 34522 - protein, 9 aa, Neisseria
MSKTVRYLK

SEQ ID NO: 34523 - protein, 16 aa, Neisseria
TVVKSRLTVEPQRAGE

SEQ ID NO: 34524 - protein, 8 aa, Neisseria
VPSERFTV

SEQ ID NO: 34525 - protein, 12 aa, Neisseria
VETEILPAENKS

SEQ ID NO: 34526 - protein, 7 aa, Neisseria
CEPEGFR

SEQ ID NO: 34527 - protein, 7 aa, Neisseria
DRPDVMS

SEQ ID NO: 34528 - protein, 7 aa, Neisseria
VADKKRY

SEQ ID NO: 34529 - protein, 12 aa, Neisseria
NGNKIDGGEFSD

SEQ ID NO: 34530 - protein, 8 aa, Neisseria
VKWEDPFA

SEQ ID NO: 34531 - protein, 8 aa, Neisseria
AVTEDRFT

SEQ ID NO: 34532 - protein, 6 aa, Neisseria
SGRNVK

SEQ ID NO: 34533 - protein, 7 aa, Neisseria
EADKPKV

SEQ ID NO: 34534 - protein, 8 aa, Neisseria
MKWDETRF

SEQ ID NO: 34535 - protein, 6 aa, Neisseria
AMENKG

SEQ ID NO: 34536 - protein, 14 aa, Neisseria
DSRTATDTDFEGIE

SEQ ID NO: 34537 - protein, 5 aa, Neisseria
SLKEG

SEQ ID NO: 34538 - protein, 19 aa, Neisseria
RDQEFSGDRAGRAVRRIEN

SEQ ID NO: 34539 - protein, 8 aa, Neisseria
QFPEDAGP

SEQ ID NO: 34540 - protein, 7 aa, Neisseria
VSYEEMN

SEQ ID NO: 34541 - protein, 8 aa, Neisseria
VYEKGAEV

SEQ ID NO: 34542 - protein, 7 aa, Neisseria
EGFQKGM

SEQ ID NO: 34543 - protein, 5 aa, Neisseria
RHDGQ

SEQ ID NO: 34544 - protein, 9 aa, Neisseria
TCDDFRAAM

SEQ ID NO: 34545 - protein, 11 aa, Neisseria
LEAEGRLKNNV

SEQ ID NO: 34546 - protein, 8 aa, Neisseria
PDMADKQP

SEQ ID NO: 34547 - protein, 8 aa, Neisseria
YQGKRATE

SEQ ID NO: 34548 - protein, 5 aa, Neisseria
TEAEQ

SEQ ID NO: 34549 - protein, 6 aa, Neisseria
YSDDDL

SEQ ID NO: 34550 - protein, 5 aa, Neisseria
HDSDA

SEQ ID NO: 34551 - protein, 6 aa, Neisseria
PKHEKL

SEQ ID NO: 34552 - protein, 6 aa, Neisseria
VEKVIS

SEQ ID NO: 34553 - protein, 5 aa, Neisseria
SEAEL

SEQ ID NO: 34554 - protein, 8 aa, Neisseria
DGTENIDP

SEQ ID NO: 34555 - protein, 7 aa, Neisseria
HQAREAL

SEQ ID NO: 34556 - protein, 14 aa, Neisseria
HELDRQAAKQENQS

SEQ ID NO: 34557 - protein, 7 aa, Neisseria
YSPETAD

SEQ ID NO: 34558 - protein, 5 aa, Neisseria
ADPAH

SEQ ID NO: 34559 - protein, 8 aa, Neisseria
TVAEKYGE

SEQ ID NO: 34560 - protein, 9 aa, Neisseria
NGNESDTRN

SEQ ID NO: 34561 - protein, 11 aa, Neisseria
FADKFSDDALV

SEQ ID NO: 34562 - protein, 8 aa, Neisseria
SSRRSDTL

SEQ ID NO: 34563 - protein, 7 aa, Neisseria
NPNKARS

SEQ ID NO: 34564 - protein, 5 aa, Neisseria
QDGSG

SEQ ID NO: 34565 - protein, 9 aa, Neisseria
KVIEIDRFN

SEQ ID NO: 34566 - protein, 17 aa, Neisseria
NKLEPHRKNLVKQELQC

SEQ ID NO: 34567 - protein, 14 aa, Neisseria
RAQEGLSKDVGEIV

SEQ ID NO: 34568 - protein, 7 aa, Neisseria
ALIMSMV

SEQ ID NO: 34569 - protein, 8 aa, Neisseria
HTPEHVTG

SEQ ID NO: 34570 - protein, 10 aa, Neisseria
GYDILKQGGS

SEQ ID NO: 34571 - protein, 8 aa, Neisseria
LKFMEAVV

SEQ ID NO: 34572 - protein, 10 aa, Neisseria
YQSNSGEGVL

SEQ ID NO: 34573 - protein, 7 aa, Neisseria
NQGKVNT

SEQ ID NO: 34574 - protein, 7 aa, Neisseria
DAHTPEH

SEQ ID NO: 34575 - protein, 8 aa, Neisseria
TGLTEQKQ

SEQ ID NO: 34576 - protein, 6 aa, Neisseria
SANPLA

SEQ ID NO: 34577 - protein, 9 aa, Neisseria
ILKQGGSAA

SEQ ID NO: 34578 - protein, 9 aa, Neisseria
EPQSSGLGG

SEQ ID NO: 34579 - protein, 6 aa, Neisseria
DNTAKT

SEQ ID NO: 34580 - protein, 10 aa, Neisseria
TTFDGRETAP

SEQ ID NO: 34581 - protein, 10 aa, Neisseria
  VARIANT 7: Xaa is any amino acid
FLDKDGXPLK

SEQ ID NO: 34582 - protein, 7 aa, Neisseria
NQGKVNT

SEQ ID NO: 34583 - protein, 5 aa, Neisseria
TEQKQ

SEQ ID NO: 34584 - protein, 5 aa, Neisseria
GGSAA

SEQ ID NO: 34585 - protein, 8 aa, Neisseria
FDGRETAP

SEQ ID NO: 34586 - protein, 8 aa, Neisseria
  VARIANT 7: Xaa is any amino acid
FLDKDGXP

SEQ ID NO: 34587 - protein, 6 aa, Neisseria
FAIIAD

SEQ ID NO: 34588 - protein, 11 aa, Neisseria
ARVERFPHFAA

SEQ ID NO: 34589 - protein, 8 aa, Neisseria
LARKAAQF

SEQ ID NO: 34590 - protein, 7 aa, Neisseria
IAAVAEI

SEQ ID NO: 34591 - protein, 19 aa, Neisseria
ADQLRRMFFNQFEKLGNHD

SEQ ID NO: 34592 - protein, 11 aa, Neisseria
EVVLHKIAAGL

SEQ ID NO: 34593 - protein, 12 aa, Neisseria
LGGEIVSDPCDF

SEQ ID NO: 34594 - protein, 11 aa, Neisseria
VESAADQTETQ

SEQ ID NO: 34595 - protein, 5 aa, Neisseria
ARVER

SEQ ID NO: 34596 - protein, 7 aa, Neisseria
LARKAAQ

SEQ ID NO: 34597 - protein, 13 aa, Neisseria
RHIRPRLVKREQI

SEQ ID NO: 34598 - protein, 6 aa, Neisseria
PADQLR

SEQ ID NO: 34599 - protein, 8 aa, Neisseria
EKLGNHDF

SEQ ID NO: 34600 - protein, 9 aa, Neisseria
HTAGNRHNL

SEQ ID NO: 34601 - protein, 16 aa, Neisseria
VIRQGRRQVIQRTDTL

SEQ ID NO: 34602 - protein, 18 aa, Neisseria
IESQNRIHGSTLHSKTDL

SEQ ID NO: 34603 - protein, 7 aa, Neisseria
IVSDPCD

SEQ ID NO: 34604 - protein, 11 aa, Neisseria
VESAADQTETQ

SEQ ID NO: 34605 - protein, 5 aa, Neisseria
ARVER

SEQ ID NO: 34606 - protein, 7 aa, Neisseria
LARKAAQ

SEQ ID NO: 34607 - protein, 13 aa, Neisseria
RHIRPRLVKREQI

SEQ ID NO: 34608 - protein, 5 aa, Neisseria
EKLGN

SEQ ID NO: 34609 - protein, 13 aa, Neisseria
RQGRRQVIQRTDT

SEQ ID NO: 34610 - protein, 6 aa, Neisseria
SQNRIH

SEQ ID NO: 34611 - protein, 7 aa, Neisseria
LHSKTDL

SEQ ID NO: 34612 - protein, 6 aa, Neisseria
KLHRAF

SEQ ID NO: 34613 - protein, 8 aa, Neisseria
QIFRHVQS

SEQ ID NO: 34614 - protein, 6 aa, Neisseria
KPPNTA

SEQ ID NO: 34615 - protein, 13 aa, Neisseria
MRRIVKKHQPVNA

SEQ ID NO: 34616 - protein, 23 aa, Neisseria
GRKRPHHHDRSLRRQHGIEGMGF

SEQ ID NO: 34617 - protein, 22 aa, Neisseria
VQSSNRQSGRQPVCTKPPNTAS

SEQ ID NO: 34618 - protein, 7 aa, Neisseria
ADIKRIL

SEQ ID NO: 34619 - protein, 10 aa, Neisseria
MRRIVKKHQP

SEQ ID NO: 34620 - protein, 17 aa, Neisseria
GRKRPHHHDRSLRRQHG

SEQ ID NO: 34621 - protein, 18 aa, Neisseria
QSSNRQSGRQPVCTKPPN

SEQ ID NO: 34622 - protein, 7 aa, Neisseria
ADIKRIL

SEQ ID NO: 34623 - protein, 5 aa, Neisseria
RSCFG

SEQ ID NO: 34624 - protein, 8 aa, Neisseria
VKNASGVS

SEQ ID NO: 34625 - protein, 5 aa, Neisseria
ITRSA

SEQ ID NO: 34626 - protein, 10 aa, Neisseria
FSACSAFCPL

SEQ ID NO: 34627 - protein, 9 aa, Neisseria
CRNCLARSC

SEQ ID NO: 34628 - protein, 14 aa, Neisseria
NASGVSSSRICPLS

SEQ ID NO: 34629 - protein, 13 aa, Neisseria
KITRSATSRANPI

SEQ ID NO: 34630 - protein, 31 aa, Neisseria
NTSPTISGSSAEVGSSNSITRGSIASPRAIA

SEQ ID NO: 34631 - protein, 10 aa, Neisseria
WPPESWEGKA

SEQ ID NO: 34632 - protein, 9 aa, Neisseria
ASPTRSKSS

SEQ ID NO: 34633 - protein, 5 aa, Neisseria
ACSAF

SEQ ID NO: 34634 - protein, 6 aa, Neisseria
NTVRCG

SEQ ID NO: 34635 - protein, 11 aa, Neisseria
KITRSATSRAN

SEQ ID NO: 34636 - protein, 7 aa, Neisseria
SSAEVGS

SEQ ID NO: 34637 - protein, 6 aa, Neisseria
PTRSKS

SEQ ID NO: 34638 - protein, 5 aa, Neisseria
FNAPN

SEQ ID NO: 34639 - protein, 5 aa, Neisseria
KGAAK

SEQ ID NO: 34640 - protein, 6 aa, Neisseria
RLFIRY

SEQ ID NO: 34641 - protein, 30 aa, Neisseria
TPFNAPNTPPKMRLAKPRPTAETAPVSSER

SEQ ID NO: 34642 - protein, 31 aa, Neisseria
QAMTNREMNDRANANRRGWNEAKARSAKGAA

SEQ ID NO: 34643 - protein, 9 aa, Neisseria
SLAKKKETT

SEQ ID NO: 34644 - protein, 8 aa, Neisseria
AEARRSAM

SEQ ID NO: 34645 - protein, 15 aa, Neisseria
TPPKMRLAKPRPTAE

SEQ ID NO: 34646 - protein, 7 aa, Neisseria
APVSSER

SEQ ID NO: 34647 - protein, 29 aa, Neisseria
MTNREMNDRANANRRGWNEAKARSAKGAA

SEQ ID NO: 34648 - protein, 9 aa, Neisseria
SLAKKKETT

SEQ ID NO: 34649 - protein, 8 aa, Neisseria
AEARRSAM

SEQ ID NO: 34650 - protein, 10 aa, Neisseria
RAIDIIKAQK

SEQ ID NO: 34651 - protein, 10 aa, Neisseria
AALPPFVSVV

SEQ ID NO: 34652 - protein, 12 aa, Neisseria
AQNIRRILAEVP

SEQ ID NO: 34653 - protein, 10 aa, Neisseria
AFCRQFDRPY

SEQ ID NO: 34654 - protein, 8 aa, Neisseria
RVQTASDI

SEQ ID NO: 34655 - protein, 7 aa, Neisseria
AATRFPN

SEQ ID NO: 34656 - protein, 6 aa, Neisseria
HPSEYG

SEQ ID NO: 34657 - protein, 9 aa, Neisseria
PENVGEAVR

SEQ ID NO: 34658 - protein, 5 aa, Neisseria
TGAEA

SEQ ID NO: 34659 - protein, 18 aa, Neisseria
MRKIRTKICGITTPEDAL

SEQ ID NO: 34660 - protein, 14 aa, Neisseria
PQSPRAIDIIKAQK

SEQ ID NO: 34661 - protein, 11 aa, Neisseria
ESAQNIRRILA

SEQ ID NO: 34662 - protein, 9 aa, Neisseria
FHGDEDDAF

SEQ ID NO: 34663 - protein, 7 aa, Neisseria
QFDRPYI

SEQ ID NO: 34664 - protein, 10 aa, Neisseria
QTASDIRNAA

SEQ ID NO: 34665 - protein, 14 aa, Neisseria
YHPSEYGGTGHRFD

SEQ ID NO: 34666 - protein, 6 aa, Neisseria
EYSGKP

SEQ ID NO: 34667 - protein, 13 aa, Neisseria
GGLTPENVGEAVR

SEQ ID NO: 34668 - protein, 20 aa, Neisseria
EAVDVSGGVEASKGKKDPAK

SEQ ID NO: 34669 - protein, 7 aa, Neisseria
TANRLSR

SEQ ID NO: 34670 - protein, 8 aa, Neisseria
MRKIRTKI

SEQ ID NO: 34671 - protein, 6 aa, Neisseria
TPEDAL

SEQ ID NO: 34672 - protein, 6 aa, Neisseria
SPRAID

SEQ ID NO: 34673 - protein, 5 aa, Neisseria
IKAQK

SEQ ID NO: 34674 - protein, 10 aa, Neisseria
SAQNIRRILA

SEQ ID NO: 34675 - protein, 8 aa, Neisseria
HGDEDDAF

SEQ ID NO: 34676 - protein, 7 aa, Neisseria
SDIRNAA

SEQ ID NO: 34677 - protein, 7 aa, Neisseria
NVGEAVR

SEQ ID NO: 34678 - protein, 12 aa, Neisseria
VEASKGKKDPAK

SEQ ID NO: 34679 - protein, 5 aa, Neisseria
NRLSR

SEQ ID NO: 34680 - protein, 18 aa, Neisseria
LNDRLNQNVTEALGGVDV

SEQ ID NO: 34681 - protein, 5 aa, Neisseria
RLTDA

SEQ ID NO: 34682 - protein, 8 aa, Neisseria
VVLKQLPK

SEQ ID NO: 34683 - protein, 13 aa, Neisseria
RIANLLELLKPYL

SEQ ID NO: 34684 - protein, 9 aa, Neisseria
KLFRYLGEE

SEQ ID NO: 34685 - protein, 6 aa, Neisseria
FEEGDG

SEQ ID NO: 34686 - protein, 9 aa, Neisseria
GERLKKIST

SEQ ID NO: 34687 - protein, 7 aa, Neisseria
KVWVKVK

SEQ ID NO: 34688 - protein, 11 aa, Neisseria
LAGERAAGGYR

SEQ ID NO: 34689 - protein, 10 aa, Neisseria
VGRPNVGKST

SEQ ID NO: 34690 - protein, 15 aa, Neisseria
SITSKKAQTTRNRVT

SEQ ID NO: 34691 - protein, 6 aa, Neisseria
YTDDTA

SEQ ID NO: 34692 - protein, 22 aa, Neisseria
TPGFQTDHRNALNDRLNQNVTE

SEQ ID NO: 34693 - protein, 10 aa, Neisseria
MRLTDADRVV

SEQ ID NO: 34694 - protein, 6 aa, Neisseria
QLPKHT

SEQ ID NO: 34695 - protein, 12 aa, Neisseria
KIDKDKAKDRYA

SEQ ID NO: 34696 - protein, 5 aa, Neisseria
VRAEF

SEQ ID NO: 34697 - protein, 9 aa, Neisseria
LKPYLPESV

SEQ ID NO: 34698 - protein, 13 aa, Neisseria
MYPEDMVTDKSAR

SEQ ID NO: 34699 - protein, 7 aa, Neisseria
IVREKLF

SEQ ID NO: 34700 - protein, 6 aa, Neisseria
LGEELP

SEQ ID NO: 34701 - protein, 13 aa, Neisseria
VEVEQFEEGDGLN

SEQ ID NO: 34702 - protein, 7 aa, Neisseria
VDKESQK

SEQ ID NO: 34703 - protein, 26 aa, Neisseria
GKGGERLKKISTEARLDMEKLFDNKV

SEQ ID NO: 34704 - protein, 13 aa, Neisseria
VKSGWADDIRFLR

SEQ ID NO: 34705 - protein, 8 aa, Neisseria
LAGERAAG

SEQ ID NO: 34706 - protein, 13 aa, Neisseria
ITSKKAQTTRNRV

SEQ ID NO: 34707 - protein, 6 aa, Neisseria
YTDDTA

SEQ ID NO: 34708 - protein, 12 aa, Neisseria
TDHRNALNDRLN

SEQ ID NO: 34709 - protein, 10 aa, Neisseria
MRLTDADRVV

SEQ ID NO: 34710 - protein, 12 aa, Neisseria
KIDKDKAKDRYA

SEQ ID NO: 34711 - protein, 5 aa, Neisseria
VRAEF

SEQ ID NO: 34712 - protein, 9 aa, Neisseria
DMVTDKSAR

SEQ ID NO: 34713 - protein, 7 aa, Neisseria
IVREKLF

SEQ ID NO: 34714 - protein, 6 aa, Neisseria
LGEELP

SEQ ID NO: 34715 - protein, 13 aa, Neisseria
VEVEQFEEGDGLN

SEQ ID NO: 34716 - protein, 7 aa, Neisseria
VDKESQK

SEQ ID NO: 34717 - protein, 22 aa, Neisseria
KGGERLKKISTEARLDMEKLFD

SEQ ID NO: 34718 - protein, 11 aa, Neisseria
SGWADDIRFLR

SEQ ID NO: 34719 - protein, 6 aa, Neisseria
VYQSLI

SEQ ID NO: 34720 - protein, 23 aa, Neisseria
TAAPEIAKNIREMSDFAKADEEL

SEQ ID NO: 34721 - protein, 9 aa, Neisseria
AADYIQKIR

SEQ ID NO: 34722 - protein, 12 aa, Neisseria
TACHELSAMPET

SEQ ID NO: 34723 - protein, 24 aa, Neisseria
IEVTKTFGGTDGHKFVNGILDKLA

SEQ ID NO: 34724 - protein, 12 aa, Neisseria
MKTARRRSRELA

SEQ ID NO: 34725 - protein, 20 aa, Neisseria
EIAKNIREMSDFAKADEELF

SEQ ID NO: 34726 - protein, 5 aa, Neisseria
TQTNA

SEQ ID NO: 34727 - protein, 21 aa, Neisseria
YIQKIRPLLDRDEKDLNPIER

SEQ ID NO: 34728 - protein, 7 aa, Neisseria
AMPETPY

SEQ ID NO: 34729 - protein, 17 aa, Neisseria
EAIEVTKTFGGTDGHKF

SEQ ID NO: 34730 - protein, 13 aa, Neisseria
LAAQIRPDEPKRR

SEQ ID NO: 34731 - protein, 12 aa, Neisseria
MKTARRRSRELA

SEQ ID NO: 34732 - protein, 20 aa, Neisseria
EIAKNIREMSDFAKADEELF

SEQ ID NO: 34733 - protein, 19 aa, Neisseria
QKIRPLLDRDEKDLNPIER

SEQ ID NO: 34734 - protein, 5 aa, Neisseria
EAIEV

SEQ ID NO: 34735 - protein, 9 aa, Neisseria
IRPDEPKRR

SEQ ID NO: 34736 - protein, 22 aa, Neisseria
RFTNEIGSQMLKVCCRTLQELG

SEQ ID NO: 34737 - protein, 5 aa, Neisseria
ALIAI

SEQ ID NO: 34738 - protein, 12 aa, Neisseria
QAIERIGEKASD

SEQ ID NO: 34739 - protein, 11 aa, Neisseria
ECANLVNLLLE

SEQ ID NO: 34740 - protein, 9 aa, Neisseria
PNLDGKHLR

SEQ ID NO: 34741 - protein, 7 aa, Neisseria
GVADENI

SEQ ID NO: 34742 - protein, 6 aa, Neisseria
SSEKFD

SEQ ID NO: 34743 - protein, 6 aa, Neisseria
IRGETY

SEQ ID NO: 34744 - protein, 8 aa, Neisseria
ANESGAGI

SEQ ID NO: 34745 - protein, 23 aa, Neisseria
TENDAQAIERIGEKASDAAKVAV

SEQ ID NO: 34746 - protein, 7 aa, Neisseria
EQFEDEE

SEQ ID NO: 34747 - protein, 7 aa, Neisseria
LDGKHLR

SEQ ID NO: 34748 - protein, 7 aa, Neisseria
GVADENI

SEQ ID NO: 34749 - protein, 6 aa, Neisseria
SSEKFD

SEQ ID NO: 34750 - protein, 6 aa, Neisseria
IRGETY

SEQ ID NO: 34751 - protein, 5 aa, Neisseria
ESGAG

SEQ ID NO: 34752 - protein, 23 aa, Neisseria
TENDAQAIERIGEKASDAAKVAV

SEQ ID NO: 34753 - protein, 7 aa, Neisseria
EQFEDEE

SEQ ID NO: 34754 - protein, 9 aa, Neisseria
TVRLCRFRR

SEQ ID NO: 34755 - protein, 25 aa, Neisseria
LTAFRRVQNHFVAFARFNQATRQRR

SEQ ID NO: 34756 - protein, 7 aa, Neisseria
IDFIDAD

SEQ ID NO: 34757 - protein, 6 aa, Neisseria
FDGLLA

SEQ ID NO: 34758 - protein, 9 aa, Neisseria
CRPVDDLDD

SEQ ID NO: 34759 - protein, 14 aa, Neisseria
AFFIDQLIKLVFQC

SEQ ID NO: 34760 - protein, 11 aa, Neisseria
CRFRRHSRSVD

SEQ ID NO: 34761 - protein, 10 aa, Neisseria
DVFDRKDFNF

SEQ ID NO: 34762 - protein, 13 aa, Neisseria
QATRQRRNPRNFV

SEQ ID NO: 34763 - protein, 8 aa, Neisseria
IDADDFDG

SEQ ID NO: 34764 - protein, 9 aa, Neisseria
QQTDGRAEK

SEQ ID NO: 34765 - protein, 8 aa, Neisseria
GIDDDGSL

SEQ ID NO: 34766 - protein, 9 aa, Neisseria
FGQETDAAV

SEQ ID NO: 34767 - protein, 10 aa, Neisseria
RPVDDLDDFG

SEQ ID NO: 34768 - protein, 6 aa, Neisseria
PSGGRN

SEQ ID NO: 34769 - protein, 11 aa, Neisseria
CRFRRHSRSVD

SEQ ID NO: 34770 - protein, 8 aa, Neisseria
DVFDRKDF

SEQ ID NO: 34771 - protein, 10 aa, Neisseria
QATRQRRNPR

SEQ ID NO: 34772 - protein, 7 aa, Neisseria
IDADDFD

SEQ ID NO: 34773 - protein, 9 aa, Neisseria
QQTDGRAEK

SEQ ID NO: 34774 - protein, 7 aa, Neisseria
GIDDDGS

SEQ ID NO: 34775 - protein, 8 aa, Neisseria
GQETDAAV

SEQ ID NO: 34776 - protein, 8 aa, Neisseria
RPVDDLDD

SEQ ID NO: 34777 - protein, 5 aa, Neisseria
MRGVI

SEQ ID NO: 34778 - protein, 5 aa, Neisseria
FAAPF

SEQ ID NO: 34779 - protein, 12 aa, Neisseria
IQKMLRSLLTGA

SEQ ID NO: 34780 - protein, 10 aa, Neisseria
RILGGVFGAL

SEQ ID NO: 34781 - protein, 5 aa, Neisseria
PDTEE

SEQ ID NO: 34782 - protein, 15 aa, Neisseria
SKTDLPDTEEWQQSY

SEQ ID NO: 34783 - protein, 13 aa, Neisseria
NHTDNAPESLDDD

SEQ ID NO: 34784 - protein, 12 aa, Neisseria
SKTDLPDTEEWQ

SEQ ID NO: 34785 - protein, 11 aa, Neisseria
TDNAPESLDDD

SEQ ID NO: 34786 - protein, 11 aa, Neisseria
FSEEAKFISAM

SEQ ID NO: 34787 - protein, 9 aa, Neisseria
CAVFGKLPR

SEQ ID NO: 34788 - protein, 6 aa, Neisseria
LGKQCG

SEQ ID NO: 34789 - protein, 7 aa, Neisseria
VGEADDA

SEQ ID NO: 34790 - protein, 8 aa, Neisseria
VGVVGVFV

SEQ ID NO: 34791 - protein, 8 aa, Neisseria
KCVHCGNT

SEQ ID NO: 34792 - protein, 12 aa, Neisseria
GGKLADFTTIPA

SEQ ID NO: 34793 - protein, 26 aa, Neisseria
CAPFAALRCFCIFGVWKRIRAVFCGR

SEQ ID NO: 34794 - protein, 8 aa, Neisseria
NFSEEAKF

SEQ ID NO: 34795 - protein, 11 aa, Neisseria
ATPNSWRVRQQ

SEQ ID NO: 34796 - protein, 6 aa, Neisseria
LVKRAC

SEQ ID NO: 34797 - protein, 10 aa, Neisseria
PMRRCLPSRL

SEQ ID NO: 34798 - protein, 6 aa, Neisseria
SECRLK

SEQ ID NO: 34799 - protein, 9 aa, Neisseria
GLGKQCGGF

SEQ ID NO: 34800 - protein, 12 aa, Neisseria
FGDVGEADDAEV

SEQ ID NO: 34801 - protein, 6 aa, Neisseria
AAEETP

SEQ ID NO: 34802 - protein, 7 aa, Neisseria
AVKEADG

SEQ ID NO: 34803 - protein, 17 aa, Neisseria
DGVGGDAAVECRGKCLC

SEQ ID NO: 34804 - protein, 9 aa, Neisseria
TLGGGKLAD

SEQ ID NO: 34805 - protein, 7 aa, Neisseria
LSADGGG

SEQ ID NO: 34806 - protein, 5 aa, Neisseria
FCGRR

SEQ ID NO: 34807 - protein, 8 aa, Neisseria
NFSEEAKF

SEQ ID NO: 34808 - protein, 5 aa, Neisseria
WRVRQ

SEQ ID NO: 34809 - protein, 6 aa, Neisseria
LVKRAC

SEQ ID NO: 34810 - protein, 7 aa, Neisseria
PMRRCLP

SEQ ID NO: 34811 - protein, 6 aa, Neisseria
SECRLK

SEQ ID NO: 34812 - protein, 10 aa, Neisseria
DVGEADDAEV

SEQ ID NO: 34813 - protein, 6 aa, Neisseria
AAEETP

SEQ ID NO: 34814 - protein, 7 aa, Neisseria
AVKEADG

SEQ ID NO: 34815 - protein, 10 aa, Neisseria
AAVECRGKCL

SEQ ID NO: 34816 - protein, 5 aa, Neisseria
FCGRR

SEQ ID NO: 34817 - protein, 16 aa, Neisseria
RLRKCGRILSGICEPF

SEQ ID NO: 34818 - protein, 7 aa, Neisseria
IKMPSEP

SEQ ID NO: 34819 - protein, 7 aa, Neisseria
AGFIRFP

SEQ ID NO: 34820 - protein, 10 aa, Neisseria
PYGERRKNWD

SEQ ID NO: 34821 - protein, 11 aa, Neisseria
LSPTRLRKCGR

SEQ ID NO: 34822 - protein, 14 aa, Neisseria
CVNDEIKMPSEPDW

SEQ ID NO: 34823 - protein, 9 aa, Neisseria
RFPTDRPIL

SEQ ID NO: 34824 - protein, 22 aa, Neisseria
ISPRTGFRYPTRSLPKSKKAYG

SEQ ID NO: 34825 - protein, 8 aa, Neisseria
GERRKNWD

SEQ ID NO: 34826 - protein, 10 aa, Neisseria
SPTRLRKCGR

SEQ ID NO: 34827 - protein, 12 aa, Neisseria
NDEIKMPSEPDW

SEQ ID NO: 34828 - protein, 7 aa, Neisseria
PTDRPIL

SEQ ID NO: 34829 - protein, 10 aa, Neisseria
SLPKSKKAYG

SEQ ID NO: 34830 - protein, 16 aa, Neisseria
TPDKSARWENIGTISN

SEQ ID NO: 34831 - protein, 6 aa, Neisseria
RFANTP

SEQ ID NO: 34832 - protein, 6 aa, Neisseria
SSLQLF

SEQ ID NO: 34833 - protein, 8 aa, Neisseria
RPMSILSG

SEQ ID NO: 34834 - protein, 12 aa, Neisseria
CSTPDKSARWEN

SEQ ID NO: 34835 - protein, 6 aa, Neisseria
GTISNG

SEQ ID NO: 34836 - protein, 11 aa, Neisseria
INKDSVRKNGN

SEQ ID NO: 34837 - protein, 20 aa, Neisseria
QDKKVVTNLKQERFANTPAY

SEQ ID NO: 34838 - protein, 8 aa, Neisseria
CNNKTYRL

SEQ ID NO: 34839 - protein, 20 aa, Neisseria
FDTKNTEISTQNYTASSLRP

SEQ ID NO: 34840 - protein, 9 aa, Neisseria
GTLTEKQYE

SEQ ID NO: 34841 - protein, 6 aa, Neisseria
VCGKKL

SEQ ID NO: 34842 - protein, 11 aa, Neisseria
STPDKSARWEN

SEQ ID NO: 34843 - protein, 10 aa, Neisseria
INKDSVRKNG

SEQ ID NO: 34844 - protein, 7 aa, Neisseria
QDKKVVT

SEQ ID NO: 34845 - protein, 7 aa, Neisseria
LKQERFA

SEQ ID NO: 34846 - protein, 8 aa, Neisseria
DTKNTEIS

SEQ ID NO: 34847 - protein, 7 aa, Neisseria
LTEKQYE

SEQ ID NO: 34848 - protein, 6 aa, Neisseria
VCGKKL

SEQ ID NO: 34849 - protein, 7 aa, Neisseria
AACGTVQ

SEQ ID NO: 34850 - protein, 5 aa, Neisseria
LAEPL

SEQ ID NO: 34851 - protein, 24 aa, Neisseria
WADTLDDMLEAALSNAFNRLDSTR

SEQ ID NO: 34852 - protein, 12 aa, Neisseria
WTVYIDAFQGSY

SEQ ID NO: 34853 - protein, 18 aa, Neisseria
AMTAALEQGLKQAAQQMV

SEQ ID NO: 34854 - protein, 31 aa, Neisseria; identical to SEQ ID NO: 9385

SEQ ID NO: 34855 - protein, 10 aa, Neisseria
TDPYRINTAQ

SEQ ID NO: 34856 - protein, 7 aa, Neisseria
TLDDMLE

SEQ ID NO: 34857 - protein, 9 aa, Neisseria
NRLDSTRTF

SEQ ID NO: 34858 - protein, 9 aa, Neisseria
ASRSGSTDK

SEQ ID NO: 34859 - protein, 10 aa, Neisseria
FQGSYTGKTL

SEQ ID NO: 34860 - protein, 21 aa, Neisseria
LPDGTNRPFHIETEQQGDGYA

SEQ ID NO: 34861 - protein, 7 aa, Neisseria
QGLKQAA

SEQ ID NO: 34862 - protein, 7 aa, Neisseria
PDSRYIR

SEQ ID NO: 34863 - protein, 21 aa, Neisseria
ATQGGETAVEVRLAEPLKRGG

SEQ ID NO: 34864 - protein, 7 aa, Neisseria
TLDDMLE

SEQ ID NO: 34865 - protein, 7 aa, Neisseria
NRLDSTR

SEQ ID NO: 34866 - protein, 8 aa, Neisseria
SRSGSTDK

SEQ ID NO: 34867 - protein, 10 aa, Neisseria
FHIETEQQGD

SEQ ID NO: 34868 - protein, 7 aa, Neisseria
QGLKQAA

SEQ ID NO: 34869 - protein, 8 aa, Neisseria
NFAFCGVV

SEQ ID NO: 34870 - protein, 5 aa, Neisseria
CAVLP

SEQ ID NO: 34871 - protein, 6 aa, Neisseria
VSAASQ

SEQ ID NO: 34872 - protein, 10 aa, Neisseria
WAALDTLTEP

SEQ ID NO: 34873 - protein, 7 aa, Neisseria
CESLHRH

SEQ ID NO: 34874 - protein, 11 aa, Neisseria
GAEAYEQLAKN

SEQ ID NO: 34875 - protein, 12 aa, Neisseria
EKQMETLSRIFG

SEQ ID NO: 34876 - protein, 5 aa, Neisseria
AVEVL

SEQ ID NO: 34877 - protein, 8 aa, Neisseria
AAEQLKAA

SEQ ID NO: 34878 - protein, 20 aa, Neisseria
LNNKHSYSYAKEPHTVKPRF

SEQ ID NO: 34879 - protein, 12 aa, Neisseria
CSPEPAAEKTVS

SEQ ID NO: 34880 - protein, 17 aa, Neisseria
PTARGDAVVPKNPERVA

SEQ ID NO: 34881 - protein, 7 aa, Neisseria
TLTEPGV

SEQ ID NO: 34882 - protein, 6 aa, Neisseria
AFDKAA

SEQ ID NO: 34883 - protein, 13 aa, Neisseria
FEPDCESLHRHNP

SEQ ID NO: 34884 - protein, 16 aa, Neisseria
GGPGAEAYEQLAKNAT

SEQ ID NO: 34885 - protein, 19 aa, Neisseria
LTVDNGNIRTSGEKQMETL

SEQ ID NO: 34886 - protein, 10 aa, Neisseria
IFGKEARVAE

SEQ ID NO: 34887 - protein, 15 aa, Neisseria
FAQKREAAKGKGRGL

SEQ ID NO: 34888 - protein, 15 aa, Neisseria
VTGNKVSAFGTQSRL

SEQ ID NO: 34889 - protein, 19 aa, Neisseria
GDIGLPPVDESLRNEGHGQ

SEQ ID NO: 34890 - protein, 9 aa, Neisseria
YIKEKNPGW

SEQ ID NO: 34891 - protein, 11 aa, Neisseria
RTAAIGQEGPA

SEQ ID NO: 34892 - protein, 7 aa, Neisseria
NAWKRKQ

SEQ ID NO: 34893 - protein, 14 aa, Neisseria
EQLKAAFEKAEPVA

SEQ ID NO: 34894 - protein, 9 aa, Neisseria
YAKEPHTVK

SEQ ID NO: 34895 - protein, 12 aa, Neisseria
CSPEPAAEKTVS

SEQ ID NO: 34896 - protein, 8 aa, Neisseria
TARGDAVV

SEQ ID NO: 34897 - protein, 7 aa, Neisseria
KNPERVA

SEQ ID NO: 34898 - protein, 6 aa, Neisseria
AFDKAA

SEQ ID NO: 34899 - protein, 11 aa, Neisseria
FEPDCESLHRH

SEQ ID NO: 34900 - protein, 8 aa, Neisseria
EAYEQLAK

SEQ ID NO: 34901 - protein, 14 aa, Neisseria
GNIRTSGEKQMETL

SEQ ID NO: 34902 - protein, 10 aa, Neisseria
IFGKEARVAE

SEQ ID NO: 34903 - protein, 14 aa, Neisseria
FAQKREAAKGKGRG

SEQ ID NO: 34904 - protein, 12 aa, Neisseria
PVDESLRNEGHG

SEQ ID NO: 34905 - protein, 7 aa, Neisseria
YIKEKNP

SEQ ID NO: 34906 - protein, 6 aa, Neisseria
GQEGPA

SEQ ID NO: 34907 - protein, 6 aa, Neisseria
AWKRKQ

SEQ ID NO: 34908 - protein, 14 aa, Neisseria
EQLKAAFEKAEPVA

SEQ ID NO: 34909 - protein, 22 aa, Neisseria
DVFDDICSAVEGFGGIARSVQL

SEQ ID NO: 34910 - protein, 12 aa, Neisseria
SAGIVETVGKPL

SEQ ID NO: 34911 - protein, 5 aa, Neisseria
VEADI

SEQ ID NO: 34912 - protein, 13 aa, Neisseria
IPRAFGSGIAAAL

SEQ ID NO: 34913 - protein, 11 aa, Neisseria
NFSCRADDVFD

SEQ ID NO: 34914 - protein, 8 aa, Neisseria
LRQHSAGI

SEQ ID NO: 34915 - protein, 9 aa, Neisseria
TVGKPLSGA

SEQ ID NO: 34916 - protein, 5 aa, Neisseria
VEADI

SEQ ID NO: 34917 - protein, 13 aa, Neisseria
DAVKAESVNGTTG

SEQ ID NO: 34918 - protein, 8 aa, Neisseria
CRADDVFD

SEQ ID NO: 34919 - protein, 5 aa, Neisseria
VEADI

SEQ ID NO: 34920 - protein, 9 aa, Neisseria
DAVKAESVN

SEQ ID NO: 34921 - protein, 6 aa, Neisseria
AALFAL

SEQ ID NO: 34922 - protein, 13 aa, Neisseria
KVEVLEFFGYFCP

SEQ ID NO: 34923 - protein, 6 aa, Neisseria
CARLEP

SEQ ID NO: 34924 - protein, 8 aa, Neisseria
LSKHAKSF

SEQ ID NO: 34925 - protein, 7 aa, Neisseria
LARLAAA

SEQ ID NO: 34926 - protein, 5 aa, Neisseria
FDAMV

SEQ ID NO: 34927 - protein, 8 aa, Neisseria
PEVLKKWL

SEQ ID NO: 34928 - protein, 5 aa, Neisseria
SPESQ

SEQ ID NO: 34929 - protein, 10 aa, Neisseria
GKMQELTETF

SEQ ID NO: 34930 - protein, 5 aa, Neisseria
MKSRH

SEQ ID NO: 34931 - protein, 15 aa, Neisseria
CDSKVQTSVPADSAP

SEQ ID NO: 34932 - protein, 8 aa, Neisseria
GLVEGQNY

SEQ ID NO: 34933 - protein, 12 aa, Neisseria
PIPQQQAGKVEV

SEQ ID NO: 34934 - protein, 11 aa, Neisseria
CPHCARLEPVL

SEQ ID NO: 34935 - protein, 12 aa, Neisseria
KHAKSFKDDMYL

SEQ ID NO: 34936 - protein, 10 aa, Neisseria
AAAESKDVAN

SEQ ID NO: 34937 - protein, 12 aa, Neisseria
QKIKLQEPEVLK

SEQ ID NO: 34938 - protein, 8 aa, Neisseria
TAFDGKKV

SEQ ID NO: 34939 - protein, 17 aa, Neisseria
ESPESQARAGKMQELTE

SEQ ID NO: 34940 - protein, 7 aa, Neisseria
FQIDGTP

SEQ ID NO: 34941 - protein, 11 aa, Neisseria
VGGKYKVEFAD

SEQ ID NO: 34942 - protein, 6 aa, Neisseria
ESGMNT

SEQ ID NO: 34943 - protein, 13 aa, Neisseria
LADKVREEQKAAQ

SEQ ID NO: 34944 - protein, 5 aa, Neisseria
MKSRH

SEQ ID NO: 34945 - protein, 7 aa, Neisseria
CDSKVQT

SEQ ID NO: 34946 - protein, 7 aa, Neisseria
VPADSAP

SEQ ID NO: 34947 - protein, 7 aa, Neisseria
QAGKVEV

SEQ ID NO: 34948 - protein, 7 aa, Neisseria
ARLEPVL

SEQ ID NO: 34949 - protein, 12 aa, Neisseria
KHAKSFKDDMYL

SEQ ID NO: 34950 - protein, 9 aa, Neisseria
AAAESKDVA

SEQ ID NO: 34951 - protein, 12 aa, Neisseria
QKIKLQEPEVLK

SEQ ID NO: 34952 - protein, 8 aa, Neisseria
TAFDGKKV

SEQ ID NO: 34953 - protein, 17 aa, Neisseria
ESPESQARAGKMQELTE

SEQ ID NO: 34954 - protein, 9 aa, Neisseria
GKYKVEFAD

SEQ ID NO: 34955 - protein, 13 aa, Neisseria
LADKVREEQKAAQ

SEQ ID NO: 34956 - protein, 7 aa, Neisseria
LSALFSL

SEQ ID NO: 34957 - protein, 8 aa, Neisseria
GDALQNAA

SEQ ID NO: 34958 - protein, 12 aa, Neisseria
SRFAQKGSPVNK

SEQ ID NO: 34959 - protein, 5 aa, Neisseria
CSVER

SEQ ID NO: 34960 - protein, 11 aa, Neisseria
IIQGNELEPRA

SEQ ID NO: 34961 - protein, 8 aa, Neisseria
RPGMTKDQ

SEQ ID NO: 34962 - protein, 9 aa, Neisseria
AFHTDRWDY

SEQ ID NO: 34963 - protein, 15 aa, Neisseria
FNTSRNGIIKERSNL

SEQ ID NO: 34964 - protein, 24 aa, Neisseria
VRTEGDALQNAAEALRAKQNADKQ

SEQ ID NO: 34965 - protein, 8 aa, Neisseria
FAQKGSPV

SEQ ID NO: 34966 - protein, 7 aa, Neisseria
NELEPRA

SEQ ID NO: 34967 - protein, 6 aa, Neisseria
GMTKDQ

SEQ ID NO: 34968 - protein, 8 aa, Neisseria
GIIKERSN

SEQ ID NO: 34969 - protein, 24 aa, Neisseria
VRTEGDALQNAAEALRAKQNADKQ

SEQ ID NO: 34970 - protein, 9 aa, Neisseria
VLMAVLVAL

SEQ ID NO: 34971 - protein, 9 aa, Neisseria
LPAIPEMAQ

SEQ ID NO: 34972 - protein, 5 aa, Neisseria
RIESL

SEQ ID NO: 34973 - protein, 7 aa, Neisseria
FGQVAGG

SEQ ID NO: 34974 - protein, 5 aa, Neisseria
IKGRK

SEQ ID NO: 34975 - protein, 10 aa, Neisseria
LLNLRAVQAF

SEQ ID NO: 34976 - protein, 8 aa, Neisseria
FALIGIIL

SEQ ID NO: 34977 - protein, 19 aa, Neisseria
APMVGALLQGLGGWRAIFV

SEQ ID NO: 34978 - protein, 10 aa, Neisseria
PVLPGLVQYF

SEQ ID NO: 34979 - protein, 6 aa, Neisseria
KIGRDV

SEQ ID NO: 34980 - protein, 6 aa, Neisseria
RFKRVL

SEQ ID NO: 34981 - protein, 7 aa, Neisseria
SFGSMFA

SEQ ID NO: 34982 - protein, 5 aa, Neisseria
GIVVQ

SEQ ID NO: 34983 - protein, 12 aa, Neisseria
ANAVSGVFRSLI

SEQ ID NO: 34984 - protein, 10 aa, Neisseria
SPPLPPMSGK

SEQ ID NO: 34985 - protein, 7 aa, Neisseria
DIHRIES

SEQ ID NO: 34986 - protein, 9 aa, Neisseria
SDIKGRKPV

SEQ ID NO: 34987 - protein, 5 aa, Neisseria
SSTEQ

SEQ ID NO: 34988 - protein, 12 aa, Neisseria
MVRDYYSGRKAA

SEQ ID NO: 34989 - protein, 12 aa, Neisseria
NPAVGGKIGRDV

SEQ ID NO: 34990 - protein, 10 aa, Neisseria
RFKRVLKTRA

SEQ ID NO: 34991 - protein, 9 aa, Neisseria
LKTGAHPQS

SEQ ID NO: 34992 - protein, 8 aa, Neisseria
FKEEGGSA

SEQ ID NO: 34993 - protein, 12 aa, Neisseria
KAWKENEKKRIL

SEQ ID NO: 34994 - protein, 7 aa, Neisseria
DIHRIES

SEQ ID NO: 34995 - protein, 9 aa, Neisseria
SDIKGRKPV

SEQ ID NO: 34996 - protein, 8 aa, Neisseria
YYSGRKAA

SEQ ID NO: 34997 - protein, 6 aa, Neisseria
KIGRDV

SEQ ID NO: 34998 - protein, 10 aa, Neisseria
RFKRVLKTRA

SEQ ID NO: 34999 - protein, 7 aa, Neisseria
FKEEGGS

SEQ ID NO: 35000 - protein, 12 aa, Neisseria
KAWKENEKKRIL

SEQ ID NO: 35001 - protein, 5 aa, Neisseria
SSASS

SEQ ID NO: 35002 - protein, 9 aa, Neisseria
SAPDNVKQA

SEQ ID NO: 35003 - protein, 17 aa, Neisseria
HPAAGIGDLIQQIAEHI

SEQ ID NO: 35004 - protein, 8 aa, Neisseria
GYDNIQRL

SEQ ID NO: 35005 - protein, 11 aa, Neisseria
TRTISRQAQDA

SEQ ID NO: 35006 - protein, 7 aa, Neisseria
PKRARYF

SEQ ID NO: 35007 - protein, 19 aa, Neisseria
GNFQYIGQLPGYLKMHGEM

SEQ ID NO: 35008 - protein, 8 aa, Neisseria
MKNKTSSL

SEQ ID NO: 35009 - protein, 14 aa, Neisseria
RSPSKEDKTKENGA

SEQ ID NO: 35010 - protein, 15 aa, Neisseria
SSSASSASSQTDLQP

SEQ ID NO: 35011 - protein, 18 aa, Neisseria
SAPDNVKQAESAPLNCTG

SEQ ID NO: 35012 - protein, 8 aa, Neisseria
AEHIDSDC

SEQ ID NO: 35013 - protein, 7 aa, Neisseria
NELETRF

SEQ ID NO: 35014 - protein, 10 aa, Neisseria
LPGGGYDNIQ

SEQ ID NO: 35015 - protein, 12 aa, Neisseria
PDIRPEDPDYHQ

SEQ ID NO: 35016 - protein, 15 aa, Neisseria
EDLRYGTRTISRQAQ

SEQ ID NO: 35017 - protein, 13 aa, Neisseria
AIMEQERRLREAT

SEQ ID NO: 35018 - protein, 18 aa, Neisseria
QGSQKTRGQGEEPKRARY

SEQ ID NO: 35019 - protein, 12 aa, Neisseria
YLNRHNNGLGGN

SEQ ID NO: 35020 - protein, 11 aa, Neisseria
MHGEMLENQSL

SEQ ID NO: 35021 - protein, 14 aa, Neisseria
RLSNRERNPDKPFL

SEQ ID NO: 35022 - protein, 9 aa, Neisseria
HFDENGKIT

SEQ ID NO: 35023 - protein, 6 aa, Neisseria
VYEKNI

SEQ ID NO: 35024 - protein, 6 aa, Neisseria
MKNKTS

SEQ ID NO: 35025 - protein, 14 aa, Neisseria
RSPSKEDKTKENGA

SEQ ID NO: 35026 - protein, 11 aa, Neisseria
SASSASSQTDL

SEQ ID NO: 35027 - protein, 13 aa, Neisseria
SAPDNVKQAESAP

SEQ ID NO: 35028 - protein, 5 aa, Neisseria
EHIDS

SEQ ID NO: 35029 - protein, 5 aa, Neisseria
NELET

SEQ ID NO: 35030 - protein, 10 aa, Neisseria
IRPEDPDYHQ

SEQ ID NO: 35031 - protein, 7 aa, Neisseria
EDLRYGT

SEQ ID NO: 35032 - protein, 7 aa, Neisseria
TISRQAQ

SEQ ID NO: 35033 - protein, 13 aa, Neisseria
AIMEQERRLREAT

SEQ ID NO: 35034 - protein, 17 aa, Neisseria
GSQKTRGQGEEPKRARY

SEQ ID NO: 35035 - protein, 7 aa, Neisseria
MHGEMLE

SEQ ID NO: 35036 - protein, 12 aa, Neisseria
LSNRERNPDKPF

SEQ ID NO: 35037 - protein, 9 aa, Neisseria
HFDENGKIT

SEQ ID NO: 35038 - protein, 5 aa, Neisseria
KPAAS

SEQ ID NO: 35039 - protein, 9 aa, Neisseria
HNELRKIRA

SEQ ID NO: 35040 - protein, 5 aa, Neisseria
ARDYV

SEQ ID NO: 35041 - protein, 5 aa, Neisseria
CRFAK

SEQ ID NO: 35042 - protein, 29 aa, Neisseria
PPNDFQPNCDIRRLGLTQGQHNELRKIRA

SEQ ID NO: 35043 - protein, 12 aa, Neisseria
MAGDRARLKVMH

SEQ ID NO: 35044 - protein, 8 aa, Neisseria
EHSRRRSV

SEQ ID NO: 35045 - protein, 23 aa, Neisseria
ISSDVFNRNEARDYVESRYHSSM

SEQ ID NO: 35046 - protein, 8 aa, Neisseria
FAVDELEI

SEQ ID NO: 35047 - protein, 6 aa, Neisseria
TPQQQQ

SEQ ID NO: 35048 - protein, 5 aa, Neisseria
SSCLK

SEQ ID NO: 35049 - protein, 7 aa, Neisseria
CDIRRLG

SEQ ID NO: 35050 - protein, 10 aa, Neisseria
QHNELRKIRA

SEQ ID NO: 35051 - protein, 12 aa, Neisseria
MAGDRARLKVMH

SEQ ID NO: 35052 - protein, 8 aa, Neisseria
EHSRRRSV

SEQ ID NO: 35053 - protein, 12 aa, Neisseria
VFNRNEARDYVE

SEQ ID NO: 35054 - protein, 8 aa, Neisseria
FAVDELEI

SEQ ID NO: 35055 - protein, 13 aa, Neisseria
SESIRRIWRNGRE

SEQ ID NO: 35056 - protein, 6 aa, Neisseria
FVALEA

SEQ ID NO: 35057 - protein, 12 aa, Neisseria
LGYVFKPLAVFV

SEQ ID NO: 35058 - protein, 7 aa, Neisseria
QGFGQLH

SEQ ID NO: 35059 - protein, 9 aa, Neisseria
FDVFQVFRD

SEQ ID NO: 35060 - protein, 24 aa, Neisseria
CEVGRVVGRGYGAAVFDFFQRFQF

SEQ ID NO: 35061 - protein, 15 aa, Neisseria
IQSQRRGRHLEGFGD

SEQ ID NO: 35062 - protein, 10 aa, Neisseria
VGKFDQFDGV

SEQ ID NO: 35063 - protein, 7 aa, Neisseria
FDHIAEV

SEQ ID NO: 35064 - protein, 5 aa, Neisseria
GGRGC

SEQ ID NO: 35065 - protein, 34 aa, Neisseria
TRCRCSESIRRIWRNGREWRIKGQKCRLNTDAVQ

SEQ ID NO: 35066 - protein, 17 aa, Neisseria
GGFDGRPVDIGKARLLE

SEQ ID NO: 35067 - protein, 7 aa, Neisseria
AVDDGKI

SEQ ID NO: 35068 - protein, 10 aa, Neisseria
CGFKLDDFDV

SEQ ID NO: 35069 - protein, 11 aa, Neisseria
RDVGFGCGQRI

SEQ ID NO: 35070 - protein, 13 aa, Neisseria
GACEVGRVVGRGY

SEQ ID NO: 35071 - protein, 16 aa, Neisseria
RIQSQRRGRHLEGFGD

SEQ ID NO: 35072 - protein, 5 aa, Neisseria
EDVDV

SEQ ID NO: 35073 - protein, 8 aa, Neisseria
KFDQFDGV

SEQ ID NO: 35074 - protein, 11 aa, Neisseria
AHGRAEDDFFF

SEQ ID NO: 35075 - protein, 13 aa, Neisseria
VIGRRGGGRGCGR

SEQ ID NO: 35076 - protein, 16 aa, Neisseria
GCEDERECGGGKGFEE

SEQ ID NO: 35077 - protein, 30 aa, Neisseria
TRCRCSESIRRIWRNGREWRIKGQKCRLNT

SEQ ID NO: 35078 - protein, 15 aa, Neisseria
FDGRPVDIGKARLLE

SEQ ID NO: 35079 - protein, 7 aa, Neisseria
AVDDGKI

SEQ ID NO: 35080 - protein, 6 aa, Neisseria
KLDDFD

SEQ ID NO: 35081 - protein, 8 aa, Neisseria
CEVGRVVG

SEQ ID NO: 35082 - protein, 13 aa, Neisseria
QSQRRGRHLEGFG

SEQ ID NO: 35083 - protein, 5 aa, Neisseria
EDVDV

SEQ ID NO: 35084 - protein, 11 aa, Neisseria
AHGRAEDDFFF

SEQ ID NO: 35085 - protein, 12 aa, Neisseria
VIGRRGGGRGCG

SEQ ID NO: 35086 - protein, 10 aa, Neisseria
GCEDERECGG

SEQ ID NO: 35087 - protein, 5 aa, Neisseria
KGFEE

SEQ ID NO: 35088 - protein, 6 aa, Neisseria
LTPAST

SEQ ID NO: 35089 - protein, 6 aa, Neisseria
RGRACR

SEQ ID NO: 35090 - protein, 6 aa, Neisseria
QVGRVV

SEQ ID NO: 35091 - protein, 6 aa, Neisseria
CRHFAQ

SEQ ID NO: 35092 - protein, 7 aa, Neisseria
VAVGRIG

SEQ ID NO: 35093 - protein, 9 aa, Neisseria
RRIADVFLV

SEQ ID NO: 35094 - protein, 6 aa, Neisseria
IADIGE

SEQ ID NO: 35095 - protein, 14 aa, Neisseria
RGLADIGEFVGVSD

SEQ ID NO: 35096 - protein, 9 aa, Neisseria
FDQKHFARC

SEQ ID NO: 35097 - protein, 8 aa, Neisseria
HQRASRIK

SEQ ID NO: 35098 - protein, 11 aa, Neisseria
RARRHFRQVFD

SEQ ID NO: 35099 - protein, 6 aa, Neisseria
DFVAHI

SEQ ID NO: 35100 - protein, 8 aa, Neisseria
AARIGKDD

SEQ ID NO: 35101 - protein, 7 aa, Neisseria
GQDEHDA

SEQ ID NO: 35102 - protein, 7 aa, Neisseria
PPFAHGF

SEQ ID NO: 35103 - protein, 8 aa, Neisseria
PPSAYGCQ

SEQ ID NO: 35104 - protein, 13 aa, Neisseria
PHQHFGRGRACRY

SEQ ID NO: 35105 - protein, 5 aa, Neisseria
FKPRA

SEQ ID NO: 35106 - protein, 9 aa, Neisseria
RIDSARCRH

SEQ ID NO: 35107 - protein, 11 aa, Neisseria
GRIGRTDHNHD

SEQ ID NO: 35108 - protein, 13 aa, Neisseria
LFDGGLPVGRRIA

SEQ ID NO: 35109 - protein, 13 aa, Neisseria
ADIGETRVQRGDD

SEQ ID NO: 35110 - protein, 9 aa, Neisseria
IDRERGLAD

SEQ ID NO: 35111 - protein, 12 aa, Neisseria
HISDRFDQKHFA

SEQ ID NO: 35112 - protein, 9 aa, Neisseria
CKLPHRAFD

SEQ ID NO: 35113 - protein, 10 aa, Neisseria
PLMPDHDDFT

SEQ ID NO: 35114 - protein, 15 aa, Neisseria
RHQRASRIKYPETAL

SEQ ID NO: 35115 - protein, 11 aa, Neisseria
RINQCRARRHF

SEQ ID NO: 35116 - protein, 6 aa, Neisseria
VFDKHR

SEQ ID NO: 35117 - protein, 7 aa, Neisseria
INRRAEF

SEQ ID NO: 35118 - protein, 25 aa, Neisseria
TFDNTDCPIHTGAEAARIGKDDGFS

SEQ ID NO: 35119 - protein, 5 aa, Neisseria
PCSDG

SEQ ID NO: 35120 - protein, 17 aa, Neisseria
LCDGRYCQAPPTPHRRR

SEQ ID NO: 35121 - protein, 7 aa, Neisseria
GQDEHDA

SEQ ID NO: 35122 - protein, 7 aa, Neisseria
GRGRACR

SEQ ID NO: 35123 - protein, 5 aa, Neisseria
FKPRA

SEQ ID NO: 35124 - protein, 9 aa, Neisseria
RIDSARCRH

SEQ ID NO: 35125 - protein, 9 aa, Neisseria
RIGRTDHNH

SEQ ID NO: 35126 - protein, 6 aa, Neisseria
VGRRIA

SEQ ID NO: 35127 - protein, 13 aa, Neisseria
ADIGETRVQRGDD

SEQ ID NO: 35128 - protein, 9 aa, Neisseria
IDRERGLAD

SEQ ID NO: 35129 - protein, 12 aa, Neisseria
HISDRFDQKHFA

SEQ ID NO: 35130 - protein, 8 aa, Neisseria
CKLPHRAF

SEQ ID NO: 35131 - protein, 5 aa, Neisseria
PDHDD

SEQ ID NO: 35132 - protein, 15 aa, Neisseria
RHQRASRIKYPETAL

SEQ ID NO: 35133 - protein, 9 aa, Neisseria
NQCRARRHF

SEQ ID NO: 35134 - protein, 6 aa, Neisseria
VFDKHR

SEQ ID NO: 35135 - protein, 7 aa, Neisseria
INRRAEF

SEQ ID NO: 35136 - protein, 5 aa, Neisseria
FDNTD

SEQ ID NO: 35137 - protein, 13 aa, Neisseria
AEAARIGKDDGFS

SEQ ID NO: 35138 - protein, 6 aa, Neisseria
TPHRRR

SEQ ID NO: 35139 - protein, 5 aa, Neisseria
QNSQR

SEQ ID NO: 35140 - protein, 12 aa, Neisseria
SKPAERYADCPH

SEQ ID NO: 35141 - protein, 7 aa, Neisseria
ASCASVL

SEQ ID NO: 35142 - protein, 7 aa, Neisseria
VRLSNEV

SEQ ID NO: 35143 - protein, 5 aa, Neisseria
VQKLD

SEQ ID NO: 35144 - protein, 18 aa, Neisseria
VETAQNLYNQALKHYQNG

SEQ ID NO: 35145 - protein, 7 aa, Neisseria
CESVIEI

SEQ ID NO: 35146 - protein, 8 aa, Neisseria
YANRFKDS

SEQ ID NO: 35147 - protein, 14 aa, Neisseria
ARATWRSLIQTYPG

SEQ ID NO: 35148 - protein, 28 aa, Neisseria
LPQTRPARRHHRHRQYFVERKGDARSGF

SEQ ID NO: 35149 - protein, 40 aa, Neisseria
QCQNSQRFQSKPAERYADCPHHPARRRRFDPASEKIMKTK

SEQ ID NO: 35150 - protein, 22 aa, Neisseria
PVPEGSRTEMPTQENASDGIPY

SEQ ID NO: 35151 - protein, 9 aa, Neisseria
LQDRLDYLE

SEQ ID NO: 35152 - protein, 42 aa, Neisseria
KIVRLSNEVEMLNGKVKALEHTKIHPSGRTYVQKLDDRKLKE

SEQ ID NO: 35153 - protein, 9 aa, Neisseria
YLNTEGGSA

SEQ ID NO: 35154 - protein, 9 aa, Neisseria
ALKHYQNGR

SEQ ID NO: 35155 - protein, 14 aa, Neisseria
LKGADGGDGGSIAQ

SEQ ID NO: 35156 - protein, 9 aa, Neisseria
QSRARMGNC

SEQ ID NO: 35157 - protein, 15 aa, Neisseria
IGGRYANRFKDSPTA

SEQ ID NO: 35158 - protein, 5 aa, Neisseria
GECQY

SEQ ID NO: 35159 - protein, 7 aa, Neisseria
LQQKDIA

SEQ ID NO: 35160 - protein, 17 aa, Neisseria
YPGSPAAKRAAAAVRKR

SEQ ID NO: 35161 - protein, 13 aa, Neisseria
PQTRPARRHHRHR

SEQ ID NO: 35162 - protein, 10 aa, Neisseria
FVERKGDARS

SEQ ID NO: 35163 - protein, 15 aa, Neisseria
NSQRFQSKPAERYAD

SEQ ID NO: 35164 - protein, 21 aa, Neisseria
PHHPARRRRFDPASEKIMKTK

SEQ ID NO: 35165 - protein, 16 aa, Neisseria
PEGSRTEMPTQENASD

SEQ ID NO: 35166 - protein, 9 aa, Neisseria
LQDRLDYLE

SEQ ID NO: 35167 - protein, 28 aa, Neisseria
KIVRLSNEVEMLNGKVKALEHTKIHPSG

SEQ ID NO: 35168 - protein, 12 aa, Neisseria
YVQKLDDRKLKE

SEQ ID NO: 35169 - protein, 13 aa, Neisseria
KGADGGDGGSIAQ

SEQ ID NO: 35170 - protein, 7 aa, Neisseria
SRARMGN

SEQ ID NO: 35171 - protein, 11 aa, Neisseria
YANRFKDSPTA

SEQ ID NO: 35172 - protein, 5 aa, Neisseria
GECQY

SEQ ID NO: 35173 - protein, 7 aa, Neisseria
LQQKDIA

SEQ ID NO: 35174 - protein, 13 aa, Neisseria
PAAKRAAAAVRKR

SEQ ID NO: 35175 - protein, 19 aa, Neisseria
TLFSVLVPMFAGFFIRVPK

SEQ ID NO: 35176 - protein, 8 aa, Neisseria
RVEDLGSR

SEQ ID NO: 35177 - protein, 8 aa, Neisseria
ALAVLGKL

SEQ ID NO: 35178 - protein, 8 aa, Neisseria
GVSWTKGL

SEQ ID NO: 35179 - protein, 8 aa, Neisseria
WYSLSGLV

SEQ ID NO: 35180 - protein, 5 aa, Neisseria
YGAVW

SEQ ID NO: 35181 - protein, 6 aa, Neisseria
DLAREL

SEQ ID NO: 35182 - protein, 5 aa, Neisseria
GAGGL

SEQ ID NO: 35183 - protein, 13 aa, Neisseria
RVPKPYLPASDKV

SEQ ID NO: 35184 - protein, 12 aa, Neisseria
SRVEDLGSRLGD

SEQ ID NO: 35185 - protein, 12 aa, Neisseria
SPWRIGGKGKGV

SEQ ID NO: 35186 - protein, 6 aa, Neisseria
VSGSVR

SEQ ID NO: 35187 - protein, 6 aa, Neisseria
VSGKLM

SEQ ID NO: 35188 - protein, 8 aa, Neisseria
MPSENAGM

SEQ ID NO: 35189 - protein, 8 aa, Neisseria
LKSSGVSL

SEQ ID NO: 35190 - protein, 9 aa, Neisseria
LLNRRGIRL

SEQ ID NO: 35191 - protein, 5 aa, Neisseria
RFPDA

SEQ ID NO: 35192 - protein, 5 aa, Neisseria
GAGGL

SEQ ID NO: 35193 - protein, 5 aa, Neisseria
ASDKV

SEQ ID NO: 35194 - protein, 12 aa, Neisseria
SRVEDLGSRLGD

SEQ ID NO: 35195 - protein, 8 aa, Neisseria
IGGKGKGV

SEQ ID NO: 35196 - protein, 7 aa, Neisseria
LKSSGVS

SEQ ID NO: 35197 - protein, 8 aa, Neisseria
LLNRRGIR

SEQ ID NO: 35198 - protein, 5 aa, Neisseria
FQVAG

SEQ ID NO: 35199 - protein, 5 aa, Neisseria
CLETS

SEQ ID NO: 35200 - protein, 13 aa, Neisseria
PNSFAGFKRFSSI

SEQ ID NO: 35201 - protein, 6 aa, Neisseria
GPAPAM

SEQ ID NO: 35202 - protein, 6 aa, Neisseria
RAISSL

SEQ ID NO: 35203 - protein, 10 aa, Neisseria
AQSTPSSPTM

SEQ ID NO: 35204 - protein, 10 aa, Neisseria
TCLETSPEAG

SEQ ID NO: 35205 - protein, 5 aa, Neisseria
KRFSS

SEQ ID NO: 35206 - protein, 10 aa, Neisseria
NKADIPTGPA

SEQ ID NO: 35207 - protein, 9 aa, Neisseria
GKASLNSRA

SEQ ID NO: 35208 - protein, 7 aa, Neisseria
SCGGTRL

SEQ ID NO: 35209 - protein, 7 aa, Neisseria
NKADIPT

SEQ ID NO: 35210 - protein, 9 aa, Neisseria
CSGLVTVPA

SEQ ID NO: 35211 - protein, 11 aa, Neisseria
ASSPTGVRKVI

SEQ ID NO: 35212 - protein, 8 aa, Neisseria
MPCSKASW

SEQ ID NO: 35213 - protein, 5 aa, Neisseria
SPGVA

SEQ ID NO: 35214 - protein, 11 aa, Neisseria
ALARDSCKPGL

SEQ ID NO: 35215 - protein, 6 aa, Neisseria
TAPASS

SEQ ID NO: 35216 - protein, 17 aa, Neisseria
AIRRMASSPTGVRKVIS

SEQ ID NO: 35217 - protein, 14 aa, Neisseria
GMPPSTRARDKSTA

SEQ ID NO: 35218 - protein, 7 aa, Neisseria
RISRGVS

SEQ ID NO: 35219 - protein, 8 aa, Neisseria
ALARDSCK

SEQ ID NO: 35220 - protein, 7 aa, Neisseria
AIRRMAS

SEQ ID NO: 35221 - protein, 8 aa, Neisseria
TGVRKVIS

SEQ ID NO: 35222 - protein, 11 aa, Neisseria
PSTRARDKSTA

SEQ ID NO: 35223 - protein, 7 aa, Neisseria
RISRGVS

SEQ ID NO: 35224 - protein, 8 aa, Neisseria
QTLATVNG

SEQ ID NO: 35225 - protein, 10 aa, Neisseria
EVVNTVVAQE

SEQ ID NO: 35226 - protein, 6 aa, Neisseria
LDRSAE

SEQ ID NO: 35227 - protein, 16 aa, Neisseria
QEVKAVYDNISGFYKG

SEQ ID NO: 35228 - protein, 5 aa, Neisseria
FDAVL

SEQ ID NO: 35229 - protein, 22 aa, Neisseria
VPLKDLEQGVPPLYQAIKDLKK

SEQ ID NO: 35230 - protein, 5 aa, Neisseria
VPSFD

SEQ ID NO: 35231 - protein, 7 aa, Neisseria
RIDRAVC

SEQ ID NO: 35232 - protein, 5 aa, Neisseria
MKAKI

SEQ ID NO: 35233 - protein, 10 aa, Neisseria
VNGQKIDSSV

SEQ ID NO: 35234 - protein, 15 aa, Neisseria
FRAENSRAEDTPQLR

SEQ ID NO: 35235 - protein, 38 aa, Neisseria
QEVKRLKLDRSAEFKDALAKLRAEAKKSGDDKKPSFKT

SEQ ID NO: 35236 - protein, 14 aa, Neisseria
KTQPVSEQEVKAVY

SEQ ID NO: 35237 - protein, 14 aa, Neisseria
NISGFYKGTQEVQL

SEQ ID NO: 35238 - protein, 22 aa, Neisseria
ILTDKEENAKKAVADLKAKKGF

SEQ ID NO: 35239 - protein, 18 aa, Neisseria
YSLNDRTKRTGAPDGYVP

SEQ ID NO: 35240 - protein, 9 aa, Neisseria
KDLEQGVPP

SEQ ID NO: 35241 - protein, 18 aa, Neisseria
KDLKKGEFTATPLKNGDF

SEQ ID NO: 35242 - protein, 18 aa, Neisseria
YVNDSREVKVPSFDEMKG

SEQ ID NO: 35243 - protein, 10 aa, Neisseria
LQAERIDRAV

SEQ ID NO: 35244 - protein, 7 aa, Neisseria
ANIKPAK

SEQ ID NO: 35245 - protein, 5 aa, Neisseria
MKAKI

SEQ ID NO: 35246 - protein, 7 aa, Neisseria
QKIDSSV

SEQ ID NO: 35247 - protein, 15 aa, Neisseria
FRAENSRAEDTPQLR

SEQ ID NO: 35248 - protein, 36 aa, Neisseria
QEVKRLKLDRSAEFKDALAKLRAEAKKSGDDKKPSF

SEQ ID NO: 35249 - protein, 12 aa, Neisseria
QPVSEQEVKAVY

SEQ ID NO: 35250 - protein, 22 aa, Neisseria
ILTDKEENAKKAVADLKAKKGF

SEQ ID NO: 35251 - protein, 11 aa, Neisseria
SLNDRTKRTGA

SEQ ID NO: 35252 - protein, 5 aa, Neisseria
KDLEQ

SEQ ID NO: 35253 - protein, 8 aa, Neisseria
KDLKKGEF

SEQ ID NO: 35254 - protein, 16 aa, Neisseria
NDSREVKVPSFDEMKG

SEQ ID NO: 35255 - protein, 10 aa, Neisseria
LQAERIDRAV

SEQ ID NO: 35256 - protein, 7 aa, Neisseria
ANIKPAK

SEQ ID NO: 35257 - protein, 12 aa, Neisseria
AVAQSIIDSGLG

SEQ ID NO: 35258 - protein, 23 aa, Neisseria
QEILDQIRLYDLPEVQSDFVETH

SEQ ID NO: 35259 - protein, 5 aa, Neisseria
LGMMQ

SEQ ID NO: 35260 - protein, 14 aa, Neisseria
LQILHWGGFLMVLP

SEQ ID NO: 35261 - protein, 8 aa, Neisseria
QGALRDLK

SEQ ID NO: 35262 - protein, 12 aa, Neisseria
AIIMTFIAGIYS

SEQ ID NO: 35263 - protein, 7 aa, Neisseria
FMEHIAR

SEQ ID NO: 35264 - protein, 27 aa, Neisseria
AGDAAERLVKLIPAFCHRMPGYPAVQD

SEQ ID NO: 35265 - protein, 6 aa, Neisseria
RESAVV

SEQ ID NO: 35266 - protein, 17 aa, Neisseria
GGTRLSHIVRLLDRALA

SEQ ID NO: 35267 - protein, 6 aa, Neisseria
ELAEQY

SEQ ID NO: 35268 - protein, 7 aa, Neisseria
AIETLSQ

SEQ ID NO: 35269 - protein, 7 aa, Neisseria
IELLGSM

SEQ ID NO: 35270 - protein, 11 aa, Neisseria
QRLNRIGEGVG

SEQ ID NO: 35271 - protein, 13 aa, Neisseria
LKDSAAEAVRQLA

SEQ ID NO: 35272 - protein, 8 aa, Neisseria
ETARALGI

SEQ ID NO: 35273 - protein, 9 aa, Neisseria
EYVEALQKE

SEQ ID NO: 35274 - protein, 10 aa, Neisseria
DLRTVAHLLD

SEQ ID NO: 35275 - protein, 12 aa, Neisseria
AVLGYVQPWIAA

SEQ ID NO: 35276 - protein, 5 aa, Neisseria
LAVLG

SEQ ID NO: 35277 - protein, 5 aa, Neisseria
MKKTC

SEQ ID NO: 35278 - protein, 7 aa, Neisseria
GLDVPEN

SEQ ID NO: 35279 - protein, 14 aa, Neisseria
VRYEGEDRETCCVG

SEQ ID NO: 35280 - protein, 28 aa, Neisseria
IDSGLGSYYKRRTADAKKTELPPQEILD

SEQ ID NO: 35281 - protein, 15 aa, Neisseria
PEVQSDFVETHNGTH

SEQ ID NO: 35282 - protein, 9 aa, Neisseria
QLLRTDGIV

SEQ ID NO: 35283 - protein, 8 aa, Neisseria
LNYSTHRC

SEQ ID NO: 35284 - protein, 10 aa, Neisseria
VVWDDGKIRL

SEQ ID NO: 35285 - protein, 6 aa, Neisseria
IRQTGY

SEQ ID NO: 35286 - protein, 18 aa, Neisseria
PYDAQKIEAANQKERKQY

SEQ ID NO: 35287 - protein, 9 aa, Neisseria
YGGDIEPDF

SEQ ID NO: 35288 - protein, 15 aa, Neisseria
ALRDLKNRRAGMDTP

SEQ ID NO: 35289 - protein, 14 aa, Neisseria
IARRKAGDAAERLV

SEQ ID NO: 35290 - protein, 5 aa, Neisseria
RMPGY

SEQ ID NO: 35291 - protein, 8 aa, Neisseria
QDVRESAV

SEQ ID NO: 35292 - protein, 12 aa, Neisseria
KPGETIPVDGTV

SEQ ID NO: 35293 - protein, 9 aa, Neisseria
EGNSAVNES

SEQ ID NO: 35294 - protein, 5 aa, Neisseria
LTGES

SEQ ID NO: 35295 - protein, 9 aa, Neisseria
KMPSEKVTA

SEQ ID NO: 35296 - protein, 11 aa, Neisseria
IRTDRTGGGTR

SEQ ID NO: 35297 - protein, 13 aa, Neisseria
ALAQKPRTAELAE

SEQ ID NO: 35298 - protein, 7 aa, Neisseria
TLAREGI

SEQ ID NO: 35299 - protein, 6 aa, Neisseria
GGKQAI

SEQ ID NO: 35300 - protein, 20 aa, Neisseria
IFDKTGTLTQGNPAVRRIEL

SEQ ID NO: 35301 - protein, 10 aa, Neisseria
SLEQQSEHPL

SEQ ID NO: 35302 - protein, 8 aa, Neisseria
RISGGSVP

SEQ ID NO: 35303 - protein, 13 aa, Neisseria
QVGQRLNRIGEGV

SEQ ID NO: 35304 - protein, 5 aa, Neisseria
VNGET

SEQ ID NO: 35305 - protein, 15 aa, Neisseria
AEISGKEPQTEGGGS

SEQ ID NO: 35306 - protein, 14 aa, Neisseria
LQDPLKDSAAEAVR

SEQ ID NO: 35307 - protein, 6 aa, Neisseria
LAGKNL

SEQ ID NO: 35308 - protein, 15 aa, Neisseria
ILSGDREEAVAETAR

SEQ ID NO: 35309 - protein, 9 aa, Neisseria
AMPEDKLEY

SEQ ID NO: 35310 - protein, 9 aa, Neisseria
EALQKEGKK

SEQ ID NO: 35311 - protein, 7 aa, Neisseria
GDGINDA

SEQ ID NO: 35312 - protein, 11 aa, Neisseria
GGTDIARDGAD

SEQ ID NO: 35313 - protein, 5 aa, Neisseria
EDLRT

SEQ ID NO: 35314 - protein, 10 aa, Neisseria
DQARRTRHII

SEQ ID NO: 35315 - protein, 12 aa, Neisseria
RLHKRGEMPSEQ

SEQ ID NO: 35316 - protein, 5 aa, Neisseria
MKKTC

SEQ ID NO: 35317 - protein, 9 aa, Neisseria
YEGEDRETC

SEQ ID NO: 35318 - protein, 15 aa, Neisseria
YKRRTADAKKTELPP

SEQ ID NO: 35319 - protein, 9 aa, Neisseria
PEVQSDFVE

SEQ ID NO: 35320 - protein, 5 aa, Neisseria
HNGTH

SEQ ID NO: 35321 - protein, 9 aa, Neisseria
QLLRTDGIV

SEQ ID NO: 35322 - protein, 10 aa, Neisseria
VVWDDGKIRL

SEQ ID NO: 35323 - protein, 16 aa, Neisseria
DAQKIEAANQKERKQY

SEQ ID NO: 35324 - protein, 7 aa, Neisseria
GDIEPDF

SEQ ID NO: 35325 - protein, 12 aa, Neisseria
ALRDLKNRRAGM

SEQ ID NO: 35326 - protein, 14 aa, Neisseria
IARRKAGDAAERLV

SEQ ID NO: 35327 - protein, 8 aa, Neisseria
QDVRESAV

SEQ ID NO: 35328 - protein, 7 aa, Neisseria
MPSEKVT

SEQ ID NO: 35329 - protein, 11 aa, Neisseria
IRTDRTGGGTR

SEQ ID NO: 35330 - protein, 13 aa, Neisseria
ALAQKPRTAELAE

SEQ ID NO: 35331 - protein, 7 aa, Neisseria
TLAREGI

SEQ ID NO: 35332 - protein, 8 aa, Neisseria
PAVRRIEL

SEQ ID NO: 35333 - protein, 9 aa, Neisseria
LEQQSEHPL

SEQ ID NO: 35334 - protein, 8 aa, Neisseria
QRLNRIGE

SEQ ID NO: 35335 - protein, 12 aa, Neisseria
ISGKEPQTEGGG

SEQ ID NO: 35336 - protein, 12 aa, Neisseria
DPLKDSAAEAVR

SEQ ID NO: 35337 - protein, 13 aa, Neisseria
SGDREEAVAETAR

SEQ ID NO: 35338 - protein, 9 aa, Neisseria
AMPEDKLEY

SEQ ID NO: 35339 - protein, 9 aa, Neisseria
EALQKEGKK

SEQ ID NO: 35340 - protein, 8 aa, Neisseria
DIARDGAD

SEQ ID NO: 35341 - protein, 5 aa, Neisseria
EDLRT

SEQ ID NO: 35342 - protein, 10 aa, Neisseria
DQARRTRHII

SEQ ID NO: 35343 - protein, 12 aa, Neisseria
RLHKRGEMPSEQ

SEQ ID NO: 35344 - protein, 6 aa, Neisseria
KCLLKL

SEQ ID NO: 35345 - protein, 5 aa, Neisseria
NPIPA

SEQ ID NO: 35346 - protein, 12 aa, Neisseria
YMQTFRRIVAPQ

SEQ ID NO: 35347 - protein, 9 aa, Neisseria
NEFIGLFKN

SEQ ID NO: 35348 - protein, 12 aa, Neisseria
VVTVTELFRVAQ

SEQ ID NO: 35349 - protein, 5 aa, Neisseria
TANRT

SEQ ID NO: 35350 - protein, 7 aa, Neisseria
TETRADM

SEQ ID NO: 35351 - protein, 7 aa, Neisseria
VPKGQWE

SEQ ID NO: 35352 - protein, 6 aa, Neisseria
PPLSNE

SEQ ID NO: 35353 - protein, 10 aa, Neisseria
AQETANRTYD

SEQ ID NO: 35354 - protein, 12 aa, Neisseria
ARLEKRFDRYVA

SEQ ID NO: 35355 - protein, 7 aa, Neisseria
TETRADM

SEQ ID NO: 35356 - protein, 8 aa, Neisseria
AQETANRT

SEQ ID NO: 35357 - protein, 12 aa, Neisseria
ARLEKRFDRYVA

SEQ ID NO: 35358 - protein, 7 aa, Neisseria
GRWLNSY

SEQ ID NO: 35359 - protein, 7 aa, Neisseria
RLIHAVR

SEQ ID NO: 35360 - protein, 8 aa, Neisseria
TALARLLH

SEQ ID NO: 35361 - protein, 15 aa, Neisseria
IYSNAVERMLGTVIG

SEQ ID NO: 35362 - protein, 10 aa, Neisseria
TASALAGWAA

SEQ ID NO: 35363 - protein, 6 aa, Neisseria
RAMNVL

SEQ ID NO: 35364 - protein, 19 aa, Neisseria
LADNLADCSKMIAEISNGR

SEQ ID NO: 35365 - protein, 14 aa, Neisseria
SMMEAMQHAHRKIV

SEQ ID NO: 35366 - protein, 7 aa, Neisseria
ALAEHLH

SEQ ID NO: 35367 - protein, 25 aa, Neisseria
MNSSQRKRLSGRWLNSYERYRHRRL

SEQ ID NO: 35368 - protein, 5 aa, Neisseria
RLGGT

SEQ ID NO: 35369 - protein, 9 aa, Neisseria
YSNAVERML

SEQ ID NO: 35370 - protein, 7 aa, Neisseria
HYFHGNL

SEQ ID NO: 35371 - protein, 6 aa, Neisseria
GKNGYV

SEQ ID NO: 35372 - protein, 9 aa, Neisseria
GDNGSEWLD

SEQ ID NO: 35373 - protein, 34 aa, Neisseria
NLADCSKMIAEISNGRRMTRERLEQNMVKMRQIN

SEQ ID NO: 35374 - protein, 22 aa, Neisseria
RMVKSRSHLAATSGESRISPSM

SEQ ID NO: 35375 - protein, 7 aa, Neisseria
AHRKIVN

SEQ ID NO: 35376 - protein, 16 aa, Neisseria
KLQSPKLNGSEIRLLD

SEQ ID NO: 35377 - protein, 5 aa, Neisseria
TDLQQ

SEQ ID NO: 35378 - protein, 21 aa, Neisseria
GRHARRIRIDTAINPELEALA

SEQ ID NO: 35379 - protein, 8 aa, Neisseria
STNMRQEI

SEQ ID NO: 35380 - protein, 16 aa, Neisseria
QRTRRKWLDAHERQHL

SEQ ID NO: 35381 - protein, 9 aa, Neisseria
SLLETREHG

SEQ ID NO: 35382 - protein, 8 aa, Neisseria
SSQRKRLS

SEQ ID NO: 35383 - protein, 9 aa, Neisseria
YERYRHRRL

SEQ ID NO: 35384 - protein, 6 aa, Neisseria
AVERML

SEQ ID NO: 35385 - protein, 6 aa, Neisseria
NGSEWL

SEQ ID NO: 35386 - protein, 10 aa, Neisseria
NLADCSKMIA

SEQ ID NO: 35387 - protein, 22 aa, Neisseria
SNGRRMTRERLEQNMVKMRQIN

SEQ ID NO: 35388 - protein, 8 aa, Neisseria
RMVKSRSH

SEQ ID NO: 35389 - protein, 8 aa, Neisseria
TSGESRIS

SEQ ID NO: 35390 - protein, 7 aa, Neisseria
AHRKIVN

SEQ ID NO: 35391 - protein, 16 aa, Neisseria
KLQSPKLNGSEIRLLD

SEQ ID NO: 35392 - protein, 8 aa, Neisseria
RHARRIRI

SEQ ID NO: 35393 - protein, 7 aa, Neisseria
PELEALA

SEQ ID NO: 35394 - protein, 6 aa, Neisseria
NMRQEI

SEQ ID NO: 35395 - protein, 16 aa, Neisseria
QRTRRKWLDAHERQHL

SEQ ID NO: 35396 - protein, 9 aa, Neisseria
SLLETREHG

SEQ ID NO: 35397 - protein, 8 aa, Neisseria
GIEKMATQ

SEQ ID NO: 35398 - protein, 11 aa, Neisseria
HAGDINQIMSL

SEQ ID NO: 35399 - protein, 5 aa, Neisseria
ILAAP

SEQ ID NO: 35400 - protein, 9 aa, Neisseria
PGYLRSIRI

SEQ ID NO: 35401 - protein, 7 aa, Neisseria
DLLNLRD

SEQ ID NO: 35402 - protein, 5 aa, Neisseria
LKCLP

SEQ ID NO: 35403 - protein, 8 aa, Neisseria
VQWRRLLP

SEQ ID NO: 35404 - protein, 5 aa, Neisseria
SDMFY

SEQ ID NO: 35405 - protein, 6 aa, Neisseria
GRSIGG

SEQ ID NO: 35406 - protein, 14 aa, Neisseria
RYHQAVSGLSEVYD

SEQ ID NO: 35407 - protein, 7 aa, Neisseria
WLAELSH

SEQ ID NO: 35408 - protein, 17 aa, Neisseria
TGMKDALRAPEEAFGEG

SEQ ID NO: 35409 - protein, 6 aa, Neisseria
HAQWNK

SEQ ID NO: 35410 - protein, 7 aa, Neisseria
LKKPEYF

SEQ ID NO: 35411 - protein, 41 aa, Neisseria
EAVSQQQDILQRQREKQLREQMQPEQDVRLDGTDTGIEKMA

SEQ ID NO: 35412 - protein, 12 aa, Neisseria
VGGANSDEASPC

SEQ ID NO: 35413 - protein, 9 aa, Neisseria
ELVGEEAAK

SEQ ID NO: 35414 - protein, 9 aa, Neisseria
PQDLNSGKL

SEQ ID NO: 35415 - protein, 12 aa, Neisseria
IRIDRSNDDQTH

SEQ ID NO: 35416 - protein, 12 aa, Neisseria
NKFPTRSNDLLN

SEQ ID NO: 35417 - protein, 9 aa, Neisseria
RDLEQGLEN

SEQ ID NO: 35418 - protein, 5 aa, Neisseria
AEADL

SEQ ID NO: 35419 - protein, 10 aa, Neisseria
PVEREPNQSD

SEQ ID NO: 35420 - protein, 15 aa, Neisseria
GMDNSGSEATGKYQG

SEQ ID NO: 35421 - protein, 7 aa, Neisseria
ADNPFGL

SEQ ID NO: 35422 - protein, 24 aa, Neisseria
YGRSIGGTPDEENFDGHRKEGGSN

SEQ ID NO: 35423 - protein, 5 aa, Neisseria
HNGYR

SEQ ID NO: 35424 - protein, 16 aa, Neisseria
EVYDYNGKSYNTDFGF

SEQ ID NO: 35425 - protein, 11 aa, Neisseria
LYRDAKRKTYL

SEQ ID NO: 35426 - protein, 22 aa, Neisseria
WTRETKSYIDDAELTVQRRKTT

SEQ ID NO: 35427 - protein, 41 aa, Neisseria
LSHKGYIGRSTADFKLKYKHGTGMKDALRAPEEAFGEGTSR

SEQ ID NO: 35428 - protein, 7 aa, Neisseria
SADVNTP

SEQ ID NO: 35429 - protein, 14 aa, Neisseria
QWNKTPLTSQDKLA

SEQ ID NO: 35430 - protein, 32 aa, Neisseria
HTVRGFDGEMSLPAERGWYWRNDLSWQFKPGH

SEQ ID NO: 35431 - protein, 6 aa, Neisseria
SGQSAK

SEQ ID NO: 35432 - protein, 16 aa, Neisseria
RALKKPEYFQTKKWVT

SEQ ID NO: 35433 - protein, 41 aa, Neisseria; identical to SEQ ID NO: 35411

SEQ ID NO: 35434 - protein, 7 aa, Neisseria
ANSDEAS

SEQ ID NO: 35435 - protein, 9 aa, Neisseria
ELVGEEAAK

SEQ ID NO: 35436 - protein, 7 aa, Neisseria
QDLNSGK

SEQ ID NO: 35437 - protein, 12 aa, Neisseria
IRIDRSNDDQTH

SEQ ID NO: 35438 - protein, 7 aa, Neisseria
FPTRSND

SEQ ID NO: 35439 - protein, 9 aa, Neisseria
RDLEQGLEN

SEQ ID NO: 35440 - protein, 5 aa, Neisseria
AEADL

SEQ ID NO: 35441 - protein, 9 aa, Neisseria
PVEREPNQS

SEQ ID NO: 35442 - protein, 12 aa, Neisseria
MDNSGSEATGKY

SEQ ID NO: 35443 - protein, 19 aa, Neisseria
IGGTPDEENFDGHRKEGGS

SEQ ID NO: 35444 - protein, 5 aa, Neisseria
YDYNG

SEQ ID NO: 35445 - protein, 11 aa, Neisseria
LYRDAKRKTYL

SEQ ID NO: 35446 - protein, 22 aa, Neisseria
WTRETKSYIDDAELTVQRRKTT

SEQ ID NO: 35447 - protein, 11 aa, Neisseria
STADFKLKYKH

SEQ ID NO: 35448 - protein, 15 aa, Neisseria
TGMKDALRAPEEAFG

SEQ ID NO: 35449 - protein, 9 aa, Neisseria
PLTSQDKLA

SEQ ID NO: 35450 - protein, 7 aa, Neisseria
RGFDGEM

SEQ ID NO: 35451 - protein, 10 aa, Neisseria
RALKKPEYFQ

SEQ ID NO: 35452 - protein, 13 aa, Neisseria
PSRAEKANQVSNI

SEQ ID NO: 35453 - protein, 12 aa, Neisseria
TASIEDALKSNP

SEQ ID NO: 35454 - protein, 6 aa, Neisseria
IYQYLK

SEQ ID NO: 35455 - protein, 5 aa, Neisseria
AQESF

SEQ ID NO: 35456 - protein, 8 aa, Neisseria
NRPAESMA

SEQ ID NO: 35457 - protein, 5 aa, Neisseria
FDKAL

SEQ ID NO: 35458 - protein, 6 aa, Neisseria
IANLNK

SEQ ID NO: 35459 - protein, 8 aa, Neisseria
PAFKELAR

SEQ ID NO: 35460 - protein, 8 aa, Neisseria
KALGNVQA

SEQ ID NO: 35461 - protein, 9 aa, Neisseria
PFKPSKRIS

SEQ ID NO: 35462 - protein, 16 aa, Neisseria
ACSTSYRPSRAEKANQ

SEQ ID NO: 35463 - protein, 26 aa, Neisseria
YMRGQDYRQATASIEDALKSNPKNEL

SEQ ID NO: 35464 - protein, 11 aa, Neisseria
KVNDKAQESFR

SEQ ID NO: 35465 - protein, 16 aa, Neisseria
LSIKPDSAEINNNYGW

SEQ ID NO: 35466 - protein, 9 aa, Neisseria
CGRLNRPAE

SEQ ID NO: 35467 - protein, 9 aa, Neisseria
ALADPTYPT

SEQ ID NO: 35468 - protein, 12 aa, Neisseria
LNKGICSAKQGQ

SEQ ID NO: 35469 - protein, 11 aa, Neisseria
PAFKELARTKM

SEQ ID NO: 35470 - protein, 23 aa, Neisseria
LGDADYYFKKYQSRVEVLQADDL

SEQ ID NO: 35471 - protein, 8 aa, Neisseria
FPYSEELQ

SEQ ID NO: 35472 - protein, 6 aa, Neisseria
KPSKRI

SEQ ID NO: 35473 - protein, 11 aa, Neisseria
YRPSRAEKANQ

SEQ ID NO: 35474 - protein, 9 aa, Neisseria
YMRGQDYRQ

SEQ ID NO: 35475 - protein, 15 aa, Neisseria
TASIEDALKSNPKNE

SEQ ID NO: 35476 - protein, 11 aa, Neisseria
KVNDKAQESFR

SEQ ID NO: 35477 - protein, 8 aa, Neisseria
IKPDSAEI

SEQ ID NO: 35478 - protein, 7 aa, Neisseria
RLNRPAE

SEQ ID NO: 35479 - protein, 7 aa, Neisseria
ICSAKQG

SEQ ID NO: 35480 - protein, 10 aa, Neisseria
AFKELARTKM

SEQ ID NO: 35481 - protein, 13 aa, Neisseria
YQSRVEVLQADDL

SEQ ID NO: 35482 - protein, 9 aa, Neisseria
SLLDMPRGE

SEQ ID NO: 35483 - protein, 10 aa, Neisseria
VVVALIAAMG

SEQ ID NO: 35484 - protein, 12 aa, Neisseria
PHMSIIAAIVVL

SEQ ID NO: 35485 - protein, 6 aa, Neisseria
ARGLKY

SEQ ID NO: 35486 - protein, 8 aa, Neisseria
IGALNQGM

SEQ ID NO: 35487 - protein, 8 aa, Neisseria
SAFALCSV

SEQ ID NO: 35488 - protein, 6 aa, Neisseria
SLTACA

SEQ ID NO: 35489 - protein, 5 aa, Neisseria
PLSDT

SEQ ID NO: 35490 - protein, 14 aa, Neisseria
IDLFEHIKNMMYTT

SEQ ID NO: 35491 - protein, 8 aa, Neisseria
LNSVESFR

SEQ ID NO: 35492 - protein, 7 aa, Neisseria
FALLVVL

SEQ ID NO: 35493 - protein, 14 aa, Neisseria
AMLFTVIAAVAVTY

SEQ ID NO: 35494 - protein, 11 aa, Neisseria
TPDLRQLGAWF

SEQ ID NO: 35495 - protein, 13 aa, Neisseria
AFKDIAKLISRGG

SEQ ID NO: 35496 - protein, 16 aa, Neisseria
LGVIPSLLEAVRTFLT

SEQ ID NO: 35497 - protein, 5 aa, Neisseria
TFKPV

SEQ ID NO: 35498 - protein, 28 aa, Neisseria
NLSRTLEDAGTVINPLVPWSVCGVFISH

SEQ ID NO: 35499 - protein, 8 aa, Neisseria
LDMPRGEA

SEQ ID NO: 35500 - protein, 9 aa, Neisseria
RGLKYNDMQ

SEQ ID NO: 35501 - protein, 13 aa, Neisseria
FGDKMSPLSDTTG

SEQ ID NO: 35502 - protein, 11 aa, Neisseria
NSVESFRSQLE

SEQ ID NO: 35503 - protein, 7 aa, Neisseria
STPDLRQ

SEQ ID NO: 35504 - protein, 23 aa, Neisseria
GGYKLEGEAFKDIAKLISRGGLE

SEQ ID NO: 35505 - protein, 7 aa, Neisseria
TNAGRAT

SEQ ID NO: 35506 - protein, 14 aa, Neisseria
LSGETFKPVYDKLG

SEQ ID NO: 35507 - protein, 11 aa, Neisseria
NLSRTLEDAGT

SEQ ID NO: 35508 - protein, 8 aa, Neisseria
LDMPRGEA

SEQ ID NO: 35509 - protein, 5 aa, Neisseria
LKYND

SEQ ID NO: 35510 - protein, 8 aa, Neisseria
DKMSPLSD

SEQ ID NO: 35511 - protein, 8 aa, Neisseria
ESFRSQLE

SEQ ID NO: 35512 - protein, 5 aa, Neisseria
PDLRQ

SEQ ID NO: 35513 - protein, 15 aa, Neisseria
KLEGEAFKDIAKLIS

SEQ ID NO: 35514 - protein, 7 aa, Neisseria
RTLEDAG

SEQ ID NO: 35515 - protein, 8 aa, Neisseria
GVQKSAQG

SEQ ID NO: 35516 - protein, 12 aa, Neisseria
ATVKKAHKHTKA

SEQ ID NO: 35517 - protein, 5 aa, Neisseria
MNKNI

SEQ ID NO: 35518 - protein, 38 aa, Neisseria
KPASNATGVQKSAQGSCGASKSAEGSCGASKSAEGSCG

SEQ ID NO: 35519 - protein, 48 aa, Neisseria
AASKAGEGKCGEGKCGATVKKAHKHTKASKAKAKSAEGKCGEGKCGSK

SEQ ID NO: 35520 - protein, 7 aa, Neisseria
GVQKSAQ

SEQ ID NO: 35521 - protein, 20 aa, Neisseria
GASKSAEGSCGASKSAEGSC

SEQ ID NO: 35522 - protein, 15 aa, Neisseria
AASKAGEGKCGEGKC

SEQ ID NO: 35523 - protein, 32 aa, Neisseria
ATVKKAHKHTKASKAKAKSAEGKCGEGKCGSK

SEQ ID NO: 35524 - protein, 5 aa, Neisseria
AAIAA

SEQ ID NO: 35525 - protein, 8 aa, Neisseria
TAVYALAN

SEQ ID NO: 35526 - protein, 5 aa, Neisseria
LHRGL

SEQ ID NO: 35527 - protein, 5 aa, Neisseria
SLAYW

SEQ ID NO: 35528 - protein, 7 aa, Neisseria
AGLEQLG

SEQ ID NO: 35529 - protein, 18 aa, Neisseria
QSIFSTVWTPYIFRAIEE

SEQ ID NO: 35530 - protein, 9 aa, Neisseria
TGIFSPLAS

SEQ ID NO: 35531 - protein, 7 aa, Neisseria
LNVVRKT

SEQ ID NO: 35532 - protein, 8 aa, Neisseria
LATLGALA

SEQ ID NO: 35533 - protein, 12 aa, Neisseria
SSCRLWQPLKRL

SEQ ID NO: 35534 - protein, 5 aa, Neisseria
CFGTP

SEQ ID NO: 35535 - protein, 9 aa, Neisseria
GVWAAYLAG

SEQ ID NO: 35536 - protein, 9 aa, Neisseria
KNLHKLFHY

SEQ ID NO: 35537 - protein, 5 aa, Neisseria
MDTKE

SEQ ID NO: 35538 - protein, 7 aa, Neisseria
PADDIGR

SEQ ID NO: 35539 - protein, 6 aa, Neisseria
ADKDTL

SEQ ID NO: 35540 - protein, 9 aa, Neisseria
SRPSLPSEI

SEQ ID NO: 35541 - protein, 5 aa, Neisseria
MEGRA

SEQ ID NO: 35542 - protein, 14 aa, Neisseria
NRCRLKAVRRAPFS

SEQ ID NO: 35543 - protein, 7 aa, Neisseria
SADRLFL

SEQ ID NO: 35544 - protein, 11 aa, Neisseria
AIEENATPARL

SEQ ID NO: 35545 - protein, 5 aa, Neisseria
ATAES

SEQ ID NO: 35546 - protein, 5 aa, Neisseria
PENYA

SEQ ID NO: 35547 - protein, 9 aa, Neisseria
VVRKTRPIA

SEQ ID NO: 35548 - protein, 8 aa, Neisseria
PSGGTRGA

SEQ ID NO: 35549 - protein, 8 aa, Neisseria
KTESSCRL

SEQ ID NO: 35550 - protein, 7 aa, Neisseria
LRHRKNL

SEQ ID NO: 35551 - protein, 5 aa, Neisseria
MDTKE

SEQ ID NO: 35552 - protein, 6 aa, Neisseria
ADKDTL

SEQ ID NO: 35553 - protein, 5 aa, Neisseria
MEGRA

SEQ ID NO: 35554 - protein, 12 aa, Neisseria
NRCRLKAVRRAP

SEQ ID NO: 35555 - protein, 11 aa, Neisseria
AIEENATPARL

SEQ ID NO: 35556 - protein, 5 aa, Neisseria
ATAES

SEQ ID NO: 35557 - protein, 7 aa, Neisseria
VVRKTRP

SEQ ID NO: 35558 - protein, 5 aa, Neisseria
GGTRG

SEQ ID NO: 35559 - protein, 5 aa, Neisseria
TESSC

SEQ ID NO: 35560 - protein, 7 aa, Neisseria
LRHRKNL

SEQ ID NO: 35561 - protein, 8 aa, Neisseria
SFFALVFA

SEQ ID NO: 35562 - protein, 8 aa, Neisseria
ATEVPENP

SEQ ID NO: 35563 - protein, 13 aa, Neisseria
AFVAKLARLFRNA

SEQ ID NO: 35564 - protein, 10 aa, Neisseria
EESLAGAVDD

SEQ ID NO: 35565 - protein, 7 aa, Neisseria
HGENYET

SEQ ID NO: 35566 - protein, 13 aa, Neisseria
EDVYEHCLGCYQM

SEQ ID NO: 35567 - protein, 6 aa, Neisseria
YRDVAN

SEQ ID NO: 35568 - protein, 6 aa, Neisseria
SNRIAS

SEQ ID NO: 35569 - protein, 7 aa, Neisseria
MRELMPR

SEQ ID NO: 35570 - protein, 13 aa, Neisseria
EKEVSRYAEAAAR

SEQ ID NO: 35571 - protein, 5 aa, Neisseria
INPRW

SEQ ID NO: 35572 - protein, 14 aa, Neisseria
LSDTATEVPENPNA

SEQ ID NO: 35573 - protein, 7 aa, Neisseria
FRNADRA

SEQ ID NO: 35574 - protein, 11 aa, Neisseria
VKESMRTEESL

SEQ ID NO: 35575 - protein, 13 aa, Neisseria
AVDDGPLQSEKDY

SEQ ID NO: 35576 - protein, 10 aa, Neisseria
RLSRLKEKAK

SEQ ID NO: 35577 - protein, 7 aa, Neisseria
TEQEHGE

SEQ ID NO: 35578 - protein, 6 aa, Neisseria
YIGEGG

SEQ ID NO: 35579 - protein, 10 aa, Neisseria
LSQRSPEAFV

SEQ ID NO: 35580 - protein, 10 aa, Neisseria
YLYRNDRPFS

SEQ ID NO: 35581 - protein, 14 aa, Neisseria
AHGENYETTGEYRV

SEQ ID NO: 35582 - protein, 6 aa, Neisseria
QPDGSV

SEQ ID NO: 35583 - protein, 12 aa, Neisseria
AAGRGKIGEDVY

SEQ ID NO: 35584 - protein, 30 aa, Neisseria
KYRDVANDEQKVWDFREESNRIASDSRDYV

SEQ ID NO: 35585 - protein, 14 aa, Neisseria
NMRELMPRGMKANS

SEQ ID NO: 35586 - protein, 10 aa, Neisseria
GYDADGLPQK

SEQ ID NO: 35587 - protein, 19 aa, Neisseria
SFDNGKKRQSFEYYLKNGN

SEQ ID NO: 35588 - protein, 7 aa, Neisseria
LKADGVT

SEQ ID NO: 35589 - protein, 19 aa, Neisseria
LDGGRIIREEKQGDRLPDF

SEQ ID NO: 35590 - protein, 29 aa, Neisseria
LNLEDLEKEVSRYAEAAARRSGGRRGLSH

SEQ ID NO: 35591 - protein, 9 aa, Neisseria
TATEVPENP

SEQ ID NO: 35592 - protein, 7 aa, Neisseria
FRNADRA

SEQ ID NO: 35593 - protein, 11 aa, Neisseria
VKESMRTEESL

SEQ ID NO: 35594 - protein, 13 aa, Neisseria
AVDDGPLQSEKDY

SEQ ID NO: 35595 - protein, 10 aa, Neisseria
RLSRLKEKAK

SEQ ID NO: 35596 - protein, 7 aa, Neisseria
TEQEHGE

SEQ ID NO: 35597 - protein, 7 aa, Neisseria
LSQRSPE

SEQ ID NO: 35598 - protein, 7 aa, Neisseria
YRNDRPF

SEQ ID NO: 35599 - protein, 9 aa, Neisseria
ENYETTGEY

SEQ ID NO: 35600 - protein, 12 aa, Neisseria
AAGRGKIGEDVY

SEQ ID NO: 35601 - protein, 28 aa, Neisseria
KYRDVANDEQKVWDFREESNRIASDSRD

SEQ ID NO: 35602 - protein, 11 aa, Neisseria
NMRELMPRGMK

SEQ ID NO: 35603 - protein, 7 aa, Neisseria
YDADGLP

SEQ ID NO: 35604 - protein, 8 aa, Neisseria
DNGKKRQS

SEQ ID NO: 35605 - protein, 7 aa, Neisseria
LKADGVT

SEQ ID NO: 35606 - protein, 15 aa, Neisseria
GGRIIREEKQGDRLP

SEQ ID NO: 35607 - protein, 28 aa, Neisseria
LNLEDLEKEVSRYAEAAARRSGGRRGLS

SEQ ID NO: 35608 - protein, 7 aa, Neisseria
CTMIPQY

SEQ ID NO: 35609 - protein, 5 aa, Neisseria
HDYFA

SEQ ID NO: 35610 - protein, 9 aa, Neisseria
PRLQKLIDI

SEQ ID NO: 35611 - protein, 5 aa, Neisseria
QGYFA

SEQ ID NO: 35612 - protein, 6 aa, Neisseria
LATLIN

SEQ ID NO: 35613 - protein, 7 aa, Neisseria
IPEDLPA

SEQ ID NO: 35614 - protein, 6 aa, Neisseria
KLPAGL

SEQ ID NO: 35615 - protein, 9 aa, Neisseria
ELGGLFKSG

SEQ ID NO: 35616 - protein, 11 aa, Neisseria
VQSAFQDVANA

SEQ ID NO: 35617 - protein, 13 aa, Neisseria
LDKAYDALSKQSR

SEQ ID NO: 35618 - protein, 9 aa, Neisseria
GALDLLDAE

SEQ ID NO: 35619 - protein, 18 aa, Neisseria
LTRAENLADLYKALDGGL

SEQ ID NO: 35620 - protein, 10 aa, Neisseria
PQYEQPKVEV

SEQ ID NO: 35621 - protein, 11 aa, Neisseria
ETFQNDTSVSS

SEQ ID NO: 35622 - protein, 13 aa, Neisseria
GWHDYFADPRLQK

SEQ ID NO: 35623 - protein, 10 aa, Neisseria
ALERNTSLRT

SEQ ID NO: 35624 - protein, 16 aa, Neisseria
EIYRKQYMIERNNLLP

SEQ ID NO: 35625 - protein, 19 aa, Neisseria
ANGSRQGSLSGGNVSSSYN

SEQ ID NO: 35626 - protein, 10 aa, Neisseria
GRVRSNSEAA

SEQ ID NO: 35627 - protein, 6 aa, Neisseria
ANRDAA

SEQ ID NO: 35628 - protein, 11 aa, Neisseria
YFNERYAEKAM

SEQ ID NO: 35629 - protein, 17 aa, Neisseria
RVLKTREETYKLSELRY

SEQ ID NO: 35630 - protein, 14 aa, Neisseria
RQQEALIESAKADY

SEQ ID NO: 35631 - protein, 9 aa, Neisseria
ARSREQARN

SEQ ID NO: 35632 - protein, 10 aa, Neisseria
NRPIPEDLPA

SEQ ID NO: 35633 - protein, 20 aa, Neisseria
VLLDRPDIRAAEHALKQANA

SEQ ID NO: 35634 - protein, 10 aa, Neisseria
RLTGSVGTGS

SEQ ID NO: 35635 - protein, 5 aa, Neisseria
FKSGT

SEQ ID NO: 35636 - protein, 15 aa, Neisseria
GTNKANLDVAKLRQQ

SEQ ID NO: 35637 - protein, 25 aa, Neisseria
AAREQLDKAYDALSKQSRASKEALR

SEQ ID NO: 35638 - protein, 8 aa, Neisseria
LRYKHGVS

SEQ ID NO: 35639 - protein, 12 aa, Neisseria
LDAERISYSAEG

SEQ ID NO: 35640 - protein, 7 aa, Neisseria
LTRAENL

SEQ ID NO: 35641 - protein, 13 aa, Neisseria
LDGGLKRDTQTGK

SEQ ID NO: 35642 - protein, 7 aa, Neisseria
EQPKVEV

SEQ ID NO: 35643 - protein, 5 aa, Neisseria
TSVSS

SEQ ID NO: 35644 - protein, 5 aa, Neisseria
PRLQK

SEQ ID NO: 35645 - protein, 8 aa, Neisseria
ALERNTSL

SEQ ID NO: 35646 - protein, 7 aa, Neisseria
YMIERNN

SEQ ID NO: 35647 - protein, 7 aa, Neisseria
NGSRQGS

SEQ ID NO: 35648 - protein, 10 aa, Neisseria
GRVRSNSEAA

SEQ ID NO: 35649 - protein, 6 aa, Neisseria
ANRDAA

SEQ ID NO: 35650 - protein, 7 aa, Neisseria
RYAEKAM

SEQ ID NO: 35651 - protein, 11 aa, Neisseria
RVLKTREETYK

SEQ ID NO: 35652 - protein, 5 aa, Neisseria
SELRY

SEQ ID NO: 35653 - protein, 14 aa, Neisseria
RQQEALIESAKADY

SEQ ID NO: 35654 - protein, 9 aa, Neisseria
ARSREQARN

SEQ ID NO: 35655 - protein, 7 aa, Neisseria
PIPEDLP

SEQ ID NO: 35656 - protein, 19 aa, Neisseria
VLLDRPDIRAAEHALKQAN

SEQ ID NO: 35657 - protein, 11 aa, Neisseria
KANLDVAKLRQ

SEQ ID NO: 35658 - protein, 25 aa, Neisseria
AAREQLDKAYDALSKQSRASKEALR

SEQ ID NO: 35659 - protein, 8 aa, Neisseria
LDAERISY

SEQ ID NO: 35660 - protein, 7 aa, Neisseria
LTRAENL

SEQ ID NO: 35661 - protein, 13 aa, Neisseria
LDGGLKRDTQTGK

SEQ ID NO: 35662 - protein, 10 aa, Neisseria
RLTNLLAACA

SEQ ID NO: 35663 - protein, 5 aa, Neisseria
LAADL

SEQ ID NO: 35664 - protein, 11 aa, Neisseria
KINVIQDYTHQ

SEQ ID NO: 35665 - protein, 5 aa, Neisseria
NHAAD

SEQ ID NO: 35666 - protein, 18 aa, Neisseria
HPADAYDGPKGGNYPKPT

SEQ ID NO: 35667 - protein, 20 aa, Neisseria
QRIFDNYNNLGSNFSDRADE

SEQ ID NO: 35668 - protein, 5 aa, Neisseria
HNAKL

SEQ ID NO: 35669 - protein, 13 aa, Neisseria
RWGNSMEFVNGVA

SEQ ID NO: 35670 - protein, 8 aa, Neisseria
GALNPFIS

SEQ ID NO: 35671 - protein, 7 aa, Neisseria
AAMRNIA

SEQ ID NO: 35672 - protein, 9 aa, Neisseria
AAIGGLGSA

SEQ ID NO: 35673 - protein, 15 aa, Neisseria
FEKNTREAVDRWIQE

SEQ ID NO: 35674 - protein, 27 aa, Neisseria
NAAETVEALVNVLPFAKVKNLTKAAKP

SEQ ID NO: 35675 - protein, 16 aa, Neisseria
LVKTADGYKAIAHIQA

SEQ ID NO: 35676 - protein, 6 aa, Neisseria
RYGNPY

SEQ ID NO: 35677 - protein, 5 aa, Neisseria
VSDGI

SEQ ID NO: 35678 - protein, 10 aa, Neisseria
KAGSRLLSES

SEQ ID NO: 35679 - protein, 5 aa, Neisseria
PLKAY

SEQ ID NO: 35680 - protein, 17 aa, Neisseria
DSHRSVGDSNRVVREGK

SEQ ID NO: 35681 - protein, 6 aa, Neisseria
QVTQFK

SEQ ID NO: 35682 - protein, 7 aa, Neisseria
KPLRRLT

SEQ ID NO: 35683 - protein, 16 aa, Neisseria
FITDNTQRQHYEPGGK

SEQ ID NO: 35684 - protein, 16 aa, Neisseria
GDPRGSVSDRTGKINV

SEQ ID NO: 35685 - protein, 12 aa, Neisseria
SGHGHEEHAPFD

SEQ ID NO: 35686 - protein, 17 aa, Neisseria
HAADSASEEKGNVDDGF

SEQ ID NO: 35687 - protein, 36 aa, Neisseria; identical to SEQ ID NO: 23780

SEQ ID NO: 35688 - protein, 20 aa, Neisseria
GTARSIKLNPTDTRSIRQRI

SEQ ID NO: 35689 - protein, 34 aa, Neisseria
DNYNNLGSNFSDRADEANRKMFEHNAKLDRWGNS

SEQ ID NO: 35690 - protein, 8 aa, Neisseria
YAIDKAAM

SEQ ID NO: 35691 - protein, 6 aa, Neisseria
PAEGKF

SEQ ID NO: 35692 - protein, 11 aa, Neisseria
GFEKNTREAVD

SEQ ID NO: 35693 - protein, 13 aa, Neisseria
WIQENPNAAETVE

SEQ ID NO: 35694 - protein, 22 aa, Neisseria
KNLTKAAKPGKAAVSGDFSKSY

SEQ ID NO: 35695 - protein, 7 aa, Neisseria
KTADGYK

SEQ ID NO: 35696 - protein, 31 aa, Neisseria
QAGDRVLSKDEASGETGYKPVTARYGNPYQE

SEQ ID NO: 35697 - protein, 8 aa, Neisseria
VSDGIGNS

SEQ ID NO: 35698 - protein, 27 aa, Neisseria
YSDGKWIKAEDLKAGSRLLSESGKTQT

SEQ ID NO: 35699 - protein, 8 aa, Neisseria
VVKPKPLK

SEQ ID NO: 35700 - protein, 9 aa, Neisseria
VKGNQAETE

SEQ ID NO: 35701 - protein, 49 aa, Neisseria
HNDCPPKPKPTNHAQQRKEEAKNDSHRSVGDSNRVVREGKQYLDSDTGN

SEQ ID NO: 35702 - protein, 7 aa, Neisseria
YVKGDKV

SEQ ID NO: 35703 - protein, 30 aa, Neisseria
LTPDGRQVTQFKNSKANTSKRVKNGKWTPK

SEQ ID NO: 35704 - protein, 7 aa, Neisseria
KPLRRLT

SEQ ID NO: 35705 - protein, 11 aa, Neisseria
NTQRQHYEPGG

SEQ ID NO: 35706 - protein, 13 aa, Neisseria
GDPRGSVSDRTGK

SEQ ID NO: 35707 - protein, 7 aa, Neisseria
GHEEHAP

SEQ ID NO: 35708 - protein, 16 aa, Neisseria
HAADSASEEKGNVDDG

SEQ ID NO: 35709 - protein, 8 aa, Neisseria
WEGHEHHP

SEQ ID NO: 35710 - protein, 13 aa, Neisseria
DAYDGPKGGNYPK

SEQ ID NO: 35711 - protein, 7 aa, Neisseria
TGARDEY

SEQ ID NO: 35712 - protein, 7 aa, Neisseria
GTARSIK

SEQ ID NO: 35713 - protein, 12 aa, Neisseria
NPTDTRSIRQRI

SEQ ID NO: 35714 - protein, 24 aa, Neisseria
FSDRADEANRKMFEHNAKLDRWGN

SEQ ID NO: 35715 - protein, 8 aa, Neisseria
YAIDKAAM

SEQ ID NO: 35716 - protein, 6 aa, Neisseria
PAEGKF

SEQ ID NO: 35717 - protein, 11 aa, Neisseria
GFEKNTREAVD

SEQ ID NO: 35718 - protein, 9 aa, Neisseria
NPNAAETVE

SEQ ID NO: 35719 - protein, 14 aa, Neisseria
KNLTKAAKPGKAAV

SEQ ID NO: 35720 - protein, 7 aa, Neisseria
KTADGYK

SEQ ID NO: 35721 - protein, 17 aa, Neisseria
AGDRVLSKDEASGETGY

SEQ ID NO: 35722 - protein, 6 aa, Neisseria
VSDGIG

SEQ ID NO: 35723 - protein, 12 aa, Neisseria
KWIKAEDLKAGS

SEQ ID NO: 35724 - protein, 10 aa, Neisseria
LLSESGKTQT

SEQ ID NO: 35725 - protein, 8 aa, Neisseria
VVKPKPLK

SEQ ID NO: 35726 - protein, 6 aa, Neisseria
NQAETE

SEQ ID NO: 35727 - protein, 10 aa, Neisseria
DCPPKPKPTN

SEQ ID NO: 35728 - protein, 35 aa, Neisseria
AQQRKEEAKNDSHRSVGDSNRVVREGKQYLDSDTG

SEQ ID NO: 35729 - protein, 5 aa, Neisseria
VKGDK

SEQ ID NO: 35730 - protein, 5 aa, Neisseria
PDGRQ

SEQ ID NO: 35731 - protein, 18 aa, Neisseria
KNSKANTSKRVKNGKWTP

SEQ ID NO: 35732 - protein, 11 aa, Neisseria
ACAVPEAYDGG

SEQ ID NO: 35733 - protein, 10 aa, Neisseria
GPDDFRAFSC

SEQ ID NO: 35734 - protein, 10 aa, Neisseria
EAYDGGGRGY

SEQ ID NO: 35735 - protein, 14 aa, Neisseria
PPVQNQAGPDDFRA

SEQ ID NO: 35736 - protein, 6 aa, Neisseria
SCENGL

SEQ ID NO: 35737 - protein, 35 aa, Neisseria
VRVRNLDGGKIALRLDGRRAVLSSDVAASGERYTA

SEQ ID NO: 35738 - protein, 16 aa, Neisseria
GLFGNGTEWHQKGGEA

SEQ ID NO: 35739 - protein, 14 aa, Neisseria
DAYGNSVETSCRAR

SEQ ID NO: 35740 - protein, 7 aa, Neisseria
EAYDGGG

SEQ ID NO: 35741 - protein, 7 aa, Neisseria
AGPDDFR

SEQ ID NO: 35742 - protein, 22 aa, Neisseria
VRVRNLDGGKIALRLDGRRAVL

SEQ ID NO: 35743 - protein, 10 aa, Neisseria
VAASGERYTA

SEQ ID NO: 35744 - protein, 7 aa, Neisseria
WHQKGGE

SEQ ID NO: 35745 - protein, 8 aa, Neisseria
VETSCRAR

SEQ ID NO: 35746 - protein, 5 aa, Neisseria
LGAIS

SEQ ID NO: 35747 - protein, 12 aa, Neisseria
VQSIRTMAEVYG

SEQ ID NO: 35748 - protein, 13 aa, Neisseria
DADLFEGAMKGMV

SEQ ID NO: 35749 - protein, 8 aa, Neisseria
EIKESTSG

SEQ ID NO: 35750 - protein, 12 aa, Neisseria
DGFVKVVSPIED

SEQ ID NO: 35751 - protein, 6 aa, Neisseria
EAVKKM

SEQ ID NO: 35752 - protein, 5 aa, Neisseria
VNLTR

SEQ ID NO: 35753 - protein, 12 aa, Neisseria
ERTVESVNTAAK

SEQ ID NO: 35754 - protein, 9 aa, Neisseria
KAVPEDYVY

SEQ ID NO: 35755 - protein, 13 aa, Neisseria
MGGDPLAGIPAEL

SEQ ID NO: 35756 - protein, 6 aa, Neisseria
SEIVAG

SEQ ID NO: 35757 - protein, 7 aa, Neisseria
LVGHIGN

SEQ ID NO: 35758 - protein, 9 aa, Neisseria
RRIPNPAKD

SEQ ID NO: 35759 - protein, 16 aa, Neisseria
KALDLVKSPEQWQKSL

SEQ ID NO: 35760 - protein, 11 aa, Neisseria
AAEKDGRDNEV

SEQ ID NO: 35761 - protein, 12 aa, Neisseria
NYYHDKPDADLF

SEQ ID NO: 35762 - protein, 25 aa, Neisseria
DPHSEYMDKKGYAEIKESTSGEFGG

SEQ ID NO: 35763 - protein, 7 aa, Neisseria
IGQEDGF

SEQ ID NO: 35764 - protein, 18 aa, Neisseria
SPIEDTPAERAEVKSGDF

SEQ ID NO: 35765 - protein, 9 aa, Neisseria
DNVSTRGMT

SEQ ID NO: 35766 - protein, 14 aa, Neisseria
EAVKKMRGKPGTKI

SEQ ID NO: 35767 - protein, 10 aa, Neisseria
LSRKNADKPI

SEQ ID NO: 35768 - protein, 8 aa, Neisseria
LIEPDYGY

SEQ ID NO: 35769 - protein, 8 aa, Neisseria
QFQERTVE

SEQ ID NO: 35770 - protein, 17 aa, Neisseria
NTAAKELVKENKGKPLK

SEQ ID NO: 35771 - protein, 9 aa, Neisseria
DLRDDPGGL

SEQ ID NO: 35772 - protein, 13 aa, Neisseria
VSTKGRDGKDGMV

SEQ ID NO: 35773 - protein, 6 aa, Neisseria
AVPEDY

SEQ ID NO: 35774 - protein, 5 aa, Neisseria
MGGDP

SEQ ID NO: 35775 - protein, 5 aa, Neisseria
AELKT

SEQ ID NO: 35776 - protein, 6 aa, Neisseria
SGSASA

SEQ ID NO: 35777 - protein, 7 aa, Neisseria
QDHKRAV

SEQ ID NO: 35778 - protein, 9 aa, Neisseria
TQSFGKGSV

SEQ ID NO: 35779 - protein, 5 aa, Neisseria
LSNGS

SEQ ID NO: 35780 - protein, 9 aa, Neisseria
YTPNDRSIQ

SEQ ID NO: 35781 - protein, 17 aa, Neisseria
VEVKDKERTFESREADL

SEQ ID NO: 35782 - protein, 12 aa, Neisseria
GNPLGGEDVNSE

SEQ ID NO: 35783 - protein, 52 aa, Neisseria
PLEKDADKPAAKEKGKKKKDEDLSSRRIPNPAKDDQLRKALDLVKSPEQWQK

SEQ ID NO: 35784 - protein, 15 aa, Neisseria
AAKKPVSNKDKKDKK

SEQ ID NO: 35785 - protein, 11 aa, Neisseria
AAEKDGRDNEV

SEQ ID NO: 35786 - protein, 11 aa, Neisseria
YYHDKPDADLF

SEQ ID NO: 35787 - protein, 22 aa, Neisseria
DPHSEYMDKKGYAEIKESTSGE

SEQ ID NO: 35788 - protein, 7 aa, Neisseria
IGQEDGF

SEQ ID NO: 35789 - protein, 18 aa, Neisseria
SPIEDTPAERAEVKSGDF

SEQ ID NO: 35790 - protein, 5 aa, Neisseria
DNVST

SEQ ID NO: 35791 - protein, 12 aa, Neisseria
EAVKKMRGKPGT

SEQ ID NO: 35792 - protein, 10 aa, Neisseria
LSRKNADKPI

SEQ ID NO: 35793 - protein, 8 aa, Neisseria
QFQERTVE

SEQ ID NO: 35794 - protein, 17 aa, Neisseria
NTAAKELVKENKGKPLK

SEQ ID NO: 35795 - protein, 7 aa, Neisseria
DLRDDPG

SEQ ID NO: 35796 - protein, 11 aa, Neisseria
TKGRDGKDGMV

SEQ ID NO: 35797 - protein, 5 aa, Neisseria
AELKT

SEQ ID NO: 35798 - protein, 7 aa, Neisseria
QDHKRAV

SEQ ID NO: 35799 - protein, 7 aa, Neisseria
PNDRSIQ

SEQ ID NO: 35800 - protein, 17 aa, Neisseria
VEVKDKERTFESREADL

SEQ ID NO: 35801 - protein, 8 aa, Neisseria
LGGEDVNS

SEQ ID NO: 35802 - protein, 51 aa, Neisseria
PLEKDADKPAAKEKGKKKKDEDLSSRRIPNPAKDDQLRKALDLVKSPEQWQ

SEQ ID NO: 35803 - protein, 15 aa, Neisseria
AAKKPVSNKDKKDKK

SEQ ID NO: 35804 - protein, 6 aa, Neisseria
TLGRLS

SEQ ID NO: 35805 - protein, 6 aa, Neisseria
VLALTA

SEQ ID NO: 35806 - protein, 11 aa, Neisseria
YGGYPDTVYEG

SEQ ID NO: 35807 - protein, 15 aa, Neisseria
KQTEKMEKYFAEAAN

SEQ ID NO: 35808 - protein, 8 aa, Neisseria
GAFRQFEE

SEQ ID NO: 35809 - protein, 7 aa, Neisseria
MNPKTLG

SEQ ID NO: 35810 - protein, 6 aa, Neisseria
AGGGHK

SEQ ID NO: 35811 - protein, 31 aa, Neisseria
YYGGYPDTVYEGLKNDDTSLGKQTEKMEKYF

SEQ ID NO: 35812 - protein, 12 aa, Neisseria
AANKKMNAAPGA

SEQ ID NO: 35813 - protein, 23 aa, Neisseria
LSRSGDKEGAFRQFEEEKRLFPE

SEQ ID NO: 35814 - protein, 9 aa, Neisseria
MKTGKGGKR

SEQ ID NO: 35815 - protein, 23 aa, Neisseria
VYEGLKNDDTSLGKQTEKMEKYF

SEQ ID NO: 35816 - protein, 8 aa, Neisseria
AANKKMNA

SEQ ID NO: 35817 - protein, 20 aa, Neisseria
RSGDKEGAFRQFEEEKRLFP

SEQ ID NO: 35818 - protein, 9 aa, Neisseria
MKTGKGGKR

SEQ ID NO: 35819 - protein, 17 aa, Neisseria
YLAVWQNPQDANDVLQV

SEQ ID NO: 35820 - protein, 11 aa, Neisseria
EAFAELEAFCK

SEQ ID NO: 35821 - protein, 8 aa, Neisseria
TGCRSVVS

SEQ ID NO: 35822 - protein, 11 aa, Neisseria
LAYPKALGAMR

SEQ ID NO: 35823 - protein, 5 aa, Neisseria
RFTSV

SEQ ID NO: 35824 - protein, 8 aa, Neisseria
ALNQCIKK

SEQ ID NO: 35825 - protein, 11 aa, Neisseria
QNPQDANDVLQ

SEQ ID NO: 35826 - protein, 15 aa, Neisseria
KTTKEDSAKSEAFAE

SEQ ID NO: 35827 - protein, 8 aa, Neisseria
AFCKGQDT

SEQ ID NO: 35828 - protein, 11 aa, Neisseria
IAEDEPTGCRS

SEQ ID NO: 35829 - protein, 5 aa, Neisseria
MRVEN

SEQ ID NO: 35830 - protein, 6 aa, Neisseria
SPRFTS

SEQ ID NO: 35831 - protein, 9 aa, Neisseria
CIKKYGAQG

SEQ ID NO: 35832 - protein, 5 aa, Neisseria
SSYYG

SEQ ID NO: 35833 - protein, 5 aa, Neisseria
QDAND

SEQ ID NO: 35834 - protein, 15 aa, Neisseria
KTTKEDSAKSEAFAE

SEQ ID NO: 35835 - protein, 8 aa, Neisseria
AFCKGQDT

SEQ ID NO: 35836 - protein, 9 aa, Neisseria
IAEDEPTGC

SEQ ID NO: 35837 - protein, 5 aa, Neisseria
MRVEN

SEQ ID NO: 35838 - protein, 7 aa, Neisseria
CIKKYGA

SEQ ID NO: 35839 - protein, 8 aa, Neisseria
GLIQSFGS

SEQ ID NO: 35840 - protein, 5 aa, Neisseria
GVLSV

SEQ ID NO: 35841 - protein, 5 aa, Neisseria
GLFVG

SEQ ID NO: 35842 - protein, 15 aa, Neisseria
LQGYTQLSKFKSADI

SEQ ID NO: 35843 - protein, 8 aa, Neisseria
LLRELGPV

SEQ ID NO: 35844 - protein, 14 aa, Neisseria
LMKTTGQLEAMNVM

SEQ ID NO: 35845 - protein, 8 aa, Neisseria
VNPVARVV

SEQ ID NO: 35846 - protein, 11 aa, Neisseria
PRFWAGVFSMP

SEQ ID NO: 35847 - protein, 13 aa, Neisseria
LASIFNVAGIFGA

SEQ ID NO: 35848 - protein, 6 aa, Neisseria
DVINGL

SEQ ID NO: 35849 - protein, 7 aa, Neisseria
LRASTRT

SEQ ID NO: 35850 - protein, 14 aa, Neisseria
AKSGTAFARPRLSV

SEQ ID NO: 35851 - protein, 5 aa, Neisseria
SKFKS

SEQ ID NO: 35852 - protein, 6 aa, Neisseria
LLRELG

SEQ ID NO: 35853 - protein, 8 aa, Neisseria
SAGGAMTS

SEQ ID NO: 35854 - protein, 5 aa, Neisseria
QMQNN

SEQ ID NO: 35855 - protein, 11 aa, Neisseria
PTSEGILRAST

SEQ ID NO: 35856 - protein, 7 aa, Neisseria
ARPRLSV

SEQ ID NO: 35857 - protein, 5 aa, Neisseria
SKFKS

SEQ ID NO: 35858 - protein, 6 aa, Neisseria
LLRELG

SEQ ID NO: 35859 - protein, 8 aa, Neisseria
AAWARVGG

SEQ ID NO: 35860 - protein, 13 aa, Neisseria
AHHDGHGDDDHGH

SEQ ID NO: 35861 - protein, 12 aa, Neisseria
AHQHGKQDKIIS

SEQ ID NO: 35862 - protein, 7 aa, Neisseria
AQAEKAA

SEQ ID NO: 35863 - protein, 31 aa, Neisseria
RVGGKITDIDLEHDDGRPHYDVEIVKNGQEY

SEQ ID NO: 35864 - protein, 15 aa, Neisseria
VDARTGRVISSRRDD

SEQ ID NO: 35865 - protein, 10 aa, Neisseria
DGHGDDDHGH

SEQ ID NO: 35866 - protein, 10 aa, Neisseria
QHGKQDKIIS

SEQ ID NO: 35867 - protein, 7 aa, Neisseria
AQAEKAA

SEQ ID NO: 35868 - protein, 19 aa, Neisseria
VGGKITDIDLEHDDGRPHY

SEQ ID NO: 35869 - protein, 9 aa, Neisseria
EIVKNGQEY

SEQ ID NO: 35870 - protein, 7 aa, Neisseria
VDARTGR

SEQ ID NO: 35871 - protein, 7 aa, Neisseria
ISSRRDD

SEQ ID NO: 35872 - protein, 13 aa, Neisseria
LMNLIYPGMNDIA

SEQ ID NO: 35873 - protein, 9 aa, Neisseria
IGSLLQSCI

SEQ ID NO: 35874 - protein, 6 aa, Neisseria
KIPAAL

SEQ ID NO: 35875 - protein, 9 aa, Neisseria
TYIAAIALI

SEQ ID NO: 35876 - protein, 9 aa, Neisseria
AILETFTGI

SEQ ID NO: 35877 - protein, 16 aa, Neisseria
VERVANGGFTDLPRQS

SEQ ID NO: 35878 - protein, 8 aa, Neisseria
KALAAFQS

SEQ ID NO: 35879 - protein, 8 aa, Neisseria
GHGWNSFA

SEQ ID NO: 35880 - protein, 9 aa, Neisseria
DNFLSTLFT

SEQ ID NO: 35881 - protein, 6 aa, Neisseria
LQLLAE

SEQ ID NO: 35882 - protein, 11 aa, Neisseria
LLTGIAGLLKR

SEQ ID NO: 35883 - protein, 6 aa, Neisseria
MCHSML

SEQ ID NO: 35884 - protein, 8 aa, Neisseria
RLVNSFSP

SEQ ID NO: 35885 - protein, 9 aa, Neisseria
DSAKTLNRK

SEQ ID NO: 35886 - protein, 7 aa, Neisseria
NELRYIS

SEQ ID NO: 35887 - protein, 7 aa, Neisseria
LPEYPET

SEQ ID NO: 35888 - protein, 8 aa, Neisseria
AKQWMRAT

SEQ ID NO: 35889 - protein, 10 aa, Neisseria
YADEIRKLPV

SEQ ID NO: 35890 - protein, 17 aa, Neisseria
PLLPELLKDCKAFAAAP

SEQ ID NO: 35891 - protein, 10 aa, Neisseria
TTVSGARPAA

SEQ ID NO: 35892 - protein, 9 aa, Neisseria
RLKPSPDFY

SEQ ID NO: 35893 - protein, 7 aa, Neisseria
AGKKLFD

SEQ ID NO: 35894 - protein, 6 aa, Neisseria
YGQERI

SEQ ID NO: 35895 - protein, 5 aa, Neisseria
HRGQG

SEQ ID NO: 35896 - protein, 8 aa, Neisseria
IGQRNNLG

SEQ ID NO: 35897 - protein, 8 aa, Neisseria
LNGQRKIP

SEQ ID NO: 35898 - protein, 11 aa, Neisseria
FRSDKSNRRTM

SEQ ID NO: 35899 - protein, 21 aa, Neisseria
TAVERVANGGFTDLPRQSEWN

SEQ ID NO: 35900 - protein, 8 aa, Neisseria
GHGWNSFA

SEQ ID NO: 35901 - protein, 6 aa, Neisseria
TIHDNF

SEQ ID NO: 35902 - protein, 10 aa, Neisseria
LLKRSLTPAS

SEQ ID NO: 35903 - protein, 14 aa, Neisseria
PAEASDGIAFKKAA

SEQ ID NO: 35904 - protein, 17 aa, Neisseria
SPAADDSAKTLNRKINE

SEQ ID NO: 35905 - protein, 11 aa, Neisseria
PEYPETQTWAE

SEQ ID NO: 35906 - protein, 8 aa, Neisseria
LKYRPYSA

SEQ ID NO: 35907 - protein, 12 aa, Neisseria
RQGKVAEAKQWM

SEQ ID NO: 35908 - protein, 5 aa, Neisseria
ATQSY

SEQ ID NO: 35909 - protein, 8 aa, Neisseria
RYADEIRK

SEQ ID NO: 35910 - protein, 7 aa, Neisseria
LLKDCKA

SEQ ID NO: 35911 - protein, 10 aa, Neisseria
PGHPETKPCK

SEQ ID NO: 35912 - protein, 10 aa, Neisseria
TTVSGARPAA

SEQ ID NO: 35913 - protein, 5 aa, Neisseria
LKPSP

SEQ ID NO: 35914 - protein, 7 aa, Neisseria
AGKKLFD

SEQ ID NO: 35915 - protein, 5 aa, Neisseria
GQERI

SEQ ID NO: 35916 - protein, 5 aa, Neisseria
GQRNN

SEQ ID NO: 35917 - protein, 6 aa, Neisseria
GQRKIP

SEQ ID NO: 35918 - protein, 10 aa, Neisseria
RSDKSNRRTM

SEQ ID NO: 35919 - protein, 7 aa, Neisseria
TAVERVA

SEQ ID NO: 35920 - protein, 9 aa, Neisseria
DLPRQSEWN

SEQ ID NO: 35921 - protein, 7 aa, Neisseria
LLKRSLT

SEQ ID NO: 35922 - protein, 5 aa, Neisseria
AEASD

SEQ ID NO: 35923 - protein, 7 aa, Neisseria
IAFKKAA

SEQ ID NO: 35924 - protein, 16 aa, Neisseria
PAADDSAKTLNRKINE

SEQ ID NO: 35925 - protein, 12 aa, Neisseria
RQGKVAEAKQWM

SEQ ID NO: 35926 - protein, 8 aa, Neisseria
RYADEIRK

SEQ ID NO: 35927 - protein, 7 aa, Neisseria
LLKDCKA

SEQ ID NO: 35928 - protein, 9 aa, Neisseria
GHPETKPCK

SEQ ID NO: 35929 - protein, 6 aa, Neisseria
NKPFRL

SEQ ID NO: 35930 - protein, 5 aa, Neisseria
HTDSP

SEQ ID NO: 35931 - protein, 6 aa, Neisseria
QPDGTE

SEQ ID NO: 35932 - protein, 12 aa, Neisseria
DAARAADSLTGT

SEQ ID NO: 35933 - protein, 5 aa, Neisseria
AENTL

SEQ ID NO: 35934 - protein, 13 aa, Neisseria
MAKKPNKPFRLTP

SEQ ID NO: 35935 - protein, 24 aa, Neisseria
FNPNGDKTLQTEPQHTDSPRETEF

SEQ ID NO: 35936 - protein, 17 aa, Neisseria
LPNGAVGQDAAQPEHHH

SEQ ID NO: 35937 - protein, 59 aa, Neisseria
ASSEPAQPDGTEESGSGLPSPAAPKKNRVKPRPSDAARAADSLTGTGTQAENTLKETPV

SEQ ID NO: 35938 - protein, 52 aa, Neisseria
PTNAPHPEPRKETPEKQAQPKETPKEKETPKENHTKPDTPKNTPAKPHKEIL

SEQ ID NO: 35939 - protein, 11 aa, Neisseria
MAKKPNKPFRL

SEQ ID NO: 35940 - protein, 21 aa, Neisseria
PNGDKTLQTEPQHTDSPRETE

SEQ ID NO: 35941 - protein, 12 aa, Neisseria
VGQDAAQPEHHH

SEQ ID NO: 35942 - protein, 16 aa, Neisseria
ASSEPAQPDGTEESGS

SEQ ID NO: 35943 - protein, 23 aa, Neisseria
AAPKKNRVKPRPSDAARAADSLT

SEQ ID NO: 35944 - protein, 11 aa, Neisseria
TQAENTLKETP

SEQ ID NO: 35945 - protein, 48 aa, Neisseria
PHPEPRKETPEKQAQPKETPKEKETPKENHTKPDTPKNTPAKPHKEIL

SEQ ID NO: 35946 - protein, 7 aa, Neisseria
LVRWLAV

SEQ ID NO: 35947 - protein, 5 aa, Neisseria
IKHHL

SEQ ID NO: 35948 - protein, 9 aa, Neisseria
ANPPEDKPQ

SEQ ID NO: 35949 - protein, 5 aa, Neisseria
IKHHL

SEQ ID NO: 35950 - protein, 9 aa, Neisseria
QGFDLKRQT

SEQ ID NO: 35951 - protein, 7 aa, Neisseria
PPEDKPQ

SEQ ID NO: 35952 - protein, 5 aa, Neisseria
IKHHL

SEQ ID NO: 35953 - protein, 9 aa, Neisseria
QGFDLKRQT

SEQ ID NO: 35954 - protein, 10 aa, Neisseria
GTGLADALTA

SEQ ID NO: 35955 - protein, 9 aa, Neisseria
GAEKTFKAG

SEQ ID NO: 35956 - protein, 12 aa, Neisseria
KINNPDKIDSLI

SEQ ID NO: 35957 - protein, 8 aa, Neisseria
TAFNQLPD

SEQ ID NO: 35958 - protein, 5 aa, Neisseria
IEHLK

SEQ ID NO: 35959 - protein, 6 aa, Neisseria
VNRTTF

SEQ ID NO: 35960 - protein, 19 aa, Neisseria
TAGPDSDRLQQRRGGGGGV

SEQ ID NO: 35961 - protein, 9 aa, Neisseria
LDHKDKGLK

SEQ ID NO: 35962 - protein, 6 aa, Neisseria
SIPQNG

SEQ ID NO: 35963 - protein, 28 aa, Neisseria
QGAEKTFKAGGKDNSLNTGKLKNDKISR

SEQ ID NO: 35964 - protein, 6 aa, Neisseria
IEVDGQ

SEQ ID NO: 35965 - protein, 8 aa, Neisseria
IYKQDHSA

SEQ ID NO: 35966 - protein, 13 aa, Neisseria
RIEKINNPDKIDS

SEQ ID NO: 35967 - protein, 5 aa, Neisseria
INQRS

SEQ ID NO: 35968 - protein, 8 aa, Neisseria
SDLGGEHT

SEQ ID NO: 35969 - protein, 11 aa, Neisseria
QLPDGKAEYHG

SEQ ID NO: 35970 - protein, 11 aa, Neisseria
AFSSDDADGKL

SEQ ID NO: 35971 - protein, 20 aa, Neisseria
FAAKQGHGKIEHLKTPEQNV

SEQ ID NO: 35972 - protein, 12 aa, Neisseria
ASAELKADEKSH

SEQ ID NO: 35973 - protein, 14 aa, Neisseria
GDTRYGGEEKGTYR

SEQ ID NO: 35974 - protein, 10 aa, Neisseria
FGDRAQEIAG

SEQ ID NO: 35975 - protein, 8 aa, Neisseria
KIGEKVHE

SEQ ID NO: 35976 - protein, 6 aa, Neisseria
GIADKQ

SEQ ID NO: 35977 - protein, 15 aa, Neisseria
AGPDSDRLQQRRGGG

SEQ ID NO: 35978 - protein, 9 aa, Neisseria
LDHKDKGLK

SEQ ID NO: 35979 - protein, 17 aa, Neisseria
QGAEKTFKAGGKDNSLN

SEQ ID NO: 35980 - protein, 10 aa, Neisseria
GKLKNDKISR

SEQ ID NO: 35981 - protein, 5 aa, Neisseria
IEVDG

SEQ ID NO: 35982 - protein, 13 aa, Neisseria
RIEKINNPDKIDS

SEQ ID NO: 35983 - protein, 9 aa, Neisseria
PDGKAEYHG

SEQ ID NO: 35984 - protein, 11 aa, Neisseria
AFSSDDADGKL

SEQ ID NO: 35985 - protein, 16 aa, Neisseria
QGHGKIEHLKTPEQNV

SEQ ID NO: 35986 - protein, 12 aa, Neisseria
ASAELKADEKSH

SEQ ID NO: 35987 - protein, 11 aa, Neisseria
TRYGGEEKGTY

SEQ ID NO: 35988 - protein, 9 aa, Neisseria
GDRAQEIAG

SEQ ID NO: 35989 - protein, 8 aa, Neisseria
KIGEKVHE

SEQ ID NO: 35990 - protein, 6 aa, Neisseria
GIADKQ

SEQ ID NO: 35991 - protein, 8 aa, Neisseria
TAADKPQD

SEQ ID NO: 35992 - protein, 5 aa, Neisseria
SEPEN

SEQ ID NO: 35993 - protein, 14 aa, Neisseria
IKGLEESEKLQQAE

SEQ ID NO: 35994 - protein, 6 aa, Neisseria
EKVSAT

SEQ ID NO: 35995 - protein, 6 aa, Neisseria
DTVAVE

SEQ ID NO: 35996 - protein, 7 aa, Neisseria
PKRTAEP

SEQ ID NO: 35997 - protein, 5 aa, Neisseria
KAERT

SEQ ID NO: 35998 - protein, 12 aa, Neisseria
TKTAEKVADKPK

SEQ ID NO: 35999 - protein, 14 aa, Neisseria
SAVKEAKKADKAEG

SEQ ID NO: 36000 - protein, 23 aa, Neisseria
ETAQKTDKADKTKTAEKEKSGKA

SEQ ID NO: 36001 - protein, 8 aa, Neisseria
STITEIMT

SEQ ID NO: 36002 - protein, 11 aa, Neisseria
YKNARDAERDL

SEQ ID NO: 36003 - protein, 8 aa, Neisseria
MSENKQNE

SEQ ID NO: 36004 - protein, 13 aa, Neisseria
EQLKRRNRRRLVT

SEQ ID NO: 36005 - protein, 29 aa, Neisseria
LSSDPADSNPAPQAGETGATESQTANTAQ

SEQ ID NO: 36006 - protein, 35 aa, Neisseria
SAAENGETAADKPQDLAGEDKPSAADSEISEPENV

SEQ ID NO: 36007 - protein, 159 aa, Neisseria
NDRLEDSNIKGLEESEKLQQAETAKTEPKQAKQRAAEKVSATADSTDTVAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAA

SEQ ID NO: 36008 - protein, 20 aa, Neisseria
GYAEKERALSLQRKMKAAGI

SEQ ID NO: 36009 - protein, 31 aa, Neisseria; identical to SEQ ID NO: 11317

SEQ ID NO: 36010 - protein, 8 aa, Neisseria
MSENKQNE

SEQ ID NO: 36011 - protein, 12 aa, Neisseria
EQLKRRNRRRLV

SEQ ID NO: 36012 - protein, 10 aa, Neisseria
LSSDPADSNP

SEQ ID NO: 36013 - protein, 12 aa, Neisseria
QAGETGATESQT

SEQ ID NO: 36014 - protein, 35 aa, Neisseria; identical to SEQ ID NO: 36006

SEQ ID NO: 36015 - protein, 46 aa, Neisseria
DRLEDSNIKGLEESEKLQQAETAKTEPKQAKQRAAEKVSATADSTD

SEQ ID NO: 36016 - protein, 111 aa, Neisseria
VAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAA

SEQ ID NO: 36017 - protein, 19 aa, Neisseria
YAEKERALSLQRKMKAAGI

SEQ ID NO: 36018 - protein, 31 aa, Neisseria; identical to SEQ ID NO: 11317

SEQ ID NO: 36019 - protein, 8 aa, Neisseria
GAIGAIGG

SEQ ID NO: 36020 - protein, 12 aa, Neisseria
GETAERTAESQH

SEQ ID NO: 36021 - protein, 12 aa, Neisseria
SAKQLENLFRTL

SEQ ID NO: 36022 - protein, 16 aa, Neisseria
LQEMRDFPNDKLQKSW

SEQ ID NO: 36023 - protein, 11 aa, Neisseria
QTALRDIIKHT

SEQ ID NO: 36024 - protein, 6 aa, Neisseria
GVAANS

SEQ ID NO: 36025 - protein, 5 aa, Neisseria
DEPEW

SEQ ID NO: 36026 - protein, 15 aa, Neisseria
QAVRLIRRFVEFWDR

SEQ ID NO: 36027 - protein, 9 aa, Neisseria
QPDFAKDPE

SEQ ID NO: 36028 - protein, 8 aa, Neisseria
LANPRDPE

SEQ ID NO: 36029 - protein, 8 aa, Neisseria
LEEYISPF

SEQ ID NO: 36030 - protein, 15 aa, Neisseria
MSQNQPAQPTKRNLF

SEQ ID NO: 36031 - protein, 23 aa, Neisseria
YFGGKKQGETAERTAESQHSPQA

SEQ ID NO: 36032 - protein, 9 aa, Neisseria
AQSAKQLEN

SEQ ID NO: 36033 - protein, 19 aa, Neisseria
TQGGEYQDGDDKLPSAGSG

SEQ ID NO: 36034 - protein, 7 aa, Neisseria
FNPDGLT

SEQ ID NO: 36035 - protein, 16 aa, Neisseria
SLFDGRFGLKDKKTVH

SEQ ID NO: 36036 - protein, 21 aa, Neisseria
QEMRDFPNDKLQKSWCDGDLS

SEQ ID NO: 36037 - protein, 5 aa, Neisseria
TPETC

SEQ ID NO: 36038 - protein, 14 aa, Neisseria
IDGWQPKSEPGAMA

SEQ ID NO: 36039 - protein, 20 aa, Neisseria
LGFRDGTGNPKVSDPKTADE

SEQ ID NO: 36040 - protein, 15 aa, Neisseria
SLDEPEWAKNGSYQA

SEQ ID NO: 36041 - protein, 6 aa, Neisseria
RLIRRF

SEQ ID NO: 36042 - protein, 62 aa, Neisseria
FWDRTPLQEQTDIFGRRKYSGAPMDGKKEADQPDFAKDPEGDITPKDSHMRLANPRDPEFLK

SEQ ID NO: 36043 - protein, 14 aa, Neisseria
AYSYSRGPASSGQL

SEQ ID NO: 36044 - protein, 9 aa, Neisseria
LNGEPLEEY

SEQ ID NO: 36045 - protein, 7 aa, Neisseria
GVGKGGF

SEQ ID NO: 36046 - protein, 8 aa, Neisseria
QPTKRNLF

SEQ ID NO: 36047 - protein, 17 aa, Neisseria
GGKKQGETAERTAESQH

SEQ ID NO: 36048 - protein, 9 aa, Neisseria
AQSAKQLEN

SEQ ID NO: 36049 - protein, 12 aa, Neisseria
GEYQDGDDKLPS

SEQ ID NO: 36050 - protein, 10 aa, Neisseria
FGLKDKKTVH

SEQ ID NO: 36051 - protein, 20 aa, Neisseria
QEMRDFPNDKLQKSWCDGDL

SEQ ID NO: 36052 - protein, 11 aa, Neisseria
WQPKSEPGAMA

SEQ ID NO: 36053 - protein, 16 aa, Neisseria
RDGTGNPKVSDPKTAD

SEQ ID NO: 36054 - protein, 9 aa, Neisseria
SLDEPEWAK

SEQ ID NO: 36055 - protein, 6 aa, Neisseria
RLIRRF

SEQ ID NO: 36056 - protein, 16 aa, Neisseria
TPLQEQTDIFGRRKYS

SEQ ID NO: 36057 - protein, 28 aa, Neisseria
PMDGKKEADQPDFAKDPEGDITPKDSHM

SEQ ID NO: 36058 - protein, 10 aa, Neisseria
ANPRDPEFLK

SEQ ID NO: 36059 - protein, 5 aa, Neisseria
RGPAS

SEQ ID NO: 36060 - protein, 6 aa, Neisseria
EPLEEY

SEQ ID NO: 36061 - protein, 388 aa, Neisseria
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMTVTLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 36062 - protein, 323 aa, Neisseria
VKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 36063 - protein, 154 aa, Neisseria
NNRNTRYAALGKRVMEGVETEISGAITPKWQIHAGYSYLHSQIKTAANPRDDGIFLLVPKHSANLWTTYQVTPGLTVGGGVNAMSGITSSAGMHAGGYATFDAMAAYRFTPKLKLQINADNIFNRHYYARVGGTNTFNIPGSERSLTANLRYSF

SEQ ID NO: 36064 - protein, 14 aa, Neisseria
GKIEVLEFFGYFCV

SEQ ID NO: 36065 - protein, 10 aa, Neisseria
GLARMAAAVK

SEQ ID NO: 36066 - protein, 11 aa, Neisseria
KKLMRAYDSPE

SEQ ID NO: 36067 - protein, 6 aa, Neisseria
KLTEQY

SEQ ID NO: 36068 - protein, 13 aa, Neisseria
FDGGVHTIKELVA

SEQ ID NO: 36069 - protein, 8 aa, Neisseria
TEGEDYLV

SEQ ID NO: 36070 - protein, 14 aa, Neisseria
DKPIPQEQPGKIEV

SEQ ID NO: 36071 - protein, 12 aa, Neisseria
LGKALPSDTYLR

SEQ ID NO: 36072 - protein, 8 aa, Neisseria
LSGLKYQA

SEQ ID NO: 36073 - protein, 13 aa, Neisseria
YEQKIRLENRAVA

SEQ ID NO: 36074 - protein, 20 aa, Neisseria
LSQKGFDGKKLMRAYDSPEA

SEQ ID NO: 36075 - protein, 15 aa, Neisseria
KMQKLTEQYGIDSTP

SEQ ID NO: 36076 - protein, 7 aa, Neisseria
VGGKYRV

SEQ ID NO: 36077 - protein, 8 aa, Neisseria
FNNGFDGG

SEQ ID NO: 36078 - protein, 18 aa, Neisseria
LVAKVREERKRQTPAVQK

SEQ ID NO: 36079 - protein, 5 aa, Neisseria
TEGED

SEQ ID NO: 36080 - protein, 13 aa, Neisseria
KPIPQEQPGKIEV

SEQ ID NO: 36081 - protein, 13 aa, Neisseria
YEQKIRLENRAVA

SEQ ID NO: 36082 - protein, 17 aa, Neisseria
KGFDGKKLMRAYDSPEA

SEQ ID NO: 36083 - protein, 7 aa, Neisseria
KMQKLTE

SEQ ID NO: 36084 - protein, 18 aa, Neisseria
LVAKVREERKRQTPAVQK

SEQ ID NO: 36085 - protein, 119 aa, Neisseria
MNIKQLITAALIASAAFATQAAPQKPVSAAQTAQHSAVWIDVRSEQEFSEGHLHNAVNIPVDQIVRRIYEAAPDKDTPVNLYCRSGRRAEAALQELKKAGYTNVANHGGYEDLLKKGMK

SEQ ID NO: 36086 - protein, 491 aa, Neisseria
LIMVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 36087 - protein, 186 aa, Neisseria
MNRLLLLSAAVLPTACGSGETDKIGRASTVFNMLGKNDRIEVEGFDDPDVQGVACYISYAKKGGLKEMVNLEEDASDASVSCVQTASSISFDETAVRKPKEVFKRGTGFAFKSRQIVRYYDPKRKAFAYLVYSDKIVQGSPKNSLSAVSCFGSGIPQTDGVQADTSGKLLAGACIISNPIKNPDKR

SEQ ID NO: 36088 - protein, 5 aa, Neisseria
SIAHT

SEQ ID NO: 36089 - protein, 8 aa, Neisseria
IQDLFDGA

SEQ ID NO: 36090 - protein, 7 aa, Neisseria
GIANIGN

SEQ ID NO: 36091 - protein, 9 aa, Neisseria
LQDTVDRLP

SEQ ID NO: 36092 - protein, 9 aa, Neisseria
RFISRLDGS

SEQ ID NO: 36093 - protein, 5 aa, Neisseria
NGTFD

SEQ ID NO: 36094 - protein, 6 aa, Neisseria
YLDEFR

SEQ ID NO: 36095 - protein, 12 aa, Neisseria
KIFPDILGRLSG

SEQ ID NO: 36096 - protein, 8 aa, Neisseria
LQDLFGFH

SEQ ID NO: 36097 - protein, 5 aa, Neisseria
GLSGK

SEQ ID NO: 36098 - protein, 11 aa, Neisseria
ISDGISRHIDT

SEQ ID NO: 36099 - protein, 12 aa, Neisseria
FTPENIRSRLQQ

SEQ ID NO: 36100 - protein, 8 aa, Neisseria
HTHRKISF

SEQ ID NO: 36101 - protein, 13 aa, Neisseria
ADIRRRLLPRPTV

SEQ ID NO: 36102 - protein, 9 aa, Neisseria
TITEPDGGR

SEQ ID NO: 36103 - protein, 8 aa, Neisseria
VSVKETKI

SEQ ID NO: 36104 - protein, 8 aa, Neisseria
LWSDRIQV

SEQ ID NO: 36105 - protein, 10 aa, Neisseria
ALTRDRNGAW

SEQ ID NO: 36106 - protein, 13 aa, Neisseria
DLFDGAKHSASVN

SEQ ID NO: 36107 - protein, 8 aa, Neisseria
IVENSTVR

SEQ ID NO: 36108 - protein, 15 aa, Neisseria
LQSPDSSGQQFESSG

SEQ ID NO: 36109 - protein, 9 aa, Neisseria
VPWKSRGLF

SEQ ID NO: 36110 - protein, 10 aa, Neisseria
DGIGTPEISP

SEQ ID NO: 36111 - protein, 9 aa, Neisseria
ASTSLDGHG

SEQ ID NO: 36112 - protein, 15 aa, Neisseria
TTGSPSVRFNAGGAD

SEQ ID NO: 36113 - protein, 7 aa, Neisseria
LRADTSF

SEQ ID NO: 36114 - protein, 11 aa, Neisseria
LKNNSIKTGTV

SEQ ID NO: 36115 - protein, 19 aa, Neisseria
AGGEYARWDGSFKLDKANL

SEQ ID NO: 36116 - protein, 15 aa, Neisseria
GNAEISGSFKTPRLQ

SEQ ID NO: 36117 - protein, 11 aa, Neisseria
WSRDNGLDAPR

SEQ ID NO: 36118 - protein, 19 aa, Neisseria
DTVDRLPQPRFISRLDGSL

SEQ ID NO: 36119 - protein, 11 aa, Neisseria
ELNGTFDRQPV

SEQ ID NO: 36120 - protein, 10 aa, Neisseria
KYTREGAPHL

SEQ ID NO: 36121 - protein, 10 aa, Neisseria
DEFRQQNGKI

SEQ ID NO: 36122 - protein, 10 aa, Neisseria
LGRLSGNVEA

SEQ ID NO: 36123 - protein, 7 aa, Neisseria
LQLDDME

SEQ ID NO: 36124 - protein, 9 aa, Neisseria
LHADKDHIA

SEQ ID NO: 36125 - protein, 16 aa, Neisseria
SRFKSGLYGGHTEGGI

SEQ ID NO: 36126 - protein, 15 aa, Neisseria
NTRPATYRLQQNASN

SEQ ID NO: 36127 - protein, 9 aa, Neisseria
SFSGNGDAV

SEQ ID NO: 36128 - protein, 18 aa, Neisseria
TASGENRKQLIRSLQGSL

SEQ ID NO: 36129 - protein, 5 aa, Neisseria
ISNGA

SEQ ID NO: 36130 - protein, 16 aa, Neisseria
DMDSILKNGLSGKISG

SEQ ID NO: 36131 - protein, 14 aa, Neisseria
LNSEISDGISRHID

SEQ ID NO: 36132 - protein, 13 aa, Neisseria
NGYTNLDTQELSE

SEQ ID NO: 36133 - protein, 10 aa, Neisseria
AVHPKNKPIP

SEQ ID NO: 36134 - protein, 30 aa, Neisseria
GTVDKPSITVDYGRLTGGINSRKEKQKILE

SEQ ID NO: 36135 - protein, 6 aa, Neisseria
LKPKEP

SEQ ID NO: 36136 - protein, 8 aa, Neisseria
ENIRSRLQ

SEQ ID NO: 36137 - protein, 7 aa, Neisseria
THRKISF

SEQ ID NO: 36138 - protein, 9 aa, Neisseria
ADIRRRLLP

SEQ ID NO: 36139 - protein, 7 aa, Neisseria
TEPDGGR

SEQ ID NO: 36140 - protein, 8 aa, Neisseria
VSVKETKI

SEQ ID NO: 36141 - protein, 8 aa, Neisseria
ALTRDRNG

SEQ ID NO: 36142 - protein, 11 aa, Neisseria
DLFDGAKHSAS

SEQ ID NO: 36143 - protein, 11 aa, Neisseria
QSPDSSGQQFE

SEQ ID NO: 36144 - protein, 7 aa, Neisseria
LRADTSF

SEQ ID NO: 36145 - protein, 8 aa, Neisseria
FKLDKANL

SEQ ID NO: 36146 - protein, 6 aa, Neisseria
FKTPRL

SEQ ID NO: 36147 - protein, 9 aa, Neisseria
RDNGLDAPR

SEQ ID NO: 36148 - protein, 8 aa, Neisseria
DTVDRLPQ

SEQ ID NO: 36149 - protein, 7 aa, Neisseria
FISRLDG

SEQ ID NO: 36150 - protein, 8 aa, Neisseria
GTFDRQPV

SEQ ID NO: 36151 - protein, 8 aa, Neisseria
KYTREGAP

SEQ ID NO: 36152 - protein, 7 aa, Neisseria
DEFRQQN

SEQ ID NO: 36153 - protein, 6 aa, Neisseria
QLDDME

SEQ ID NO: 36154 - protein, 9 aa, Neisseria
LHADKDHIA

SEQ ID NO: 36155 - protein, 10 aa, Neisseria
ASGENRKQLI

SEQ ID NO: 36156 - protein, 11 aa, Neisseria
EISDGISRHID

SEQ ID NO: 36157 - protein, 7 aa, Neisseria
DTQELSE

SEQ ID NO: 36158 - protein, 9 aa, Neisseria
VHPKNKPIP

SEQ ID NO: 36159 - protein, 8 aa, Neisseria
GTVDKPSI

SEQ ID NO: 36160 - protein, 12 aa, Neisseria
INSRKEKQKILE

SEQ ID NO: 36161 - protein, 5 aa, Neisseria
KPKEP

SEQ ID NO: 36162 - protein, 297 aa, Neisseria
VFGTVLRTDADCLQIIVVGKFFQVVAYGFAALAEGEFHQFGEMIEIVRLADTVFHRNHAHHCGIDFRRGIERFGRHVNQQLHIEKILQHHTQATVVVAFRRGNHALDHFFLQHKVHIGDIVRHLRQFEQKRRGDVIRQVADDFLFADAVEIKLQHVAFVNHQFIRKRQRFQTAYDVAVDFDNVQAVQLFRQRFGNCRQTRADFNHDIIRLRAHGVDNIADNPRVLQKILPETLAGFVFFHRVSSSVETPPFRAAGSDSVWAGRNPFQIRTTHRAVLYVSSCVLEHKCVYSIRLMSAL

SEQ ID NO: 36163 - protein, 7 aa, Neisseria
ASCASVL

SEQ ID NO: 36164 - protein, 7 aa, Neisseria
VRLSNEV

SEQ ID NO: 36165 - protein, 5 aa, Neisseria
VQKLD

SEQ ID NO: 36166 - protein, 18 aa, Neisseria
VETAQNLYNQALKHYQNG

SEQ ID NO: 36167 - protein, 7 aa, Neisseria
CESVIEI

SEQ ID NO: 36168 - protein, 8 aa, Neisseria
YANRFKDS

SEQ ID NO: 36169 - protein, 14 aa, Neisseria
ARATWRSLIQTYPG

SEQ ID NO: 36170 - protein, 21 aa, Neisseria
PVPEGSRTEMPTQENASDGIP

SEQ ID NO: 36171 - protein, 9 aa, Neisseria
LQDRLDYLE

SEQ ID NO: 36172 - protein, 42 aa, Neisseria; identical to SEQ ID NO: 35152

SEQ ID NO: 36173 - protein, 9 aa, Neisseria
YLNTEGGSA

SEQ ID NO: 36174 - protein, 10 aa, Neisseria
ALKHYQNGRF

SEQ ID NO: 36175 - protein, 13 aa, Neisseria
KGADGGDGGSIAQ

SEQ ID NO: 36176 - protein, 9 aa, Neisseria
QSRARMGNC

SEQ ID NO: 36177 - protein, 15 aa, Neisseria
IGGRYANRFKDSPTA

SEQ ID NO: 36178 - protein, 5 aa, Neisseria
GECQY

SEQ ID NO: 36179 - protein, 7 aa, Neisseria
LQQKDIA

SEQ ID NO: 36180 - protein, 17 aa, Neisseria
YPGSPAAKRAAAAVRKR

SEQ ID NO: 36181 - protein, 16 aa, Neisseria
PEGSRTEMPTQENASD

SEQ ID NO: 36182 - protein, 9 aa, Neisseria
LQDRLDYLE

SEQ ID NO: 36183 - protein, 28 aa, Neisseria
KIVRLSNEVEMLNGKVKALEHTKIHPSG

SEQ ID NO: 36184 - protein, 12 aa, Neisseria
YVQKLDDRKLKE

SEQ ID NO: 36185 - protein, 13 aa, Neisseria
KGADGGDGGSIAQ

SEQ ID NO: 36186 - protein, 7 aa, Neisseria
SRARMGN

SEQ ID NO: 36187 - protein, 11 aa, Neisseria
YANRFKDSPTA

SEQ ID NO: 36188 - protein, 5 aa, Neisseria
GECQY

SEQ ID NO: 36189 - protein, 7 aa, Neisseria
LQQKDIA

SEQ ID NO: 36190 - protein, 13 aa, Neisseria
PAAKRAAAAVRKR

SEQ ID NO: 36191 - protein, 7 aa, Neisseria
LENGTHS

SEQ ID NO: 36192 - protein, 4 aa, Neisseria
LRRI

SEQ ID NO: 36193 - protein, 6 aa, Neisseria
AFAQFC

SEQ ID NO: 36194 - protein, 15 aa, Neisseria
VGKHLRKFRRFRRRG

SEQ ID NO: 36195 - protein, 24 aa, Neisseria
VGLFRLARLFHVGNDFVDRFLGFF

SEQ ID NO: 36196 - protein, 6 aa, Neisseria
FGHFAS

SEQ ID NO: 36197 - protein, 24 aa, Neisseria
GEEFLETVVEAAGNVARHFDVLDL

SEQ ID NO: 36198 - protein, 6 aa, Neisseria
SHQNRI

SEQ ID NO: 36199 - protein, 9 aa, Neisseria
HQTLGGDAG

SEQ ID NO: 36200 - protein, 7 aa, Neisseria
VQLHHFG

SEQ ID NO: 36201 - protein, 14 aa, Neisseria
GKPSGGNGLGGLVN

SEQ ID NO: 36202 - protein, 9 aa, Neisseria
DGADVVAQM

SEQ ID NO: 36203 - protein, 8 aa, Neisseria
LRRIRGQC

SEQ ID NO: 36204 - protein, 11 aa, Neisseria
FGVDFRRRKFF

SEQ ID NO: 36205 - protein, 17 aa, Neisseria
KHLRKFRRFRRRGEGFI

SEQ ID NO: 36206 - protein, 5 aa, Neisseria
FKQRA

SEQ ID NO: 36207 - protein, 7 aa, Neisseria
VGNDFVD

SEQ ID NO: 36208 - protein, 8 aa, Neisseria
FPKRNGIA

SEQ ID NO: 36209 - protein, 8 aa, Neisseria
SVQTDQEF

SEQ ID NO: 36210 - protein, 8 aa, Neisseria
FGQGEEFL

SEQ ID NO: 36211 - protein, 5 aa, Neisseria
AAGNV

SEQ ID NO: 36212 - protein, 9 aa, Neisseria
VAPDGDFVG

SEQ ID NO: 36213 - protein, 16 aa, Neisseria
QNVGSHQNRITEQTHF

SEQ ID NO: 36214 - protein, 9 aa, Neisseria
LGGDAGQNP

SEQ ID NO: 36215 - protein, 12 aa, Neisseria
VESAGKPSGGNG

SEQ ID NO: 36216 - protein, 10 aa, Neisseria
VVIGEEEEGF

SEQ ID NO: 36217 - protein, 13 aa, Neisseria
VLRRADGGADGAD

SEQ ID NO: 36218 - protein, 10 aa, Neisseria
MRGAGGGYAG

SEQ ID NO: 36219 - protein, 10 aa, Neisseria
MPSEREKMRR

SEQ ID NO: 36220 - protein, 5 aa, Neisseria
PADNR

SEQ ID NO: 36221 - protein, 5 aa, Neisseria
ERTYP

SEQ ID NO: 36222 - protein, 6 aa, Neisseria
LRRIRG

SEQ ID NO: 36223 - protein, 8 aa, Neisseria
DFRRRKFF

SEQ ID NO: 36224 - protein, 15 aa, Neisseria
KHLRKFRRFRRRGEG

SEQ ID NO: 36225 - protein, 5 aa, Neisseria
PKRNG

SEQ ID NO: 36226 - protein, 6 aa, Neisseria
QTDQEF

SEQ ID NO: 36227 - protein, 6 aa, Neisseria
QGEEFL

SEQ ID NO: 36228 - protein, 9 aa, Neisseria
VAPDGDFVG

SEQ ID NO: 36229 - protein, 7 aa, Neisseria
HQNRITE

SEQ ID NO: 36230 - protein, 7 aa, Neisseria
LGGDAGQ

SEQ ID NO: 36231 - protein, 7 aa, Neisseria
SAGKPSG

SEQ ID NO: 36232 - protein, 10 aa, Neisseria
VVIGEEEEGF

SEQ ID NO: 36233 - protein, 13 aa, Neisseria
VLRRADGGADGAD

SEQ ID NO: 36234 - protein, 10 aa, Neisseria
MPSEREKMRR

SEQ ID NO: 36235 - protein, 10 aa, Neisseria
AVGHFADVPA

SEQ ID NO: 36236 - protein, 8 aa, Neisseria
LTIKRVHG

SEQ ID NO: 36237 - protein, 6 aa, Neisseria
DAVGGG

SEQ ID NO: 36238 - protein, 6 aa, Neisseria
FGDFGD

SEQ ID NO: 36239 - protein, 5 aa, Neisseria
ARRLD

SEQ ID NO: 36240 - protein, 9 aa, Neisseria
DVAHFLGGA

SEQ ID NO: 36241 - protein, 9 aa, Neisseria
RRIRHLFGV

SEQ ID NO: 36242 - protein, 10 aa, Neisseria
GKITAVQGFS

SEQ ID NO: 36243 - protein, 9 aa, Neisseria
RPTEAAEGF

SEQ ID NO: 36244 - protein, 14 aa, Neisseria
RKCDGVVDKITADV

SEQ ID NO: 36245 - protein, 13 aa, Neisseria
MPSEPERRHGNTA

SEQ ID NO: 36246 - protein, 10 aa, Neisseria
FSGKPFKITG

SEQ ID NO: 36247 - protein, 9 aa, Neisseria
VVLRRRIVQ

SEQ ID NO: 36248 - protein, 13 aa, Neisseria
AHTDGLTIKRVHG

SEQ ID NO: 36249 - protein, 5 aa, Neisseria
QNGGS

SEQ ID NO: 36250 - protein, 8 aa, Neisseria
  VARIANT 7: Xaa is any amino acid
QTQGRRXN

SEQ ID NO: 36251 - protein, 9 aa, Neisseria
IAEKPRPAL

SEQ ID NO: 36252 - protein, 23 aa, Neisseria
LFEDGGGFLRRSDVAVDPGRDVQ

SEQ ID NO: 36253 - protein, 12 aa, Neisseria
RARAPVNGKGGN

SEQ ID NO: 36254 - protein, 7 aa, Neisseria
DFGDGGQ

SEQ ID NO: 36255 - protein, 22 aa, Neisseria
FEGNGYARRLDHRLQNGGNQRL

SEQ ID NO: 36256 - protein, 18 aa, Neisseria
IDVDDLRPESDVVTRRIR

SEQ ID NO: 36257 - protein, 8 aa, Neisseria
GNLHGNDA

SEQ ID NO: 36258 - protein, 10 aa, Neisseria
FSGIPERRIA

SEQ ID NO: 36259 - protein, 15 aa, Neisseria
AHRPTCAKRPTEAAE

SEQ ID NO: 36260 - protein, 16 aa, Neisseria
ARHRRKCDGVVDKITA

SEQ ID NO: 36261 - protein, 11 aa, Neisseria
VHNGPAFQKSA

SEQ ID NO: 36262 - protein, 11 aa, Neisseria
MPSEPERRHGN

SEQ ID NO: 36263 - protein, 7 aa, Neisseria
KPFKITG

SEQ ID NO: 36264 - protein, 9 aa, Neisseria
VVLRRRIVQ

SEQ ID NO: 36265 - protein, 8 aa, Neisseria
LTIKRVHG

SEQ ID NO: 36266 - protein, 6 aa, Neisseria
  VARIANT 5: Xaa is any amino acid
QGRRXN

SEQ ID NO: 36267 - protein, 9 aa, Neisseria
IAEKPRPAL

SEQ ID NO: 36268 - protein, 23 aa, Neisseria
LFEDGGGFLRRSDVAVDPGRDVQ

SEQ ID NO: 36269 - protein, 12 aa, Neisseria
RARAPVNGKGGN

SEQ ID NO: 36270 - protein, 12 aa, Neisseria
GYARRLDHRLQN

SEQ ID NO: 36271 - protein, 18 aa, Neisseria
IDVDDLRPESDVVTRRIR

SEQ ID NO: 36272 - protein, 7 aa, Neisseria
IPERRIA

SEQ ID NO: 36273 - protein, 12 aa, Neisseria
PTCAKRPTEAAE

SEQ ID NO: 36274 - protein, 16 aa, Neisseria
ARHRRKCDGVVDKITA

SEQ ID NO: 36275 - protein, 436 aa, Neisseria
MMQHNRFFAVGAGGDDGDRRAADFFNPFQICFGIGRQCVVAFHADSRFAPAGHGFVNRFAGFHRIRTARQDVGFAAAWQFVADADIDGFNAVHYIEFGNAHTGNAVDLDGAFQGGGIKPAAAARAAGYRTEFVSALRQTCAYFVEQFGRERARTDARGIGFDDAQNIIQHLRTYARACRSRAGETVGRGNEGVSAVVDVQQRTLRAFKQQFFAVFVFFVQHAGHVGNHRRNARRDFFDNRHHVFRFNRSGVMQVLELDVVIGKDGIQFFTQFFRMQQIGGANGAACHFVFVGRADAAAGRADFAFAARCFAGLVERDVVRQDQRAGRRDFQTAFDVFHACRVQLVDFAQQGFGGNDNARTDEAIQSFVQDTARNQAQNGFFAADDQGMARIVAALEAHDAAGFFRQPVNDFTFTLVAPLCADYYNIFSHSHITYRY

SEQ ID NO: 36276 - protein, 9 aa, Neisseria
MKKPTDTLP

SEQ ID NO: 36277 - protein, 9 aa, Neisseria
DDVASVMRS

SEQ ID NO: 36278 - protein, 11 aa, Neisseria
KEGERWLSAMS

SEQ ID NO: 36279 - protein, 7 aa, Neisseria
RLARFVP

SEQ ID NO: 36280 - protein, 5 aa, Neisseria
GARGL

SEQ ID NO: 36281 - protein, 8 aa, Neisseria
NYIGKPAH

SEQ ID NO: 36282 - protein, 21 aa, Neisseria
LRHYRNLEKGDIVRALARFNG

SEQ ID NO: 36283 - protein, 7 aa, Neisseria
LQRRRLL

SEQ ID NO: 36284 - protein, 14 aa, Neisseria
GAQREETLADDVAS

SEQ ID NO: 36285 - protein, 21 aa, Neisseria
SVGSVNPPRLVFDNPKEGERW

SEQ ID NO: 36286 - protein, 12 aa, Neisseria
RFVPDEGERRRL

SEQ ID NO: 36287 - protein, 9 aa, Neisseria
QYESSRAGL

SEQ ID NO: 36288 - protein, 6 aa, Neisseria
EVESAF

SEQ ID NO: 36289 - protein, 9 aa, Neisseria
NYIGKPAHN

SEQ ID NO: 36290 - protein, 7 aa, Neisseria
RTNLRYG

SEQ ID NO: 36291 - protein, 10 aa, Neisseria
YRNLEKGDIV

SEQ ID NO: 36292 - protein, 12 aa, Neisseria
NGSLGSNKYPNA

SEQ ID NO: 36293 - protein, 7 aa, Neisseria
WRNRWQW

SEQ ID NO: 36294 - protein, 5 aa, Neisseria
ERTYP

SEQ ID NO: 36295 - protein, 6 aa, Neisseria
MKKPTD

SEQ ID NO: 36296 - protein, 7 aa, Neisseria
LQRRRLL

SEQ ID NO: 36297 - protein, 14 aa, Neisseria
GAQREETLADDVAS

SEQ ID NO: 36298 - protein, 12 aa, Neisseria
LVFDNPKEGERW

SEQ ID NO: 36299 - protein, 10 aa, Neisseria
VPDEGERRRL

SEQ ID NO: 36300 - protein, 7 aa, Neisseria
ESSRAGL

SEQ ID NO: 36301 - protein, 6 aa, Neisseria
EVESAF

SEQ ID NO: 36302 - protein, 9 aa, Neisseria
RNLEKGDIV

SEQ ID NO: 36303 - protein, 5 aa, Neisseria
TAAEL

SEQ ID NO: 36304 - protein, 19 aa, Neisseria
TDCYRSYDVLDVSEFSHFS

SEQ ID NO: 36305 - protein, 12 aa, Neisseria
KSRLSRYKQNKL

SEQ ID NO: 36306 - protein, 7 aa, Neisseria
GINKNTA

SEQ ID NO: 36307 - protein, 5 aa, Neisseria
QNGPH

SEQ ID NO: 36308 - protein, 27 aa, Neisseria
FDGEVEADESYFGGQRKGKRGRGAAGK

SEQ ID NO: 36309 - protein, 8 aa, Neisseria
LLKRNGKV

SEQ ID NO: 36310 - protein, 11 aa, Neisseria
IREQVKPDSIV

SEQ ID NO: 36311 - protein, 8 aa, Neisseria
TDCYRSYD

SEQ ID NO: 36312 - protein, 6 aa, Neisseria
RTTKPY

SEQ ID NO: 36313 - protein, 11 aa, Neisseria
KSRLSRYKQNK

SEQ ID NO: 36314 - protein, 11 aa, Neisseria
FDGEVEADESY

SEQ ID NO: 36315 - protein, 13 aa, Neisseria
GQRKGKRGRGAAG

SEQ ID NO: 36316 - protein, 6 aa, Neisseria
LKRNGK

SEQ ID NO: 36317 - protein, 9 aa, Neisseria
IREQVKPDS

SEQ ID NO: 36318 - protein, 5 aa, Neisseria
QDGSG

SEQ ID NO: 36319 - protein, 20 aa, Neisseria
TYQDGSGKTAVRAKCSTGTP

SEQ ID NO: 36320 - protein, 37 aa, Neisseria
QDGRGSKKVDCDEYGGERRAVLRNQKRGKPATRRAAT

SEQ ID NO: 36321 - protein, 27 aa, Neisseria
GKPSFRARDGGGRVNRAETGEGKRSAR

SEQ ID NO: 36322 - protein, 16 aa, Neisseria
YQDGSGKTAVRAKCST

SEQ ID NO: 36323 - protein, 36 aa, Neisseria
DGRGSKKVDCDEYGGERRAVLRNQKRGKPATRRAAT

SEQ ID NO: 36324 - protein, 25 aa, Neisseria
PSFRARDGGGRVNRAETGEGKRSAR

SEQ ID NO: 36325 - protein, 6 aa, Neisseria
SAERQI

SEQ ID NO: 36326 - protein, 7 aa, Neisseria
KAVKMLE

SEQ ID NO: 36327 - protein, 6 aa, Neisseria
AYKDGR

SEQ ID NO: 36328 - protein, 32 aa, Neisseria; identical to SEQ ID NO: 12308

SEQ ID NO: 36329 - protein, 14 aa, Neisseria
DVDADDYWGKPVLE

SEQ ID NO: 36330 - protein, 10 aa, Neisseria
EAYKDGREYD

SEQ ID NO: 36331 - protein, 12 aa, Neisseria
PDLKIIKEQLDR

SEQ ID NO: 36332 - protein, 8 aa, Neisseria
DSAERQIY

SEQ ID NO: 36333 - protein, 18 aa, Neisseria
PHFEQNRTKAVKMLEQRG

SEQ ID NO: 36334 - protein, 8 aa, Neisseria
DVDADDYW

SEQ ID NO: 36335 - protein, 10 aa, Neisseria
EAYKDGREYD

SEQ ID NO: 36336 - protein, 9 aa, Neisseria
KIIKEQLDR

SEQ ID NO: 36337 - protein, 8 aa, Neisseria
LEFWVGLF

SEQ ID NO: 36338 - protein, 9 aa, Neisseria
VYADFGDIG

SEQ ID NO: 36339 - protein, 5 aa, Neisseria
VSAQI

SEQ ID NO: 36340 - protein, 7 aa, Neisseria
GDTENLA

SEQ ID NO: 36341 - protein, 10 aa, Neisseria
NLIGKFMTSF

SEQ ID NO: 36342 - protein, 5 aa, Neisseria
MKKNI

SEQ ID NO: 36343 - protein, 7 aa, Neisseria
GGSDKTY

SEQ ID NO: 36344 - protein, 13 aa, Neisseria
GDIGGLKVNAPVK

SEQ ID NO: 36345 - protein, 24 aa, Neisseria
LDPKSYQARVRLDLDGKYQFSSDV

SEQ ID NO: 36346 - protein, 6 aa, Neisseria
TSGLLG

SEQ ID NO: 36347 - protein, 8 aa, Neisseria
QQGGDTEN

SEQ ID NO: 36348 - protein, 16 aa, Neisseria
FAEKNAEGGNAEKAAE

SEQ ID NO: 36349 - protein, 5 aa, Neisseria
MKKNI

SEQ ID NO: 36350 - protein, 5 aa, Neisseria
GSDKT

SEQ ID NO: 36351 - protein, 16 aa, Neisseria
LDPKSYQARVRLDLDG

SEQ ID NO: 36352 - protein, 7 aa, Neisseria
QGGDTEN

SEQ ID NO: 36353 - protein, 16 aa, Neisseria
FAEKNAEGGNAEKAAE

SEQ ID NO: 36354 - protein, 9 aa, Neisseria
SPADAVGQI

SEQ ID NO: 36355 - protein, 22 aa, Neisseria
DFQRMTALAVGNPWRTASDAQK

SEQ ID NO: 36356 - protein, 6 aa, Neisseria
KEFQTL

SEQ ID NO: 36357 - protein, 19 aa, Neisseria
YRNQFGEIIKAKGIDGLIA

SEQ ID NO: 36358 - protein, 5 aa, Neisseria
VKKSS

SEQ ID NO: 36359 - protein, 5 aa, Neisseria
SPADA

SEQ ID NO: 36360 - protein, 7 aa, Neisseria
IRQNATQ

SEQ ID NO: 36361 - protein, 15 aa, Neisseria
LKSGDAASARPKAEA

SEQ ID NO: 36362 - protein, 18 aa, Neisseria
NPWRTASDAQKQALAKEF

SEQ ID NO: 36363 - protein, 5 aa, Neisseria
LKFKN

SEQ ID NO: 36364 - protein, 17 aa, Neisseria
NVKDNPIVNKGGKEIVV

SEQ ID NO: 36365 - protein, 9 aa, Neisseria
IPGQKPVNM

SEQ ID NO: 36366 - protein, 10 aa, Neisseria
TYQSGGKYRT

SEQ ID NO: 36367 - protein, 5 aa, Neisseria
YRNQF

SEQ ID NO: 36368 - protein, 7 aa, Neisseria
IKAKGID

SEQ ID NO: 36369 - protein, 8 aa, Neisseria
LKAKNGGK

SEQ ID NO: 36370 - protein, 5 aa, Neisseria
VKKSS

SEQ ID NO: 36371 - protein, 5 aa, Neisseria
IRQNA

SEQ ID NO: 36372 - protein, 14 aa, Neisseria
KSGDAASARPKAEA

SEQ ID NO: 36373 - protein, 14 aa, Neisseria
TASDAQKQALAKEF

SEQ ID NO: 36374 - protein, 5 aa, Neisseria
LKFKN

SEQ ID NO: 36375 - protein, 8 aa, Neisseria
NVKDNPIV

SEQ ID NO: 36376 - protein, 8 aa, Neisseria
KGGKEIVV

SEQ ID NO: 36377 - protein, 7 aa, Neisseria
IKAKGID

SEQ ID NO: 36378 - protein, 8 aa, Neisseria
LKAKNGGK

SEQ ID NO: 36379 - protein, 22 aa, Neisseria
ETRPADPYEGYNRAVSKFNDQA

SEQ ID NO: 36380 - protein, 9 aa, Neisseria
RGYRKVTPK

SEQ ID NO: 36381 - protein, 14 aa, Neisseria
GVSNFFNNLRDVVS

SEQ ID NO: 36382 - protein, 9 aa, Neisseria
LGGLIDIAG

SEQ ID NO: 36383 - protein, 13 aa, Neisseria
VRDALGTGITSVY

SEQ ID NO: 36384 - protein, 10 aa, Neisseria
DLTDSLDEAA

SEQ ID NO: 36385 - protein, 5 aa, Neisseria
LVESA

SEQ ID NO: 36386 - protein, 5 aa, Neisseria
SETQA

SEQ ID NO: 36387 - protein, 5 aa, Neisseria
MKKTA

SEQ ID NO: 36388 - protein, 26 aa, Neisseria
AETRPADPYEGYNRAVSKFNDQADRY

SEQ ID NO: 36389 - protein, 15 aa, Neisseria
AARGYRKVTPKPVRA

SEQ ID NO: 36390 - protein, 11 aa, Neisseria
LDIKRASEDLV

SEQ ID NO: 36391 - protein, 12 aa, Neisseria
GGVPDNKNTLGD

SEQ ID NO: 36392 - protein, 8 aa, Neisseria
SWGWKNSN

SEQ ID NO: 36393 - protein, 7 aa, Neisseria
STVRDAL

SEQ ID NO: 36394 - protein, 5 aa, Neisseria
YPPKN

SEQ ID NO: 36395 - protein, 6 aa, Neisseria
PAGRWG

SEQ ID NO: 36396 - protein, 29 aa, Neisseria
STREGLLDLTDSLDEAAIDKYSYTRDLYM

SEQ ID NO: 36397 - protein, 34 aa, Neisseria
VRARQTGATPAEGTEDNIDIDIDELVESAETGAA

SEQ ID NO: 36398 - protein, 26 aa, Neisseria
AVHEDSVSETQAEAAGEAETQPGTQP

SEQ ID NO: 36399 - protein, 5 aa, Neisseria
MKKTA

SEQ ID NO: 36400 - protein, 13 aa, Neisseria
AETRPADPYEGYN

SEQ ID NO: 36401 - protein, 10 aa, Neisseria
AVSKFNDQAD

SEQ ID NO: 36402 - protein, 12 aa, Neisseria
RGYRKVTPKPVR

SEQ ID NO: 36403 - protein, 11 aa, Neisseria
LDIKRASEDLV

SEQ ID NO: 36404 - protein, 9 aa, Neisseria
GVPDNKNTL

SEQ ID NO: 36405 - protein, 6 aa, Neisseria
TVRDAL

SEQ ID NO: 36406 - protein, 19 aa, Neisseria
STREGLLDLTDSLDEAAID

SEQ ID NO: 36407 - protein, 7 aa, Neisseria
VRARQTG

SEQ ID NO: 36408 - protein, 26 aa, Neisseria
TPAEGTEDNIDIDIDELVESAETGAA

SEQ ID NO: 36409 - protein, 22 aa, Neisseria
AVHEDSVSETQAEAAGEAETQP

SEQ ID NO: 36410 - protein, 10 aa, Neisseria
LGILTACAAM

SEQ ID NO: 36411 - protein, 9 aa, Neisseria
AFADRISDL

SEQ ID NO: 36412 - protein, 6 aa, Neisseria
FQKTFE

SEQ ID NO: 36413 - protein, 7 aa, Neisseria
QKVRQAC

SEQ ID NO: 36414 - protein, 30 aa, Neisseria
FADRISDLEARLAQLEHRVAVLESGGNTVK

SEQ ID NO: 36415 - protein, 6 aa, Neisseria
LFGSNS

SEQ ID NO: 36416 - protein, 30 aa, Neisseria; identical to SEQ ID NO: 12395

SEQ ID NO: 36417 - protein, 12 aa, Neisseria
CGDEAIRCRKFD

SEQ ID NO: 36418 - protein, 21 aa, Neisseria
FADRISDLEARLAQLEHRVAV

SEQ ID NO: 36419 - protein, 26 aa, Neisseria
KTFEASDRNEGVARQKVRQACNRETS

SEQ ID NO: 36420 - protein, 12 aa, Neisseria
CGDEAIRCRKFD

SEQ ID NO: 36421 - protein, 9 aa, Neisseria
IVAVFALSA

SEQ ID NO: 36422 - protein, 6 aa, Neisseria
ISDRSV

SEQ ID NO: 36423 - protein, 32 aa, Neisseria; identical to SEQ ID NO: 33718

SEQ ID NO: 36424 - protein, 5 aa, Neisseria
QAEKF

SEQ ID NO: 36425 - protein, 37 aa, Neisseria; identical to SEQ ID NO: 33720

SEQ ID NO: 36426 - protein, 9 aa, Neisseria
LNGKPDQPV

SEQ ID NO: 36427 - protein, 11 aa, Neisseria
YTKLPEEPKGI

SEQ ID NO: 36428 - protein, 22 aa, Neisseria
DMGNVTDWTNPNADTEWIDAKK

SEQ ID NO: 36429 - protein, 29 aa, Neisseria
GMGAEDALPFGNKEQAEKFAKDKGGKVVG

SEQ ID NO: 36430 - protein, 5 aa, Neisseria
DDMPD

SEQ ID NO: 36431 - protein, 10 aa, Neisseria
RQAEEAPPPL

SEQ ID NO: 36432 - protein, 7 aa, Neisseria
QISDRSV

SEQ ID NO: 36433 - protein, 6 aa, Neisseria
EHNGPK

SEQ ID NO: 36434 - protein, 5 aa, Neisseria
GKPDQ

SEQ ID NO: 36435 - protein, 9 aa, Neisseria
KLPEEPKGI

SEQ ID NO: 36436 - protein, 11 aa, Neisseria
NADTEWIDAKK

SEQ ID NO: 36437 - protein, 6 aa, Neisseria
GAEDAL

SEQ ID NO: 36438 - protein, 16 aa, Neisseria
GNKEQAEKFAKDKGGK

SEQ ID NO: 36439 - protein, 5 aa, Neisseria
DDMPD

SEQ ID NO: 36440 - protein, 10 aa, Neisseria
PLAVLTALLL

SEQ ID NO: 36441 - protein, 20 aa, Neisseria
QNVLKIYNWSEYVDPETVAD

SEQ ID NO: 36442 - protein, 12 aa, Neisseria
IKAGAYQKIDKS

SEQ ID NO: 36443 - protein, 7 aa, Neisseria
RLMDGVD

SEQ ID NO: 36444 - protein, 6 aa, Neisseria
RVKKAL

SEQ ID NO: 36445 - protein, 5 aa, Neisseria
DSAAE

SEQ ID NO: 36446 - protein, 12 aa, Neisseria
NSSNTEDIREAT

SEQ ID NO: 36447 - protein, 16 aa, Neisseria
AKNVANAHKYINDFLD

SEQ ID NO: 36448 - protein, 9 aa, Neisseria
KPARDLMED

SEQ ID NO: 36449 - protein, 20 aa, Neisseria
CGGSDKPPAEKPAPAENQNV

SEQ ID NO: 36450 - protein, 21 aa, Neisseria
SEYVDPETVADFEKKNGIKVT

SEQ ID NO: 36451 - protein, 19 aa, Neisseria
YDSDETLESKVLTGKSGYD

SEQ ID NO: 36452 - protein, 34 aa, Neisseria
GAYQKIDKSMIPNYKHLNPEMMRLMDGVDPDHEY

SEQ ID NO: 36453 - protein, 18 aa, Neisseria
NTERVKKALGTDKLPDNQ

SEQ ID NO: 36454 - protein, 5 aa, Neisseria
FNPEY

SEQ ID NO: 36455 - protein, 5 aa, Neisseria
LKQCG

SEQ ID NO: 36456 - protein, 36 aa, Neisseria; identical to SEQ ID NO: 12434

SEQ ID NO: 36457 - protein, 7 aa, Neisseria
DLARGDT

SEQ ID NO: 36458 - protein, 26 aa, Neisseria
NIAKRRAEEAGGKEKIRVMMPKEGVG

SEQ ID NO: 36459 - protein, 11 aa, Neisseria
VIPKDAKNVAN

SEQ ID NO: 36460 - protein, 12 aa, Neisseria
FLDPEVSAKNGN

SEQ ID NO: 36461 - protein, 31 aa, Neisseria
YAPSSKPARDLMEDEFKNDNTIFPSGEDLKN

SEQ ID NO: 36462 - protein, 9 aa, Neisseria
QWQDVKAGK

SEQ ID NO: 36463 - protein, 16 aa, Neisseria
GGSDKPPAEKPAPAEN

SEQ ID NO: 36464 - protein, 15 aa, Neisseria
VDPETVADFEKKNGI

SEQ ID NO: 36465 - protein, 13 aa, Neisseria
YDSDETLESKVLT

SEQ ID NO: 36466 - protein, 7 aa, Neisseria
QKIDKSM

SEQ ID NO: 36467 - protein, 15 aa, Neisseria
EMMRLMDGVDPDHEY

SEQ ID NO: 36468 - protein, 18 aa, Neisseria
NTERVKKALGTDKLPDNQ

SEQ ID NO: 36469 - protein, 28 aa, Neisseria
NPNSSNTEDIREATALLKKNRPNIKRFT

SEQ ID NO: 36470 - protein, 7 aa, Neisseria
DLARGDT

SEQ ID NO: 36471 - protein, 24 aa, Neisseria
NIAKRRAEEAGGKEKIRVMMPKEG

SEQ ID NO: 36472 - protein, 8 aa, Neisseria
KDAKNVAN

SEQ ID NO: 36473 - protein, 10 aa, Neisseria
FLDPEVSAKN

SEQ ID NO: 36474 - protein, 18 aa, Neisseria
PSSKPARDLMEDEFKNDN

SEQ ID NO: 36475 - protein, 7 aa, Neisseria
SGEDLKN

SEQ ID NO: 36476 - protein, 7 aa, Neisseria
QDVKAGK

SEQ ID NO: 36477 - protein, 11 aa, Neisseria
SALYGIAAAIL

SEQ ID NO: 36478 - protein, 8 aa, Neisseria
RSIQTFPQ

SEQ ID NO: 36479 - protein, 15 aa, Neisseria
INGPDRPAGIPDPAG

SEQ ID NO: 36480 - protein, 7 aa, Neisseria
DFAKSLQ

SEQ ID NO: 36481 - protein, 12 aa, Neisseria
QDVCAQAFQTPV

SEQ ID NO: 36482 - protein, 6 aa, Neisseria
FERYFT

SEQ ID NO: 36483 - protein, 10 aa, Neisseria
LAGTVTGYYE

SEQ ID NO: 36484 - protein, 10 aa, Neisseria
GIPDDFISVP

SEQ ID NO: 36485 - protein, 11 aa, Neisseria
RGGKNLVRIRQ

SEQ ID NO: 36486 - protein, 10 aa, Neisseria
SGTIDNAGGT

SEQ ID NO: 36487 - protein, 18 aa, Neisseria
QGIKAYMRQNPQRLAEVL

SEQ ID NO: 36488 - protein, 14 aa, Neisseria
ALGTPLMGEYAGAI

SEQ ID NO: 36489 - protein, 6 aa, Neisseria
RKALNR

SEQ ID NO: 36490 - protein, 6 aa, Neisseria
MKKHLL

SEQ ID NO: 36491 - protein, 7 aa, Neisseria
CQSRSIQ

SEQ ID NO: 36492 - protein, 5 aa, Neisseria
PQPDT

SEQ ID NO: 36493 - protein, 16 aa, Neisseria
VINGPDRPAGIPDPAG

SEQ ID NO: 36494 - protein, 7 aa, Neisseria
DFAKSLQ

SEQ ID NO: 36495 - protein, 12 aa, Neisseria
GCANLKNRQGWQ

SEQ ID NO: 36496 - protein, 6 aa, Neisseria
QAKRFF

SEQ ID NO: 36497 - protein, 5 aa, Neisseria
YFTPW

SEQ ID NO: 36498 - protein, 14 aa, Neisseria
PVLKGDGRRTERAR

SEQ ID NO: 36499 - protein, 7 aa, Neisseria
GIPDDFI

SEQ ID NO: 36500 - protein, 29 aa, Neisseria
AGLRGGKNLVRIRQTGKNSGTIDNAGGTH

SEQ ID NO: 36501 - protein, 31 aa, Neisseria; identical to SEQ ID NO: 12479

SEQ ID NO: 36502 - protein, 6 aa, Neisseria
AEDPVE

SEQ ID NO: 36503 - protein, 15 aa, Neisseria
QGSGRLKTPSGKYIR

SEQ ID NO: 36504 - protein, 9 aa, Neisseria
GYADKNEHP

SEQ ID NO: 36505 - protein, 12 aa, Neisseria
YMADKGYLKLGQ

SEQ ID NO: 36506 - protein, 12 aa, Neisseria
AYMRQNPQRLAE

SEQ ID NO: 36507 - protein, 5 aa, Neisseria
GQNPS

SEQ ID NO: 36508 - protein, 10 aa, Neisseria
LAGSGNEGPV

SEQ ID NO: 36509 - protein, 7 aa, Neisseria
GAIDRHY

SEQ ID NO: 36510 - protein, 8 aa, Neisseria
PVTRKALN

SEQ ID NO: 36511 - protein, 11 aa, Neisseria
DTGSAIKGAVR

SEQ ID NO: 36512 - protein, 16 aa, Neisseria
GYGDEAGELAGKQKTT

SEQ ID NO: 36513 - protein, 11 aa, Neisseria
LPNGMKPEYRP

SEQ ID NO: 36514 - protein, 6 aa, Neisseria
MKKHLL

SEQ ID NO: 36515 - protein, 14 aa, Neisseria
NGPDRPAGIPDPAG

SEQ ID NO: 36516 - protein, 8 aa, Neisseria
NLKNRQGW

SEQ ID NO: 36517 - protein, 13 aa, Neisseria
VLKGDGRRTERAR

SEQ ID NO: 36518 - protein, 24 aa, Neisseria
LRGGKNLVRIRQTGKNSGTIDNAG

SEQ ID NO: 36519 - protein, 9 aa, Neisseria
TAIKGRFEG

SEQ ID NO: 36520 - protein, 6 aa, Neisseria
ALDGKA

SEQ ID NO: 36521 - protein, 5 aa, Neisseria
AEDPV

SEQ ID NO: 36522 - protein, 7 aa, Neisseria
GRLKTPS

SEQ ID NO: 36523 - protein, 7 aa, Neisseria
YADKNEH

SEQ ID NO: 36524 - protein, 7 aa, Neisseria
NPQRLAE

SEQ ID NO: 36525 - protein, 9 aa, Neisseria
LAGSGNEGP

SEQ ID NO: 36526 - protein, 7 aa, Neisseria
VTRKALN

SEQ ID NO: 36527 - protein, 6 aa, Neisseria
DTGSAI

SEQ ID NO: 36528 - protein, 12 aa, Neisseria
DEAGELAGKQKT

SEQ ID NO: 36529 - protein, 8 aa, Neisseria
GMKPEYRP

SEQ ID NO: 36530 - protein, 10 aa, Neisseria
GEFPELEPIA

SEQ ID NO: 36531 - protein, 7 aa, Neisseria
GIKEMPD

SEQ ID NO: 36532 - protein, 6 aa, Neisseria
KNIVNV

SEQ ID NO: 36533 - protein, 6 aa, Neisseria
LDNPAN

SEQ ID NO: 36534 - protein, 16 aa, Neisseria
TVTATFDGFDTSDRSK

SEQ ID NO: 36535 - protein, 7 aa, Neisseria
QAFSDST

SEQ ID NO: 36536 - protein, 8 aa, Neisseria
LGYGEFPE

SEQ ID NO: 36537 - protein, 8 aa, Neisseria
EPIAKDRL

SEQ ID NO: 36538 - protein, 10 aa, Neisseria
VTEKGKENMI

SEQ ID NO: 36539 - protein, 19 aa, Neisseria
RGTYNYQYRSNRPVKDGSY

SEQ ID NO: 36540 - protein, 10 aa, Neisseria
TFWSKNKAGW

SEQ ID NO: 36541 - protein, 32 aa, Neisseria; identical to SEQ ID NO: 12518

SEQ ID NO: 36542 - protein, 8 aa, Neisseria
KPVGQNLE

SEQ ID NO: 36543 - protein, 6 aa, Neisseria
PLDNPA

SEQ ID NO: 36544 - protein, 5 aa, Neisseria
ERFKV

SEQ ID NO: 36545 - protein, 9 aa, Neisseria
FRGEPLPNA

SEQ ID NO: 36546 - protein, 18 aa, Neisseria
TFDGFDTSDRSKTHKTEA

SEQ ID NO: 36547 - protein, 13 aa, Neisseria
AFSDSTDDKGEVD

SEQ ID NO: 36548 - protein, 21 aa, Neisseria
NVEHKTDFPDQSVCQKQANYS

SEQ ID NO: 36549 - protein, 8 aa, Neisseria
EPIAKDRL

SEQ ID NO: 36550 - protein, 10 aa, Neisseria
VTEKGKENMI

SEQ ID NO: 36551 - protein, 10 aa, Neisseria
RSNRPVKDGS

SEQ ID NO: 36552 - protein, 7 aa, Neisseria
SKNKAGW

SEQ ID NO: 36553 - protein, 8 aa, Neisseria
AGIKEMPD

SEQ ID NO: 36554 - protein, 7 aa, Neisseria
EQTRMFG

SEQ ID NO: 36555 - protein, 5 aa, Neisseria
HESAD

SEQ ID NO: 36556 - protein, 5 aa, Neisseria
ERFKV

SEQ ID NO: 36557 - protein, 16 aa, Neisseria
DGFDTSDRSKTHKTEA

SEQ ID NO: 36558 - protein, 13 aa, Neisseria
AFSDSTDDKGEVD

SEQ ID NO: 36559 - protein, 10 aa, Neisseria
NVEHKTDFPD

SEQ ID NO: 36560 - protein, 5 aa, Neisseria
SVCQK

SEQ ID NO: 36561 - protein, 20 aa, Neisseria
AVLSGCQSIYVPTLTEIPVN

SEQ ID NO: 36562 - protein, 6 aa, Neisseria
INTVKT

SEQ ID NO: 36563 - protein, 11 aa, Neisseria
HWADVAKISDE

SEQ ID NO: 36564 - protein, 17 aa, Neisseria
GKMTKVQAAQYLNNFRK

SEQ ID NO: 36565 - protein, 9 aa, Neisseria
DSMYEIYLR

SEQ ID NO: 36566 - protein, 11 aa, Neisseria
ENALRGWQQRW

SEQ ID NO: 36567 - protein, 11 aa, Neisseria
VKTEAPAKGFR

SEQ ID NO: 36568 - protein, 9 aa, Neisseria
AKISDEATR

SEQ ID NO: 36569 - protein, 5 aa, Neisseria
GKMTK

SEQ ID NO: 36570 - protein, 17 aa, Neisseria
NNFRKRLVGRNAVDDSM

SEQ ID NO: 36571 - protein, 18 aa, Neisseria
SAVDSQRGEINTEQSKLY

SEQ ID NO: 36572 - protein, 20 aa, Neisseria
ALRGWQQRWKNMDAKPDNPA

SEQ ID NO: 36573 - protein, 11 aa, Neisseria
VKTEAPAKGFR

SEQ ID NO: 36574 - protein, 9 aa, Neisseria
AKISDEATR

SEQ ID NO: 36575 - protein, 7 aa, Neisseria
FRKRLVG

SEQ ID NO: 36576 - protein, 7 aa, Neisseria
NAVDDSM

SEQ ID NO: 36577 - protein, 18 aa, Neisseria
SAVDSQRGEINTEQSKLY

SEQ ID NO: 36578 - protein, 10 aa, Neisseria
WKNMDAKPDN

SEQ ID NO: 36579 - protein, 6 aa, Neisseria
LSACTA

SEQ ID NO: 36580 - protein, 8 aa, Neisseria
RANEAQAP

SEQ ID NO: 36581 - protein, 7 aa, Neisseria
VRRFVDD

SEQ ID NO: 36582 - protein, 9 aa, Neisseria
AEWQDFFDK

SEQ ID NO: 36583 - protein, 5 aa, Neisseria
VKIMH

SEQ ID NO: 36584 - protein, 5 aa, Neisseria
DDVAQ

SEQ ID NO: 36585 - protein, 9 aa, Neisseria
GSFRVADAL

SEQ ID NO: 36586 - protein, 10 aa, Neisseria
KELVELLKLA

SEQ ID NO: 36587 - protein, 5 aa, Neisseria
AMGMP

SEQ ID NO: 36588 - protein, 22 aa, Neisseria
HRDIWGNVGDVAASVANYMKQH

SEQ ID NO: 36589 - protein, 9 aa, Neisseria
RTVADLKAY

SEQ ID NO: 36590 - protein, 9 aa, Neisseria
YLGLNNFYT

SEQ ID NO: 36591 - protein, 7 aa, Neisseria
MEKRKIL

SEQ ID NO: 36592 - protein, 27 aa, Neisseria
MEARTPRANEAQAPRADEMKKESRPAF

SEQ ID NO: 36593 - protein, 6 aa, Neisseria
VSDSGF

SEQ ID NO: 36594 - protein, 18 aa, Neisseria
ANVRRFVDDEVGKGDFSQ

SEQ ID NO: 36595 - protein, 9 aa, Neisseria
MHRPSTSRP

SEQ ID NO: 36596 - protein, 12 aa, Neisseria
RTGNSGRAKFHG

SEQ ID NO: 36597 - protein, 20 aa, Neisseria
RRFYAENRAVIDDVAQKYGV

SEQ ID NO: 36598 - protein, 11 aa, Neisseria
IETNYGKNTGS

SEQ ID NO: 36599 - protein, 9 aa, Neisseria
DYPRRAGFF

SEQ ID NO: 36600 - protein, 9 aa, Neisseria
KLAKEEGGD

SEQ ID NO: 36601 - protein, 20 aa, Neisseria
MPSSYRKWAVDYDGDGHRDI

SEQ ID NO: 36602 - protein, 9 aa, Neisseria
HGWRTGGKM

SEQ ID NO: 36603 - protein, 5 aa, Neisseria
APGAD

SEQ ID NO: 36604 - protein, 7 aa, Neisseria
IGEKTAL

SEQ ID NO: 36605 - protein, 12 aa, Neisseria
PGETLADDEKAV

SEQ ID NO: 36606 - protein, 5 aa, Neisseria
ETAPG

SEQ ID NO: 36607 - protein, 13 aa, Neisseria
VRDIANSLGGPGL

SEQ ID NO: 36608 - protein, 7 aa, Neisseria
MEKRKIL

SEQ ID NO: 36609 - protein, 27 aa, Neisseria
MEARTPRANEAQAPRADEMKKESRPAF

SEQ ID NO: 36610 - protein, 18 aa, Neisseria
ANVRRFVDDEVGKGDFSQ

SEQ ID NO: 36611 - protein, 10 aa, Neisseria
GNSGRAKFHG

SEQ ID NO: 36612 - protein, 16 aa, Neisseria
RRFYAENRAVIDDVAQ

SEQ ID NO: 36613 - protein, 7 aa, Neisseria
NYGKNTG

SEQ ID NO: 36614 - protein, 8 aa, Neisseria
YPRRAGFF

SEQ ID NO: 36615 - protein, 9 aa, Neisseria
KLAKEEGGD

SEQ ID NO: 36616 - protein, 9 aa, Neisseria
YDGDGHRDI

SEQ ID NO: 36617 - protein, 7 aa, Neisseria
IGEKTAL

SEQ ID NO: 36618 - protein, 9 aa, Neisseria
TLADDEKAV

SEQ ID NO: 36619 - protein, 5 aa, Neisseria
VRDIA

SEQ ID NO: 36620 - protein, 8 aa, Neisseria
PMACAAFL

SEQ ID NO: 36621 - protein, 12 aa, Neisseria
LGACYAILSLYA

SEQ ID NO: 36622 - protein, 9 aa, Neisseria
PALFGGWTG

SEQ ID NO: 36623 - protein, 18 aa, Neisseria
IDKRRAVRGKRRIPEHRL

SEQ ID NO: 36624 - protein, 12 aa, Neisseria
RMFRHKTAKKRF

SEQ ID NO: 36625 - protein, 18 aa, Neisseria
IDKRRAVRGKRRIPEHRL

SEQ ID NO: 36626 - protein, 12 aa, Neisseria
RMFRHKTAKKRF

SEQ ID NO: 36627 - protein, 7 aa, Neisseria
KCGQTAQ

SEQ ID NO: 36628 - protein, 5 aa, Neisseria
FDELE

SEQ ID NO: 36629 - protein, 33 aa, Neisseria
GCGKDAGGYEGYWREKSDKKEGVIAVKKKGNYF

SEQ ID NO: 36630 - protein, 15 aa, Neisseria
TGKEESLLLSEKDGA

SEQ ID NO: 36631 - protein, 5 aa, Neisseria
NTGIG

SEQ ID NO: 36632 - protein, 40 aa, Neisseria
IPIKLSDDGKELYVERRRYVKTDAAMKDKIIAHQKKCGQT

SEQ ID NO: 36633 - protein, 19 aa, Neisseria
LDARNALPSNQTYQQRQAA

SEQ ID NO: 36634 - protein, 25 aa, Neisseria
EQLKRRFEAEFDELEKEIKCNGKPT

SEQ ID NO: 36635 - protein, 7 aa, Neisseria
CGKDAGG

SEQ ID NO: 36636 - protein, 19 aa, Neisseria
YWREKSDKKEGVIAVKKKG

SEQ ID NO: 36637 - protein, 15 aa, Neisseria
TGKEESLLLSEKDGA

SEQ ID NO: 36638 - protein, 39 aa, Neisseria
IPIKLSDDGKELYVERRRYVKTDAAMKDKIIAHQKKCGQ

SEQ ID NO: 36639 - protein, 7 aa, Neisseria
LDARNAL

SEQ ID NO: 36640 - protein, 7 aa, Neisseria
YQQRQAA

SEQ ID NO: 36641 - protein, 23 aa, Neisseria
EQLKRRFEAEFDELEKEIKCNGK

SEQ ID NO: 36642 - protein, 8 aa, Neisseria
PSEHISSF

SEQ ID NO: 36643 - protein, 7 aa, Neisseria
LGSTLGQ

SEQ ID NO: 36644 - protein, 10 aa, Neisseria
AEGTEDLSRQ

SEQ ID NO: 36645 - protein, 16 aa, Neisseria
LPQNNENLWQPSEHIS

SEQ ID NO: 36646 - protein, 17 aa, Neisseria
AAEGRLAVKAEGKGSYA

SEQ ID NO: 36647 - protein, 5 aa, Neisseria
TPLGS

SEQ ID NO: 36648 - protein, 9 aa, Neisseria
LCQDRDGAL

SEQ ID NO: 36649 - protein, 8 aa, Neisseria
VDGKGNVY

SEQ ID NO: 36650 - protein, 10 aa, Neisseria
AEGTEDLSRQ

SEQ ID NO: 36651 - protein, 18 aa, Neisseria
EGRRVAGAPYRIRSDGIL

SEQ ID NO: 36652 - protein, 13 aa, Neisseria
YGWTIGQNCRQWG

SEQ ID NO: 36653 - protein, 7 aa, Neisseria
SPNVATE

SEQ ID NO: 36654 - protein, 15 aa, Neisseria
AAEGRLAVKAEGKGS

SEQ ID NO: 36655 - protein, 8 aa, Neisseria
CQDRDGAL

SEQ ID NO: 36656 - protein, 5 aa, Neisseria
VDGKG

SEQ ID NO: 36657 - protein, 8 aa, Neisseria
EGTEDLSR

SEQ ID NO: 36658 - protein, 6 aa, Neisseria
EGRRVA

SEQ ID NO: 36659 - protein, 9 aa, Neisseria
YRIRSDGIL

SEQ ID NO: 36660 - protein, 5 aa, Neisseria
LLTAC

SEQ ID NO: 36661 - protein, 11 aa, Neisseria
SYDVTRYFYKE

SEQ ID NO: 36662 - protein, 8 aa, Neisseria
KGWQQALP

SEQ ID NO: 36663 - protein, 15 aa, Neisseria
NPKQIRDWNDLAKDG

SEQ ID NO: 36664 - protein, 7 aa, Neisseria
KLVASIL

SEQ ID NO: 36665 - protein, 26 aa, Neisseria
CSPAADSNHPSGQNAPANTESDGKNI

SEQ ID NO: 36666 - protein, 11 aa, Neisseria
GTYQSEHPGTS

SEQ ID NO: 36667 - protein, 6 aa, Neisseria
SHGGFS

SEQ ID NO: 36668 - protein, 15 aa, Neisseria
  VARIANT 12: Xaa is any amino acid
NQSSDIDLLEKXGLV

SEQ ID NO: 36669 - protein, 9 aa, Neisseria
LPDHAAPYT

SEQ ID NO: 36670 - protein, 19 aa, Neisseria
RKNNPKQIRDWNDLAKDGV

SEQ ID NO: 36671 - protein, 8 aa, Neisseria
AKTSGNGR

SEQ ID NO: 36672 - protein, 13 aa, Neisseria
LKANNGNEQEAQK

SEQ ID NO: 36673 - protein, 24 aa, Neisseria
  VARIANT 13: Xaa is any amino acid
LKNTPVFENGGRXPPPPPSHNATS

SEQ ID NO: 36674 - protein, 13 aa, Neisseria
SLLKTKPTTSAKN

SEQ ID NO: 36675 - protein, 9 aa, Neisseria
PAADSNHPS

SEQ ID NO: 36676 - protein, 9 aa, Neisseria
ANTESDGKN

SEQ ID NO: 36677 - protein, 6 aa, Neisseria
QSEHPG

SEQ ID NO: 36678 - protein, 14 aa, Neisseria
  VARIANT 11: Xaa is any amino acid
QSSDIDLLEKXGLV

SEQ ID NO: 36679 - protein, 19 aa, Neisseria
RKNNPKQIRDWNDLAKDGV

SEQ ID NO: 36680 - protein, 5 aa, Neisseria
TSGNG

SEQ ID NO: 36681 - protein, 11 aa, Neisseria
ANNGNEQEAQK

SEQ ID NO: 36682 - protein, 8 aa, Neisseria
  VARIANT 5: Xaa is any amino acid
NGGRXPPP

SEQ ID NO: 36683 - protein, 11 aa, Neisseria
LKTKPTTSAKN

SEQ ID NO: 36684 - protein, 6 aa, Neisseria
VPDGVK

SEQ ID NO: 36685 - protein, 16 aa, Neisseria
WTLLAMFVGVIAAIIG

SEQ ID NO: 36686 - protein, 6 aa, Neisseria
PLGALS

SEQ ID NO: 36687 - protein, 11 aa, Neisseria
GAAMSDALSAF

SEQ ID NO: 36688 - protein, 17 aa, Neisseria
HPIMQSIAGSYGSNPAK

SEQ ID NO: 36689 - protein, 5 aa, Neisseria
YLALV

SEQ ID NO: 36690 - protein, 5 aa, Neisseria
HSNPI

SEQ ID NO: 36691 - protein, 12 aa, Neisseria
PLIVNLIAENLG

SEQ ID NO: 36692 - protein, 6 aa, Neisseria
GVIAFF

SEQ ID NO: 36693 - protein, 7 aa, Neisseria
RLSEMGK

SEQ ID NO: 36694 - protein, 6 aa, Neisseria
AVIFGI

SEQ ID NO: 36695 - protein, 18 aa, Neisseria
LGLIKWFSGVLAESVGGL

SEQ ID NO: 36696 - protein, 13 aa, Neisseria
TAHITAMFGAFLA

SEQ ID NO: 36697 - protein, 8 aa, Neisseria
YTTMGEWW

SEQ ID NO: 36698 - protein, 18 aa, Neisseria
NFLIFSVIGSIWWKVLGY

SEQ ID NO: 36699 - protein, 8 aa, Neisseria
VPDGVKPQ

SEQ ID NO: 36700 - protein, 9 aa, Neisseria
TADKPGAAM

SEQ ID NO: 36701 - protein, 7 aa, Neisseria
GRKTLGI

SEQ ID NO: 36702 - protein, 10 aa, Neisseria
TPSNTARGGG

SEQ ID NO: 36703 - protein, 17 aa, Neisseria
GSYGSNPAKGTEGKMGK

SEQ ID NO: 36704 - protein, 6 aa, Neisseria
HSNPIS

SEQ ID NO: 36705 - protein, 6 aa, Neisseria
NLGSSF

SEQ ID NO: 36706 - protein, 10 aa, Neisseria
YPPEIKETPN

SEQ ID NO: 36707 - protein, 17 aa, Neisseria
FAKDRLSEMGKMSADEI

SEQ ID NO: 36708 - protein, 9 aa, Neisseria
DVLKEKSAW

SEQ ID NO: 36709 - protein, 9 aa, Neisseria
TADKPGAAM

SEQ ID NO: 36710 - protein, 5 aa, Neisseria
NTARG

SEQ ID NO: 36711 - protein, 12 aa, Neisseria
NPAKGTEGKMGK

SEQ ID NO: 36712 - protein, 8 aa, Neisseria
PEIKETPN

SEQ ID NO: 36713 - protein, 17 aa, Neisseria
FAKDRLSEMGKMSADEI

SEQ ID NO: 36714 - protein, 9 aa, Neisseria
DVLKEKSAW

SEQ ID NO: 36715 - protein, 10 aa, Neisseria
AGDINQIMSL

SEQ ID NO: 36716 - protein, 5 aa, Neisseria
ILAAP

SEQ ID NO: 36717 - protein, 9 aa, Neisseria
PGYLRSIRI

SEQ ID NO: 36718 - protein, 7 aa, Neisseria
DLLNLRD

SEQ ID NO: 36719 - protein, 5 aa, Neisseria
LKCLP

SEQ ID NO: 36720 - protein, 5 aa, Neisseria
SDMFY

SEQ ID NO: 36721 - protein, 6 aa, Neisseria
GRSIGG

SEQ ID NO: 36722 - protein, 14 aa, Neisseria
RYHQAVSGLSEVYD

SEQ ID NO: 36723 - protein, 7 aa, Neisseria
WLAELSH

SEQ ID NO: 36724 - protein, 17 aa, Neisseria
TGMKDALRAPEEAFGEG

SEQ ID NO: 36725 - protein, 6 aa, Neisseria
HAQWNK

SEQ ID NO: 36726 - protein, 7 aa, Neisseria
LKKPEYF

SEQ ID NO: 36727 - protein, 8 aa, Neisseria
GKCLHAGD

SEQ ID NO: 36728 - protein, 9 aa, Neisseria
PQDLNSGKL

SEQ ID NO: 36729 - protein, 17 aa, Neisseria
IRIDRSNDDQTHAGRIA

SEQ ID NO: 36730 - protein, 12 aa, Neisseria
NKFPTRSNDLLN

SEQ ID NO: 36731 - protein, 9 aa, Neisseria
RDLEQGLEN

SEQ ID NO: 36732 - protein, 5 aa, Neisseria
AEADL

SEQ ID NO: 36733 - protein, 10 aa, Neisseria
PVEREPNQSD

SEQ ID NO: 36734 - protein, 15 aa, Neisseria
GMDNSGSEATGKYQG

SEQ ID NO: 36735 - protein, 7 aa, Neisseria
ADNPFGL

SEQ ID NO: 36736 - protein, 24 aa, Neisseria
YGRSIGGTPDEENFDGHRKEGGSN

SEQ ID NO: 36737 - protein, 5 aa, Neisseria
HNGYR

SEQ ID NO: 36738 - protein, 16 aa, Neisseria
EVYDYNGKSYNTDFGF

SEQ ID NO: 36739 - protein, 11 aa, Neisseria
LYRDAKRKTYL

SEQ ID NO: 36740 - protein, 22 aa, Neisseria
WTRETKSYIDDAELTVQRRKTT

SEQ ID NO: 36741 - protein, 41 aa, Neisseria; identical to SEQ ID NO: 35427

SEQ ID NO: 36742 - protein, 7 aa, Neisseria
SADVNTP

SEQ ID NO: 36743 - protein, 14 aa, Neisseria
QWNKTPLTSQDKLA

SEQ ID NO: 36744 - protein, 32 aa, Neisseria; identical to SEQ ID NO: 35430

SEQ ID NO: 36745 - protein, 6 aa, Neisseria
SGQSAK

SEQ ID NO: 36746 - protein, 16 aa, Neisseria
RALKKPEYFQTKKWVT

SEQ ID NO: 36747 - protein, 7 aa, Neisseria
QDLNSGK

SEQ ID NO: 36748 - protein, 13 aa, Neisseria
IRIDRSNDDQTHA

SEQ ID NO: 36749 - protein, 7 aa, Neisseria
FPTRSND

SEQ ID NO: 36750 - protein, 9 aa, Neisseria
RDLEQGLEN

SEQ ID NO: 36751 - protein, 5 aa, Neisseria
AEADL

SEQ ID NO: 36752 - protein, 9 aa, Neisseria
PVEREPNQS

SEQ ID NO: 36753 - protein, 12 aa, Neisseria
MDNSGSEATGKY

SEQ ID NO: 36754 - protein, 19 aa, Neisseria
IGGTPDEENFDGHRKEGGS

SEQ ID NO: 36755 - protein, 5 aa, Neisseria
YDYNG

SEQ ID NO: 36756 - protein, 11 aa, Neisseria
LYRDAKRKTYL

SEQ ID NO: 36757 - protein, 22 aa, Neisseria
WTRETKSYIDDAELTVQRRKTT

SEQ ID NO: 36758 - protein, 11 aa, Neisseria
STADFKLKYKH

SEQ ID NO: 36759 - protein, 15 aa, Neisseria
TGMKDALRAPEEAFG

SEQ ID NO: 36760 - protein, 9 aa, Neisseria
PLTSQDKLA

SEQ ID NO: 36761 - protein, 7 aa, Neisseria
RGFDGEM

SEQ ID NO: 36762 - protein, 10 aa, Neisseria
RALKKPEYFQ

SEQ ID NO: 36763 - protein, 15 aa, Neisseria
KASKTVANFVRYARK

SEQ ID NO: 36764 - protein, 5 aa, Neisseria
RVIGG

SEQ ID NO: 36765 - protein, 11 aa, Neisseria
EDLVQKATDKA

SEQ ID NO: 36766 - protein, 13 aa, Neisseria
ANESGNGLKNTVG

SEQ ID NO: 36767 - protein, 26 aa, Neisseria
TVFGRVESGMDTVSKIARVKTATRGF

SEQ ID NO: 36768 - protein, 5 aa, Neisseria
MKPKF

SEQ ID NO: 36769 - protein, 5 aa, Neisseria
TDMGN

SEQ ID NO: 36770 - protein, 10 aa, Neisseria
VLDESKASKT

SEQ ID NO: 36771 - protein, 9 aa, Neisseria
YARKGFYDN

SEQ ID NO: 36772 - protein, 30 aa, Neisseria
QGDGLTEDLVQKATDKAVANESGNGLKNTV

SEQ ID NO: 36773 - protein, 6 aa, Neisseria
AAPDSA

SEQ ID NO: 36774 - protein, 14 aa, Neisseria
ADNGSLDYKNGQYG

SEQ ID NO: 36775 - protein, 23 aa, Neisseria
GRVESGMDTVSKIARVKTATRGF

SEQ ID NO: 36776 - protein, 5 aa, Neisseria
VKIRR

SEQ ID NO: 36777 - protein, 5 aa, Neisseria
MKPKF

SEQ ID NO: 36778 - protein, 5 aa, Neisseria
TDMGN

SEQ ID NO: 36779 - protein, 10 aa, Neisseria
VLDESKASKT

SEQ ID NO: 36780 - protein, 23 aa, Neisseria
GLTEDLVQKATDKAVANESGNGL

SEQ ID NO: 36781 - protein, 6 aa, Neisseria
AAPDSA

SEQ ID NO: 36782 - protein, 7 aa, Neisseria
GSLDYKN

SEQ ID NO: 36783 - protein, 20 aa, Neisseria
GRVESGMDTVSKIARVKTAT

SEQ ID NO: 36784 - protein, 5 aa, Neisseria
VKIRR

SEQ ID NO: 36785 - protein, 23 aa, Neisseria
PNIPALFPKHPFDPFENINNSKK

SEQ ID NO: 36786 - protein, 5 aa, Neisseria
GFARG

SEQ ID NO: 36787 - protein, 14 aa, Neisseria
EKPLRQYFKDCVNT

SEQ ID NO: 36788 - protein, 6 aa, Neisseria
ISSFGN

SEQ ID NO: 36789 - protein, 8 aa, Neisseria
VGNYIEWL

SEQ ID NO: 36790 - protein, 24 aa, Neisseria
TLNKLTGWQEHLYAGLDPFHYIEV

SEQ ID NO: 36791 - protein, 17 aa, Neisseria
ALDNLKHLDGHQIVKVN

SEQ ID NO: 36792 - protein, 5 aa, Neisseria
GFFTK

SEQ ID NO: 36793 - protein, 10 aa, Neisseria
WLRVIDGHSN

SEQ ID NO: 36794 - protein, 8 aa, Neisseria
PVEGYRKG

SEQ ID NO: 36795 - protein, 8 aa, Neisseria
AGVYATWH

SEQ ID NO: 36796 - protein, 10 aa, Neisseria
AYVDSWMQYQ

SEQ ID NO: 36797 - protein, 6 aa, Neisseria
KGITAS

SEQ ID NO: 36798 - protein, 7 aa, Neisseria
GYNALLA

SEQ ID NO: 36799 - protein, 6 aa, Neisseria
QPFVAV

SEQ ID NO: 36800 - protein, 6 aa, Neisseria
FNRQTS

SEQ ID NO: 36801 - protein, 26 aa, Neisseria
KKLRDRNSEYWKEETYHIKSNGRTYP

SEQ ID NO: 36802 - protein, 28 aa, Neisseria
PKHPFDPFENINNSKKISFYDKEYTEDY

SEQ ID NO: 36803 - protein, 15 aa, Neisseria
FGVEKRNGEEEKPLR

SEQ ID NO: 36804 - protein, 16 aa, Neisseria
CVNTENSNNDNCKISS

SEQ ID NO: 36805 - protein, 5 aa, Neisseria
IKSDI

SEQ ID NO: 36806 - protein, 11 aa, Neisseria
QIKNSHINSEI

SEQ ID NO: 36807 - protein, 11 aa, Neisseria
PTLNKLTGWQE

SEQ ID NO: 36808 - protein, 7 aa, Neisseria
EVTDNSH

SEQ ID NO: 36809 - protein, 11 aa, Neisseria
SLWKPRWNSNI

SEQ ID NO: 36810 - protein, 26 aa, Neisseria
KNAEIRFNTKNESLLVKEDYAGGARF

SEQ ID NO: 36811 - protein, 9 aa, Neisseria
YDLKDKVPE

SEQ ID NO: 36812 - protein, 9 aa, Neisseria
FEKNITGTS

SEQ ID NO: 36813 - protein, 34 aa, Neisseria
KALDNLKHLDGHQIVKVNDTADKDAFRLSSKYRK

SEQ ID NO: 36814 - protein, 8 aa, Neisseria
LQQRPEGF

SEQ ID NO: 36815 - protein, 8 aa, Neisseria
KVQERDDI

SEQ ID NO: 36816 - protein, 19 aa, Neisseria
RLNDKNSDIFDRTLPRKGL

SEQ ID NO: 36817 - protein, 23 aa, Neisseria
IDGHSNQWVQGKTAPVEGYRKGV

SEQ ID NO: 36818 - protein, 7 aa, Neisseria
QNESNQL

SEQ ID NO: 36819 - protein, 20 aa, Neisseria
MGGQAEQRSTFRNPDTDNLT

SEQ ID NO: 36820 - protein, 5 aa, Neisseria
GNVKG

SEQ ID NO: 36821 - protein, 9 aa, Neisseria
LQDKQTGAY

SEQ ID NO: 36822 - protein, 21 aa, Neisseria
QRFRHRINTEYATERFTSKGI

SEQ ID NO: 36823 - protein, 9 aa, Neisseria
HFTKKGNSL

SEQ ID NO: 36824 - protein, 11 aa, Neisseria
VNGKFSDSENA

SEQ ID NO: 36825 - protein, 12 aa, Neisseria
LGSRQLQSRVGV

SEQ ID NO: 36826 - protein, 22 aa, Neisseria
KPFGVEIDGDRRVINNKTVIET

SEQ ID NO: 36827 - protein, 5 aa, Neisseria
AKIKS

SEQ ID NO: 36828 - protein, 13 aa, Neisseria
SFNRQTSKHHHAK

SEQ ID NO: 36829 - protein, 17 aa, Neisseria
KKLRDRNSEYWKEETYH

SEQ ID NO: 36830 - protein, 5 aa, Neisseria
SNGRT

SEQ ID NO: 36831 - protein, 5 aa, Neisseria
HPFDP

SEQ ID NO: 36832 - protein, 15 aa, Neisseria
NNSKKISFYDKEYTE

SEQ ID NO: 36833 - protein, 14 aa, Neisseria
FGVEKRNGEEEKPL

SEQ ID NO: 36834 - protein, 13 aa, Neisseria
CVNTENSNNDNCK

SEQ ID NO: 36835 - protein, 22 aa, Neisseria
KNAEIRFNTKNESLLVKEDYAG

SEQ ID NO: 36836 - protein, 9 aa, Neisseria
YDLKDKVPE

SEQ ID NO: 36837 - protein, 5 aa, Neisseria
KNITG

SEQ ID NO: 36838 - protein, 10 aa, Neisseria
KALDNLKHLD

SEQ ID NO: 36839 - protein, 19 aa, Neisseria
KVNDTADKDAFRLSSKYRK

SEQ ID NO: 36840 - protein, 7 aa, Neisseria
QQRPEGF

SEQ ID NO: 36841 - protein, 7 aa, Neisseria
VQERDDI

SEQ ID NO: 36842 - protein, 10 aa, Neisseria
LNDKNSDIFD

SEQ ID NO: 36843 - protein, 7 aa, Neisseria
EGYRKGV

SEQ ID NO: 36844 - protein, 5 aa, Neisseria
NESNQ

SEQ ID NO: 36845 - protein, 17 aa, Neisseria
QAEQRSTFRNPDTDNLT

SEQ ID NO: 36846 - protein, 6 aa, Neisseria
LQDKQT

SEQ ID NO: 36847 - protein, 9 aa, Neisseria
QRFRHRINT

SEQ ID NO: 36848 - protein, 8 aa, Neisseria
HFTKKGNS

SEQ ID NO: 36849 - protein, 8 aa, Neisseria
KFSDSENA

SEQ ID NO: 36850 - protein, 5 aa, Neisseria
RQLQS

SEQ ID NO: 36851 - protein, 13 aa, Neisseria
FGVEIDGDRRVIN

SEQ ID NO: 36852 - protein, 5 aa, Neisseria
AKIKS

SEQ ID NO: 36853 - protein, 12 aa, Neisseria
FNRQTSKHHHAK

SEQ ID NO: 36854 - protein, 23 aa, Neisseria
PNIPALFPKHPFDPFENINNSKK

SEQ ID NO: 36855 - protein, 5 aa, Neisseria
GFARG

SEQ ID NO: 36856 - protein, 14 aa, Neisseria
EKPLRQYFKDCVNT

SEQ ID NO: 36857 - protein, 6 aa, Neisseria
ISSFGN

SEQ ID NO: 36858 - protein, 8 aa, Neisseria
VGNYIEWL

SEQ ID NO: 36859 - protein, 24 aa, Neisseria
TLNKLTGWQEHLYAGLDPFHYIEV

SEQ ID NO: 36860 - protein, 17 aa, Neisseria
ALDNLKHLDGHQIVKVN

SEQ ID NO: 36861 - protein, 5 aa, Neisseria
GFFTK

SEQ ID NO: 36862 - protein, 10 aa, Neisseria
WLRVIDGHSN

SEQ ID NO: 36863 - protein, 8 aa, Neisseria
PVEGYRKG

SEQ ID NO: 36864 - protein, 8 aa, Neisseria
AGVYATWH

SEQ ID NO: 36865 - protein, 10 aa, Neisseria
AYVDSWMQYQ

SEQ ID NO: 36866 - protein, 6 aa, Neisseria
KGITAS

SEQ ID NO: 36867 - protein, 7 aa, Neisseria
GYNALLA

SEQ ID NO: 36868 - protein, 6 aa, Neisseria
QPFVAV

SEQ ID NO: 36869 - protein, 6 aa, Neisseria
FNRQTS

SEQ ID NO: 36870 - protein, 26 aa, Neisseria
KKLRDRNSEYWKEETYHIKSNGRTYP

SEQ ID NO: 36871 - protein, 28 aa, Neisseria
PKHPFDPFENINNSKKISFYDKEYTEDY

SEQ ID NO: 36872 - protein, 15 aa, Neisseria
FGVEKRNGEEEKPLR

SEQ ID NO: 36873 - protein, 16 aa, Neisseria
CVNTENSNNDNCKISS

SEQ ID NO: 36874 - protein, 5 aa, Neisseria
IKSDI

SEQ ID NO: 36875 - protein, 11 aa, Neisseria
QIKNSHINSEI

SEQ ID NO: 36876 - protein, 11 aa, Neisseria
PTLNKLTGWQE

SEQ ID NO: 36877 - protein, 7 aa, Neisseria
EVTDNSH

SEQ ID NO: 36878 - protein, 11 aa, Neisseria
SLWKPRWNSNI

SEQ ID NO: 36879 - protein, 26 aa, Neisseria
KNAEIRFNTKNESLLVKEDYAGGARF

SEQ ID NO: 36880 - protein, 9 aa, Neisseria
YDLKDKVPE

SEQ ID NO: 36881 - protein, 9 aa, Neisseria
FEKNITGTS

SEQ ID NO: 36882 - protein, 34 aa, Neisseria; identical to SEQ ID NO: 36813

SEQ ID NO: 36883 - protein, 8 aa, Neisseria
LQQRPEGF

SEQ ID NO: 36884 - protein, 8 aa, Neisseria
KVQERDDI

SEQ ID NO: 36885 - protein, 19 aa, Neisseria
RLNDKNSDIFDRTLPRKGL

SEQ ID NO: 36886 - protein, 23 aa, Neisseria
IDGHSNQWVQGKTAPVEGYRKGV

SEQ ID NO: 36887 - protein, 7 aa, Neisseria
QNESNQL

SEQ ID NO: 36888 - protein, 20 aa, Neisseria
MGGQAEQRSTFRNPDTDNLT

SEQ ID NO: 36889 - protein, 5 aa, Neisseria
GNVKG

SEQ ID NO: 36890 - protein, 9 aa, Neisseria
LQDKQTGAY

SEQ ID NO: 36891 - protein, 21 aa, Neisseria
QRFRHRINTEYATERFTSKGI

SEQ ID NO: 36892 - protein, 9 aa, Neisseria
HFTKKGNSL

SEQ ID NO: 36893 - protein, 11 aa, Neisseria
VNGKFSDSENA

SEQ ID NO: 36894 - protein, 12 aa, Neisseria
LGSRQLQSRVGV

SEQ ID NO: 36895 - protein, 22 aa, Neisseria
KPFGVEIDGDRRVINNKTVIET

SEQ ID NO: 36896 - protein, 5 aa, Neisseria
AKIKS

SEQ ID NO: 36897 - protein, 13 aa, Neisseria
SFNRQTSKHHHAK

SEQ ID NO: 36898 - protein, 17 aa, Neisseria
KKLRDRNSEYWKEETYH

SEQ ID NO: 36899 - protein, 5 aa, Neisseria
SNGRT

SEQ ID NO: 36900 - protein, 5 aa, Neisseria
HPFDP

SEQ ID NO: 36901 - protein, 15 aa, Neisseria
NNSKKISFYDKEYTE

SEQ ID NO: 36902 - protein, 14 aa, Neisseria
FGVEKRNGEEEKPL

SEQ ID NO: 36903 - protein, 13 aa, Neisseria
CVNTENSNNDNCK

SEQ ID NO: 36904 - protein, 22 aa, Neisseria
KNAEIRFNTKNESLLVKEDYAG

SEQ ID NO: 36905 - protein, 9 aa, Neisseria
YDLKDKVPE

SEQ ID NO: 36906 - protein, 5 aa, Neisseria
KNITG

SEQ ID NO: 36907 - protein, 10 aa, Neisseria
KALDNLKHLD

SEQ ID NO: 36908 - protein, 19 aa, Neisseria
KVNDTADKDAFRLSSKYRK

SEQ ID NO: 36909 - protein, 7 aa, Neisseria
QQRPEGF

SEQ ID NO: 36910 - protein, 7 aa, Neisseria
VQERDDI

SEQ ID NO: 36911 - protein, 10 aa, Neisseria
LNDKNSDIFD

SEQ ID NO: 36912 - protein, 7 aa, Neisseria
EGYRKGV

SEQ ID NO: 36913 - protein, 5 aa, Neisseria
NESNQ

SEQ ID NO: 36914 - protein, 17 aa, Neisseria
QAEQRSTFRNPDTDNLT

SEQ ID NO: 36915 - protein, 6 aa, Neisseria
LQDKQT

SEQ ID NO: 36916 - protein, 9 aa, Neisseria
QRFRHRINT

SEQ ID NO: 36917 - protein, 8 aa, Neisseria
HFTKKGNS

SEQ ID NO: 36918 - protein, 8 aa, Neisseria
KFSDSENA

SEQ ID NO: 36919 - protein, 5 aa, Neisseria
RQLQS

SEQ ID NO: 36920 - protein, 13 aa, Neisseria
FGVEIDGDRRVIN

SEQ ID NO: 36921 - protein, 5 aa, Neisseria
AKIKS

SEQ ID NO: 36922 - protein, 12 aa, Neisseria
FNRQTSKHHHAK

SEQ ID NO: 36923 - protein, 5 aa, Neisseria
TLIAA

SEQ ID NO: 36924 - protein, 9 aa, Neisseria
ALGGCFSAV

SEQ ID NO: 36925 - protein, 6 aa, Neisseria
QFVGQI

SEQ ID NO: 36926 - protein, 23 aa, Neisseria
AEGVYNYITVASLPRTAGDIAGD

SEQ ID NO: 36927 - protein, 8 aa, Neisseria
MKPKPHTV

SEQ ID NO: 36928 - protein, 17 aa, Neisseria
SVIDRRTTGAQTDDNVM

SEQ ID NO: 36929 - protein, 19 aa, Neisseria
RIETTARSYLRQNNQTKGY

SEQ ID NO: 36930 - protein, 8 aa, Neisseria
ATEGEKQF

SEQ ID NO: 36931 - protein, 7 aa, Neisseria
ARSEQAA

SEQ ID NO: 36932 - protein, 20 aa, Neisseria
LPRTAGDIAGDTWNTSKVRA

SEQ ID NO: 36933 - protein, 9 aa, Neisseria
SPATQARVK

SEQ ID NO: 36934 - protein, 9 aa, Neisseria
TPEEQAQIT

SEQ ID NO: 36935 - protein, 7 aa, Neisseria
MKPKPHT

SEQ ID NO: 36936 - protein, 17 aa, Neisseria
SVIDRRTTGAQTDDNVM

SEQ ID NO: 36937 - protein, 6 aa, Neisseria
RIETTA

SEQ ID NO: 36938 - protein, 7 aa, Neisseria
NNQTKGY

SEQ ID NO: 36939 - protein, 8 aa, Neisseria
ATEGEKQF

SEQ ID NO: 36940 - protein, 7 aa, Neisseria
ARSEQAA

SEQ ID NO: 36941 - protein, 5 aa, Neisseria
PRTAG

SEQ ID NO: 36942 - protein, 6 aa, Neisseria
TQARVK

SEQ ID NO: 36943 - protein, 8 aa, Neisseria
TPEEQAQI

SEQ ID NO: 36944 - protein, 12 aa, Neisseria
KRMSDISAGISH

SEQ ID NO: 36945 - protein, 7 aa, Neisseria
KQPDRID

SEQ ID NO: 36946 - protein, 7 aa, Neisseria
TDLPLNI

SEQ ID NO: 36947 - protein, 13 aa, Neisseria
DIMTDKGKWKLET

SEQ ID NO: 36948 - protein, 10 aa, Neisseria
LNSENSRAAL

SEQ ID NO: 36949 - protein, 12 aa, Neisseria
PTEIQENGSNTD

SEQ ID NO: 36950 - protein, 10 aa, Neisseria
GNTDIYGSGS

SEQ ID NO: 36951 - protein, 20 aa, Neisseria
HEERKLDGNGKTRNKRMSDI

SEQ ID NO: 36952 - protein, 9 aa, Neisseria
FLKDGKNPA

SEQ ID NO: 36953 - protein, 14 aa, Neisseria
TVYEKSRNKASSGK

SEQ ID NO: 36954 - protein, 18 aa, Neisseria
YRINGSKTLSDDVKYKAG

SEQ ID NO: 36955 - protein, 10 aa, Neisseria
ANDRISLTGG

SEQ ID NO: 36956 - protein, 19 aa, Neisseria
GKQPDRIDGKKESARNTST

SEQ ID NO: 36957 - protein, 11 aa, Neisseria
VSGQSSSELKL

SEQ ID NO: 36958 - protein, 11 aa, Neisseria
DIMTDKGKWKL

SEQ ID NO: 36959 - protein, 7 aa, Neisseria
ENSRAAL

SEQ ID NO: 36960 - protein, 9 aa, Neisseria
EIQENGSNT

SEQ ID NO: 36961 - protein, 20 aa, Neisseria
HEERKLDGNGKTRNKRMSDI

SEQ ID NO: 36962 - protein, 7 aa, Neisseria
FLKDGKN

SEQ ID NO: 36963 - protein, 13 aa, Neisseria
TVYEKSRNKASSG

SEQ ID NO: 36964 - protein, 11 aa, Neisseria
KTLSDDVKYKA

SEQ ID NO: 36965 - protein, 6 aa, Neisseria
ANDRIS

SEQ ID NO: 36966 - protein, 15 aa, Neisseria
KQPDRIDGKKESARN

SEQ ID NO: 36967 - protein, 7 aa, Neisseria
SSSELKL

SEQ ID NO: 36968 - protein, 8 aa, Neisseria
GVQKSAQG

SEQ ID NO: 36969 - protein, 12 aa, Neisseria
ATVKKAHKHTKA

SEQ ID NO: 36970 - protein, 5 aa, Neisseria
MNKNI

SEQ ID NO: 36971 - protein, 38 aa, Neisseria; identical to SEQ ID NO: 35518

SEQ ID NO: 36972 - protein, 48 aa, Neisseria; identical to SEQ ID NO: 35519

SEQ ID NO: 36973 - protein, 7 aa, Neisseria
GVQKSAQ

SEQ ID NO: 36974 - protein, 20 aa, Neisseria
GASKSAEGSCGASKSAEGSC

SEQ ID NO: 36975 - protein, 15 aa, Neisseria
AASKAGEGKCGEGKC

SEQ ID NO: 36976 - protein, 32 aa, Neisseria; identical to SEQ ID NO: 35523

SEQ ID NO: 36977 - protein, 8 aa, Neisseria
TILSVLAA

SEQ ID NO: 36978 - protein, 16 aa, Neisseria
ELPKEVGKVLRKHRRY

SEQ ID NO: 36979 - protein, 9 aa, Neisseria
VGERVNRVF

SEQ ID NO: 36980 - protein, 10 aa, Neisseria
WRQIEPIPGE

SEQ ID NO: 36981 - protein, 20 aa, Neisseria
RNVLREGGNQHLDGLEEVLA

SEQ ID NO: 36982 - protein, 10 aa, Neisseria
AQKASKAVRR

SEQ ID NO: 36983 - protein, 7 aa, Neisseria
EHLPEAA

SEQ ID NO: 36984 - protein, 10 aa, Neisseria
IEALQRLAKL

SEQ ID NO: 36985 - protein, 11 aa, Neisseria
KYPEILDGFFE

SEQ ID NO: 36986 - protein, 15 aa, Neisseria
MEIMNLVSLRKPDDA

SEQ ID NO: 36987 - protein, 8 aa, Neisseria
VIDGYAEK

SEQ ID NO: 36988 - protein, 6 aa, Neisseria
VRQWLK

SEQ ID NO: 36989 - protein, 15 aa, Neisseria
ALRQIGRVRKLPEQQ

SEQ ID NO: 36990 - protein, 6 aa, Neisseria
DNLSKI

SEQ ID NO: 36991 - protein, 5 aa, Neisseria
MLALS

SEQ ID NO: 36992 - protein, 17 aa, Neisseria
NIIAKLSAAGSTEPLAE

SEQ ID NO: 36993 - protein, 8 aa, Neisseria
KMIADLET

SEQ ID NO: 36994 - protein, 5 aa, Neisseria
NLGYS

SEQ ID NO: 36995 - protein, 5 aa, Neisseria
DSKRL

SEQ ID NO: 36996 - protein, 5 aa, Neisseria
HLGEV

SEQ ID NO: 36997 - protein, 6 aa, Neisseria
DVWTQA

SEQ ID NO: 36998 - protein, 8 aa, Neisseria
KIWRETLK

SEQ ID NO: 36999 - protein, 31 aa, Neisseria
ADVELPKEVGKVLRKHRRYSEEEIKNERARL

SEQ ID NO: 37000 - protein, 8 aa, Neisseria
AVGERVNR

SEQ ID NO: 37001 - protein, 8 aa, Neisseria
TALQKGQA

SEQ ID NO: 37002 - protein, 14 aa, Neisseria
ERTKSPEVAERALE

SEQ ID NO: 37003 - protein, 18 aa, Neisseria
KWRQIEPIPGEAQKRAGW

SEQ ID NO: 37004 - protein, 28 aa, Neisseria
VLREGGNQHLDGLEEVLAQSDDVQKRRI

SEQ ID NO: 37005 - protein, 16 aa, Neisseria
GVAQKASKAVRRAALK

SEQ ID NO: 37006 - protein, 24 aa, Neisseria
QGREKEKAIEALQRLAKLDTEILP

SEQ ID NO: 37007 - protein, 21 aa, Neisseria
LTARKYPEILDGFFEQTDTQN

SEQ ID NO: 37008 - protein, 10 aa, Neisseria
SLRKPDDAYA

SEQ ID NO: 37009 - protein, 7 aa, Neisseria
EHNPNAN

SEQ ID NO: 37010 - protein, 8 aa, Neisseria
ANRKEGAS

SEQ ID NO: 37011 - protein, 20 aa, Neisseria
IDGYAEKAYGRGTGEQRGRA

SEQ ID NO: 37012 - protein, 8 aa, Neisseria
ADRRDYAK

SEQ ID NO: 37013 - protein, 9 aa, Neisseria
QWLKKVSAP

SEQ ID NO: 37014 - protein, 6 aa, Neisseria
LFDKGV

SEQ ID NO: 37015 - protein, 10 aa, Neisseria
AELDGGRAAL

SEQ ID NO: 37016 - protein, 17 aa, Neisseria
QIGRVRKLPEQQGRYFT

SEQ ID NO: 37017 - protein, 9 aa, Neisseria
KLPDKREAL

SEQ ID NO: 37018 - protein, 10 aa, Neisseria
SAAGSTEPLA

SEQ ID NO: 37019 - protein, 15 aa, Neisseria
EQFGKRGKMIADLET

SEQ ID NO: 37020 - protein, 5 aa, Neisseria
LTPDN

SEQ ID NO: 37021 - protein, 11 aa, Neisseria
LSDSKRLDEGF

SEQ ID NO: 37022 - protein, 13 aa, Neisseria
QINPDDTAVNDSI

SEQ ID NO: 37023 - protein, 8 aa, Neisseria
LKGDAESA

SEQ ID NO: 37024 - protein, 12 aa, Neisseria
RYSFENDPEPEV

SEQ ID NO: 37025 - protein, 6 aa, Neisseria
GERDQA

SEQ ID NO: 37026 - protein, 18 aa, Neisseria
AHLRGDKKIWRETLKRYG

SEQ ID NO: 37027 - protein, 11 aa, Neisseria
ALPEPSRKPRK

SEQ ID NO: 37028 - protein, 31 aa, Neisseria; identical to SEQ ID NO: 36999

SEQ ID NO: 37029 - protein, 8 aa, Neisseria
AVGERVNR

SEQ ID NO: 37030 - protein, 8 aa, Neisseria
TALQKGQA

SEQ ID NO: 37031 - protein, 14 aa, Neisseria
ERTKSPEVAERALE

SEQ ID NO: 37032 - protein, 11 aa, Neisseria
IPGEAQKRAGW

SEQ ID NO: 37033 - protein, 9 aa, Neisseria
VLREGGNQH

SEQ ID NO: 37034 - protein, 18 aa, Neisseria
DGLEEVLAQSDDVQKRRI

SEQ ID NO: 37035 - protein, 15 aa, Neisseria
VAQKASKAVRRAALK

SEQ ID NO: 37036 - protein, 22 aa, Neisseria
QGREKEKAIEALQRLAKLDTEI

SEQ ID NO: 37037 - protein, 9 aa, Neisseria
LTARKYPEI

SEQ ID NO: 37038 - protein, 8 aa, Neisseria
FEQTDTQN

SEQ ID NO: 37039 - protein, 10 aa, Neisseria
SLRKPDDAYA

SEQ ID NO: 37040 - protein, 8 aa, Neisseria
ANRKEGAS

SEQ ID NO: 37041 - protein, 7 aa, Neisseria
YAEKAYG

SEQ ID NO: 37042 - protein, 9 aa, Neisseria
GTGEQRGRA

SEQ ID NO: 37043 - protein, 8 aa, Neisseria
ADRRDYAK

SEQ ID NO: 37044 - protein, 10 aa, Neisseria
AELDGGRAAL

SEQ ID NO: 37045 - protein, 13 aa, Neisseria
QIGRVRKLPEQQG

SEQ ID NO: 37046 - protein, 9 aa, Neisseria
KLPDKREAL

SEQ ID NO: 37047 - protein, 7 aa, Neisseria
GSTEPLA

SEQ ID NO: 37048 - protein, 13 aa, Neisseria
FGKRGKMIADLET

SEQ ID NO: 37049 - protein, 5 aa, Neisseria
LTPDN

SEQ ID NO: 37050 - protein, 8 aa, Neisseria
SDSKRLDE

SEQ ID NO: 37051 - protein, 7 aa, Neisseria
NPDDTAV

SEQ ID NO: 37052 - protein, 5 aa, Neisseria
GDAES

SEQ ID NO: 37053 - protein, 9 aa, Neisseria
FENDPEPEV

SEQ ID NO: 37054 - protein, 6 aa, Neisseria
GERDQA

SEQ ID NO: 37055 - protein, 13 aa, Neisseria
LRGDKKIWRETLK

SEQ ID NO: 37056 - protein, 8 aa, Neisseria
EPSRKPRK

SEQ ID NO: 37057 - protein, 7 aa, Neisseria
SVATLLN

SEQ ID NO: 37058 - protein, 11 aa, Neisseria
LEKLGKEQMRA

SEQ ID NO: 37059 - protein, 7 aa, Neisseria
FEDMRRI

SEQ ID NO: 37060 - protein, 6 aa, Neisseria
EQLAQL

SEQ ID NO: 37061 - protein, 6 aa, Neisseria
SVLRGV

SEQ ID NO: 37062 - protein, 6 aa, Neisseria
AQFLEA

SEQ ID NO: 37063 - protein, 20 aa, Neisseria
QSWKARRDFNIVKQDLDFSC

SEQ ID NO: 37064 - protein, 28 aa, Neisseria
KLTEEEVLEKLGKEQMRASFEDMRRIMP

SEQ ID NO: 37065 - protein, 8 aa, Neisseria
LGFEAKGY

SEQ ID NO: 37066 - protein, 10 aa, Neisseria
LKYRKDDHFS

SEQ ID NO: 37067 - protein, 7 aa, Neisseria
RGVDGNT

SEQ ID NO: 37068 - protein, 7 aa, Neisseria
ADPSPGH

SEQ ID NO: 37069 - protein, 10 aa, Neisseria
WQTREGNLAG

SEQ ID NO: 37070 - protein, 9 aa, Neisseria
VPKKAEAIS

SEQ ID NO: 37071 - protein, 8 aa, Neisseria
HHPKRQTE

SEQ ID NO: 37072 - protein, 17 aa, Neisseria
SWKARRDFNIVKQDLDF

SEQ ID NO: 37073 - protein, 28 aa, Neisseria
KLTEEEVLEKLGKEQMRASFEDMRRIMP

SEQ ID NO: 37074 - protein, 7 aa, Neisseria
LGFEAKG

SEQ ID NO: 37075 - protein, 9 aa, Neisseria
KYRKDDHFS

SEQ ID NO: 37076 - protein, 8 aa, Neisseria
WQTREGNL

SEQ ID NO: 37077 - protein, 9 aa, Neisseria
VPKKAEAIS

SEQ ID NO: 37078 - protein, 7 aa, Neisseria
HPKRQTE

SEQ ID NO: 37079 - protein, 13 aa, Neisseria
NTSTNVGGFYGLT

SEQ ID NO: 37080 - protein, 5 aa, Neisseria
PFTGH

SEQ ID NO: 37081 - protein, 10 aa, Neisseria
KSADIFDAAQ

SEQ ID NO: 37082 - protein, 6 aa, Neisseria
GDFSTT

SEQ ID NO: 37083 - protein, 8 aa, Neisseria
YKVDEYHA

SEQ ID NO: 37084 - protein, 7 aa, Neisseria
FNTSTNV

SEQ ID NO: 37085 - protein, 14 aa, Neisseria
VEFDQAKRDGKIDI

SEQ ID NO: 37086 - protein, 6 aa, Neisseria
QSGSQP

SEQ ID NO: 37087 - protein, 9 aa, Neisseria
QYPDIRFVS

SEQ ID NO: 37088 - protein, 11 aa, Neisseria
KFNFNGKKLVS

SEQ ID NO: 37089 - protein, 14 aa, Neisseria
MRGKTAPVKLKAEK

SEQ ID NO: 37090 - protein, 29 aa, Neisseria
NCYQSPMAETEVCGGDFSTTIDRTKWGVD

SEQ ID NO: 37091 - protein, 8 aa, Neisseria
GMTKNVRI

SEQ ID NO: 37092 - protein, 8 aa, Neisseria
IQIEAAKQ

SEQ ID NO: 37093 - protein, 8 aa, Neisseria
YKVDEYHA

SEQ ID NO: 37094 - protein, 14 aa, Neisseria
VEFDQAKRDGKIDI

SEQ ID NO: 37095 - protein, 8 aa, Neisseria
FNGKKLVS

SEQ ID NO: 37096 - protein, 14 aa, Neisseria
MRGKTAPVKLKAEK

SEQ ID NO: 37097 - protein, 8 aa, Neisseria
MAETEVCG

SEQ ID NO: 37098 - protein, 8 aa, Neisseria
TTIDRTKW

SEQ ID NO: 37099 - protein, 5 aa, Neisseria
KNVRI

SEQ ID NO: 37100 - protein, 8 aa, Neisseria
IQIEAAKQ

SEQ ID NO: 37101 - protein, 8 aa, Neisseria
SFFALVFA

SEQ ID NO: 37102 - protein, 8 aa, Neisseria
ATEVPENP

SEQ ID NO: 37103 - protein, 13 aa, Neisseria
AFVAKLARLFRNA

SEQ ID NO: 37104 - protein, 10 aa, Neisseria
EESLAGAVDD

SEQ ID NO: 37105 - protein, 7 aa, Neisseria
HGENYET

SEQ ID NO: 37106 - protein, 13 aa, Neisseria
EDVYEHCLGCYQM

SEQ ID NO: 37107 - protein, 6 aa, Neisseria
YRDVAN

SEQ ID NO: 37108 - protein, 6 aa, Neisseria
SNRIAS

SEQ ID NO: 37109 - protein, 7 aa, Neisseria
MRELMPR

SEQ ID NO: 37110 - protein, 13 aa, Neisseria
EKEVSRYAEAAAR

SEQ ID NO: 37111 - protein, 5 aa, Neisseria
INPRW

SEQ ID NO: 37112 - protein, 14 aa, Neisseria
LSDTATEVPENPNA

SEQ ID NO: 37113 - protein, 7 aa, Neisseria
FRNADRA

SEQ ID NO: 37114 - protein, 11 aa, Neisseria
VKESMRTEESL

SEQ ID NO: 37115 - protein, 13 aa, Neisseria
AVDDGPLQSEKDY

SEQ ID NO: 37116 - protein, 10 aa, Neisseria
RLSRLKEKAK

SEQ ID NO: 37117 - protein, 7 aa, Neisseria
TEQEHGE

SEQ ID NO: 37118 - protein, 6 aa, Neisseria
YIGEGG

SEQ ID NO: 37119 - protein, 10 aa, Neisseria
LSQRSPEAFV

SEQ ID NO: 37120 - protein, 10 aa, Neisseria
YLYRNDRPFS

SEQ ID NO: 37121 - protein, 14 aa, Neisseria
AHGENYETTGEYRV

SEQ ID NO: 37122 - protein, 6 aa, Neisseria
QPDGSV

SEQ ID NO: 37123 - protein, 12 aa, Neisseria
AAGRGKIGEDVY

SEQ ID NO: 37124 - protein, 30 aa, Neisseria; identical to SEQ ID NO: 35584

SEQ ID NO: 37125 - protein, 14 aa, Neisseria
NMRELMPRGMKANS

SEQ ID NO: 37126 - protein, 10 aa, Neisseria
GYDADGLPQK

SEQ ID NO: 37127 - protein, 19 aa, Neisseria
SFDNGKKRQSFEYYLKNGN

SEQ ID NO: 37128 - protein, 7 aa, Neisseria
LKADGVT

SEQ ID NO: 37129 - protein, 19 aa, Neisseria
LDGGRIIREEKQGDRLPDF

SEQ ID NO: 37130 - protein, 29 aa, Neisseria
LNLEDLEKEVSRYAEAAARRSGGRRGLSH

SEQ ID NO: 37131 - protein, 9 aa, Neisseria
TATEVPENP

SEQ ID NO: 37132 - protein, 7 aa, Neisseria
FRNADRA

SEQ ID NO: 37133 - protein, 11 aa, Neisseria
VKESMRTEESL

SEQ ID NO: 37134 - protein, 13 aa, Neisseria
AVDDGPLQSEKDY

SEQ ID NO: 37135 - protein, 10 aa, Neisseria
RLSRLKEKAK

SEQ ID NO: 37136 - protein, 7 aa, Neisseria
TEQEHGE

SEQ ID NO: 37137 - protein, 7 aa, Neisseria
LSQRSPE

SEQ ID NO: 37138 - protein, 7 aa, Neisseria
YRNDRPF

SEQ ID NO: 37139 - protein, 9 aa, Neisseria
ENYETTGEY

SEQ ID NO: 37140 - protein, 12 aa, Neisseria
AAGRGKIGEDVY

SEQ ID NO: 37141 - protein, 28 aa, Neisseria
KYRDVANDEQKVWDFREESNRIASDSRD

SEQ ID NO: 37142 - protein, 11 aa, Neisseria
NMRELMPRGMK

SEQ ID NO: 37143 - protein, 7 aa, Neisseria
YDADGLP

SEQ ID NO: 37144 - protein, 8 aa, Neisseria
DNGKKRQS

SEQ ID NO: 37145 - protein, 7 aa, Neisseria
LKADGVT

SEQ ID NO: 37146 - protein, 15 aa, Neisseria
GGRIIREEKQGDRLP

SEQ ID NO: 37147 - protein, 28 aa, Neisseria
LNLEDLEKEVSRYAEAAARRSGGRRGLS

SEQ ID NO: 37148 - protein, 11 aa, Neisseria
GGAQGASESAQ

SEQ ID NO: 37149 - protein, 10 aa, Neisseria
PEDYTRIVAD

SEQ ID NO: 37150 - protein, 15 aa, Neisseria
GRRLQSVSRTAEMLG

SEQ ID NO: 37151 - protein, 6 aa, Neisseria
ISDTLQ

SEQ ID NO: 37152 - protein, 8 aa, Neisseria
QKYQTLAN

SEQ ID NO: 37153 - protein, 6 aa, Neisseria
WHKNAG

SEQ ID NO: 37154 - protein, 15 aa, Neisseria
GGKASRSVGRVLPVV

SEQ ID NO: 37155 - protein, 5 aa, Neisseria
IEPRL

SEQ ID NO: 37156 - protein, 8 aa, Neisseria
QNDLPNFD

SEQ ID NO: 37157 - protein, 12 aa, Neisseria
NAANSLSTAVQS

SEQ ID NO: 37158 - protein, 5 aa, Neisseria
VGKNP

SEQ ID NO: 37159 - protein, 5 aa, Neisseria
DKLSQ

SEQ ID NO: 37160 - protein, 5 aa, Neisseria
KKPIE

SEQ ID NO: 37161 - protein, 9 aa, Neisseria
DLSSVGRNP

SEQ ID NO: 37162 - protein, 5 aa, Neisseria
GTHCA

SEQ ID NO: 37163 - protein, 25 aa, Neisseria
VAAEEADGRVAEGGAQGASESAQAS

SEQ ID NO: 37164 - protein, 47 aa, Neisseria
CSNESGSPERTEAAVQGSGEASVPEDYTRIVADRMEGQSKVKVRAEG

SEQ ID NO: 37165 - protein, 10 aa, Neisseria
VIIERDGAVL

SEQ ID NO: 37166 - protein, 10 aa, Neisseria
DWADYDQSGD

SEQ ID NO: 37167 - protein, 20 aa, Neisseria
TVGDRFALQQDGTLIRGETL

SEQ ID NO: 37168 - protein, 54 aa, Neisseria
LDQQTGEAHNVRMETEQGGRRLQSVSRTAEMLGEGRYKLTETQFNTCSAGDAGW

SEQ ID NO: 37169 - protein, 12 aa, Neisseria
ASVEADRGKGIG

SEQ ID NO: 37170 - protein, 11 aa, Neisseria
FPLDGNRKSGL

SEQ ID NO: 37171 - protein, 7 aa, Neisseria
SAGSDGV

SEQ ID NO: 37172 - protein, 26 aa, Neisseria
GIIGERGATFDGQIRYLRPDYSGQTD

SEQ ID NO: 37173 - protein, 15 aa, Neisseria
LPHDKKSGRNNRYQA

SEQ ID NO: 37174 - protein, 11 aa, Neisseria
WQHRHDISDTL

SEQ ID NO: 37175 - protein, 31 aa, Neisseria
DFNQVSDSGYYRDFYGGEEIAGNVNLNRRVW

SEQ ID NO: 37176 - protein, 12 aa, Neisseria
DYGGRAAGGSLN

SEQ ID NO: 37177 - protein, 5 aa, Neisseria
QKYQT

SEQ ID NO: 37178 - protein, 11 aa, Neisseria
ANQSGYKDEPY

SEQ ID NO: 37179 - protein, 16 aa, Neisseria
PRLSADWHKNAGRAQI

SEQ ID NO: 37180 - protein, 12 aa, Neisseria
RFSHDGRQDGSR

SEQ ID NO: 37181 - protein, 6 aa, Neisseria
FSNSWG

SEQ ID NO: 37182 - protein, 6 aa, Neisseria
RPKLGL

SEQ ID NO: 37183 - protein, 12 aa, Neisseria
SFGGKASRSVGR

SEQ ID NO: 37184 - protein, 16 aa, Neisseria
DGGTTFERNTRLFGGG

SEQ ID NO: 37185 - protein, 18 aa, Neisseria
AKSQNDLPNFDSSESSFG

SEQ ID NO: 37186 - protein, 14 aa, Neisseria
FRENLYYGNDRINA

SEQ ID NO: 37187 - protein, 43 aa, Neisseria
RILDGATGEERFRAGIGQKFYFKDDAVMLDGSVGKNPRSRSDW

SEQ ID NO: 37188 - protein, 6 aa, Neisseria
SGGIGG

SEQ ID NO: 37189 - protein, 14 aa, Neisseria
SSIHYNQNDKRAEH

SEQ ID NO: 37190 - protein, 23 aa, Neisseria
AGYRPAPGKVLNARYKYGRNEKI

SEQ ID NO: 37191 - protein, 5 aa, Neisseria
DKLSQ

SEQ ID NO: 37192 - protein, 10 aa, Neisseria
YGFEAKKPIE

SEQ ID NO: 37193 - protein, 10 aa, Neisseria
AEYKSSCGCW

SEQ ID NO: 37194 - protein, 9 aa, Neisseria
VTGENTYKN

SEQ ID NO: 37195 - protein, 18 aa, Neisseria
QLKDLSSVGRNPAGRMDV

SEQ ID NO: 37196 - protein, 10 aa, Neisseria
SLSAGRNKRP

SEQ ID NO: 37197 - protein, 15 aa, Neisseria
VAAEEADGRVAEGGA

SEQ ID NO: 37198 - protein, 9 aa, Neisseria
GASESAQAS

SEQ ID NO: 37199 - protein, 13 aa, Neisseria
NESGSPERTEAAV

SEQ ID NO: 37200 - protein, 12 aa, Neisseria
GSGEASVPEDYT

SEQ ID NO: 37201 - protein, 17 aa, Neisseria
VADRMEGQSKVKVRAEG

SEQ ID NO: 37202 - protein, 8 aa, Neisseria
VIIERDGA

SEQ ID NO: 37203 - protein, 8 aa, Neisseria
ADYDQSGD

SEQ ID NO: 37204 - protein, 7 aa, Neisseria
TLIRGET

SEQ ID NO: 37205 - protein, 39 aa, Neisseria
QQTGEAHNVRMETEQGGRRLQSVSRTAEMLGEGRYKLTE

SEQ ID NO: 37206 - protein, 10 aa, Neisseria
ASVEADRGKG

SEQ ID NO: 37207 - protein, 9 aa, Neisseria
PLDGNRKSG

SEQ ID NO: 37208 - protein, 6 aa, Neisseria
AGSDGV

SEQ ID NO: 37209 - protein, 7 aa, Neisseria
IGERGAT

SEQ ID NO: 37210 - protein, 5 aa, Neisseria
IRYLR

SEQ ID NO: 37211 - protein, 13 aa, Neisseria
HDKKSGRNNRYQA

SEQ ID NO: 37212 - protein, 9 aa, Neisseria
WQHRHDISD

SEQ ID NO: 37213 - protein, 8 aa, Neisseria
SGYKDEPY

SEQ ID NO: 37214 - protein, 12 aa, Neisseria
LSADWHKNAGRA

SEQ ID NO: 37215 - protein, 11 aa, Neisseria
FSHDGRQDGSR

SEQ ID NO: 37216 - protein, 10 aa, Neisseria
FGGKASRSVG

SEQ ID NO: 37217 - protein, 8 aa, Neisseria
TTFERNTR

SEQ ID NO: 37218 - protein, 5 aa, Neisseria
KSQND

SEQ ID NO: 37219 - protein, 5 aa, Neisseria
DSSES

SEQ ID NO: 37220 - protein, 5 aa, Neisseria
DRINA

SEQ ID NO: 37221 - protein, 9 aa, Neisseria
ATGEERFRA

SEQ ID NO: 37222 - protein, 8 aa, Neisseria
YFKDDAVM

SEQ ID NO: 37223 - protein, 11 aa, Neisseria
SVGKNPRSRSD

SEQ ID NO: 37224 - protein, 8 aa, Neisseria
QNDKRAEH

SEQ ID NO: 37225 - protein, 9 aa, Neisseria
YKYGRNEKI

SEQ ID NO: 37226 - protein, 8 aa, Neisseria
FEAKKPIE

SEQ ID NO: 37227 - protein, 5 aa, Neisseria
AEYKS

SEQ ID NO: 37228 - protein, 18 aa, Neisseria
QLKDLSSVGRNPAGRMDV

SEQ ID NO: 37229 - protein, 8 aa, Neisseria
SAGRNKRP

SEQ ID NO: 37230 - protein, 8 aa, Neisseria
AAWARVGG

SEQ ID NO: 37231 - protein, 13 aa, Neisseria
AHHDGHGDDDHGH

SEQ ID NO: 37232 - protein, 12 aa, Neisseria
AHQHGKQDKIIS

SEQ ID NO: 37233 - protein, 7 aa, Neisseria
AQAEKAA

SEQ ID NO: 37234 - protein, 31 aa, Neisseria; identical to SEQ ID NO: 35863

SEQ ID NO: 37235 - protein, 15 aa, Neisseria
VDARTGRVISSRRDD

SEQ ID NO: 37236 - protein, 10 aa, Neisseria
DGHGDDDHGH

SEQ ID NO: 37237 - protein, 10 aa, Neisseria
QHGKQDKIIS

SEQ ID NO: 37238 - protein, 7 aa, Neisseria
AQAEKAA

SEQ ID NO: 37239 - protein, 19 aa, Neisseria
VGGKITDIDLEHDDGRPHY

SEQ ID NO: 37240 - protein, 9 aa, Neisseria
EIVKNGQEY

SEQ ID NO: 37241 - protein, 7 aa, Neisseria
VDARTGR

SEQ ID NO: 37242 - protein, 7 aa, Neisseria
ISSRRDD

SEQ ID NO: 37243 - protein, 24 aa, Neisseria
ERLIARLAREPDSAEDVLNLLRQA

SEQ ID NO: 37244 - protein, 12 aa, Neisseria
DTLTRLEKVLDF

SEQ ID NO: 37245 - protein, 9 aa, Neisseria
DSIERITAY

SEQ ID NO: 37246 - protein, 6 aa, Neisseria
DLLKYM

SEQ ID NO: 37247 - protein, 9 aa, Neisseria
ALLKEFREQ

SEQ ID NO: 37248 - protein, 14 aa, Neisseria
FEDIIEQIVGDIED

SEQ ID NO: 37249 - protein, 9 aa, Neisseria
ESADDIHSV

SEQ ID NO: 37250 - protein, 10 aa, Neisseria
ATEIEDINAF

SEQ ID NO: 37251 - protein, 5 aa, Neisseria
IQELG

SEQ ID NO: 37252 - protein, 10 aa, Neisseria
MDGAQPKTNF

SEQ ID NO: 37253 - protein, 11 aa, Neisseria
LAREPDSAEDV

SEQ ID NO: 37254 - protein, 21 aa, Neisseria
QAHEQEVFDADTLTRLEKVLD

SEQ ID NO: 37255 - protein, 26 aa, Neisseria
AELEVRDAMITRSRMNVLKENDSIER

SEQ ID NO: 37256 - protein, 9 aa, Neisseria
VIGEDKDEV

SEQ ID NO: 37257 - protein, 7 aa, Neisseria
FNPEQFH

SEQ ID NO: 37258 - protein, 5 aa, Neisseria
PEGKS

SEQ ID NO: 37259 - protein, 9 aa, Neisseria
KEFREQRNH

SEQ ID NO: 37260 - protein, 9 aa, Neisseria
IDEYGGTSG

SEQ ID NO: 37261 - protein, 19 aa, Neisseria
IVGDIEDEFDEDESADDIH

SEQ ID NO: 37262 - protein, 6 aa, Neisseria
SAERWR

SEQ ID NO: 37263 - protein, 5 aa, Neisseria
TEIED

SEQ ID NO: 37264 - protein, 11 aa, Neisseria
GTEYGSEEADT

SEQ ID NO: 37265 - protein, 11 aa, Neisseria
GHLPVRGEKVL

SEQ ID NO: 37266 - protein, 9 aa, Neisseria
ARADNRRLH

SEQ ID NO: 37267 - protein, 7 aa, Neisseria
MDGAQPK

SEQ ID NO: 37268 - protein, 11 aa, Neisseria
LAREPDSAEDV

SEQ ID NO: 37269 - protein, 9 aa, Neisseria
QAHEQEVFD

SEQ ID NO: 37270 - protein, 11 aa, Neisseria
DTLTRLEKVLD

SEQ ID NO: 37271 - protein, 26 aa, Neisseria
AELEVRDAMITRSRMNVLKENDSIER

SEQ ID NO: 37272 - protein, 9 aa, Neisseria
VIGEDKDEV

SEQ ID NO: 37273 - protein, 5 aa, Neisseria
PEGKS

SEQ ID NO: 37274 - protein, 8 aa, Neisseria
KEFREQRN

SEQ ID NO: 37275 - protein, 19 aa, Neisseria
IVGDIEDEFDEDESADDIH

SEQ ID NO: 37276 - protein, 6 aa, Neisseria
SAERWR

SEQ ID NO: 37277 - protein, 5 aa, Neisseria
TEIED

SEQ ID NO: 37278 - protein, 8 aa, Neisseria
YGSEEADT

SEQ ID NO: 37279 - protein, 7 aa, Neisseria
VRGEKVL

SEQ ID NO: 37280 - protein, 9 aa, Neisseria
ARADNRRLH

SEQ ID NO: 37281 - protein, 10 aa, Neisseria
NPGKVYRVAS

SEQ ID NO: 37282 - protein, 7 aa, Neisseria
APFESLD

SEQ ID NO: 37283 - protein, 5 aa, Neisseria
NAMAK

SEQ ID NO: 37284 - protein, 15 aa, Neisseria
KVSSSEDLKKMNKVG

SEQ ID NO: 37285 - protein, 6 aa, Neisseria
KIARFE

SEQ ID NO: 37286 - protein, 10 aa, Neisseria
LENGGLDSVV

SEQ ID NO: 37287 - protein, 8 aa, Neisseria
ANYVKNNP

SEQ ID NO: 37288 - protein, 8 aa, Neisseria
GMDFVTLP

SEQ ID NO: 37289 - protein, 17 aa, Neisseria
VKMLNDALEKVRESGEY

SEQ ID NO: 37290 - protein, 10 aa, Neisseria
CGGQGKDAAA

SEQ ID NO: 37291 - protein, 9 aa, Neisseria
AANPGKVYR

SEQ ID NO: 37292 - protein, 13 aa, Neisseria
ESLDSKGNVEGFD

SEQ ID NO: 37293 - protein, 10 aa, Neisseria
IEFKHQPWDS

SEQ ID NO: 37294 - protein, 8 aa, Neisseria
LNNGDADV

SEQ ID NO: 37295 - protein, 16 aa, Neisseria
ITDDRKQSMDFSDPYF

SEQ ID NO: 37296 - protein, 20 aa, Neisseria
VPKGKKVSSSEDLKKMNKVG

SEQ ID NO: 37297 - protein, 9 aa, Neisseria
TGHTGDFSV

SEQ ID NO: 37298 - protein, 12 aa, Neisseria
KLLGNDNPKIAR

SEQ ID NO: 37299 - protein, 16 aa, Neisseria
KELENGGLDSVVSDSA

SEQ ID NO: 37300 - protein, 10 aa, Neisseria
KNNPAKGMDF

SEQ ID NO: 37301 - protein, 5 aa, Neisseria
PDFTT

SEQ ID NO: 37302 - protein, 9 aa, Neisseria
VRKGDEATV

SEQ ID NO: 37303 - protein, 19 aa, Neisseria
MLNDALEKVRESGEYDKIY

SEQ ID NO: 37304 - protein, 10 aa, Neisseria
FAKEGGQAAK

SEQ ID NO: 37305 - protein, 8 aa, Neisseria
GQGKDAAA

SEQ ID NO: 37306 - protein, 13 aa, Neisseria
ESLDSKGNVEGFD

SEQ ID NO: 37307 - protein, 7 aa, Neisseria
NNGDADV

SEQ ID NO: 37308 - protein, 12 aa, Neisseria
ITDDRKQSMDFS

SEQ ID NO: 37309 - protein, 17 aa, Neisseria
PKGKKVSSSEDLKKMNK

SEQ ID NO: 37310 - protein, 7 aa, Neisseria
DNPKIAR

SEQ ID NO: 37311 - protein, 8 aa, Neisseria
KELENGGL

SEQ ID NO: 37312 - protein, 7 aa, Neisseria
NPAKGMD

SEQ ID NO: 37313 - protein, 9 aa, Neisseria
VRKGDEATV

SEQ ID NO: 37314 - protein, 19 aa, Neisseria
MLNDALEKVRESGEYDKIY

SEQ ID NO: 37315 - protein, 10 aa, Neisseria
FAKEGGQAAK

SEQ ID NO: 37316 - protein, 18 aa, Neisseria
RFLQKMVNGVNILPAADW

SEQ ID NO: 37317 - protein, 11 aa, Neisseria
AQMVKEVASKT

SEQ ID NO: 37318 - protein, 7 aa, Neisseria
VAEGMKY

SEQ ID NO: 37319 - protein, 35 aa, Neisseria; identical to SEQ ID NO: 25494

SEQ ID NO: 37320 - protein, 11 aa, Neisseria
AIIAEAMEKVG

SEQ ID NO: 37321 - protein, 9 aa, Neisseria
NELDVVEGM

SEQ ID NO: 37322 - protein, 8 aa, Neisseria
EKQIAGLD

SEQ ID NO: 37323 - protein, 17 aa, Neisseria
ISNIRDLLPVLEQVAKA

SEQ ID NO: 37324 - protein, 11 aa, Neisseria
NNIRGILKTVA

SEQ ID NO: 37325 - protein, 10 aa, Neisseria
TLDDLGQTKR

SEQ ID NO: 37326 - protein, 10 aa, Neisseria
TVIDGFGDAA

SEQ ID NO: 37327 - protein, 10 aa, Neisseria
ERVAKLAGGV

SEQ ID NO: 37328 - protein, 6 aa, Neisseria
LENLHT

SEQ ID NO: 37329 - protein, 15 aa, Neisseria
LRAVESPLRQIVANA

SEQ ID NO: 37330 - protein, 8 aa, Neisseria
EYGDMIGM

SEQ ID NO: 37331 - protein, 5 aa, Neisseria
TRSAL

SEQ ID NO: 37332 - protein, 12 aa, Neisseria
ASQNLRFDNRFL

SEQ ID NO: 37333 - protein, 9 aa, Neisseria
GAKGRNVVV

SEQ ID NO: 37334 - protein, 28 aa, Neisseria
AFGGPHITKDGVTVAKEIELKDKFENMG

SEQ ID NO: 37335 - protein, 18 aa, Neisseria
MVKEVASKTNDVAGDGTT

SEQ ID NO: 37336 - protein, 13 aa, Neisseria
NPTDLKRGIDKAV

SEQ ID NO: 37337 - protein, 17 aa, Neisseria
EELKNIAKPCDTSKEIA

SEQ ID NO: 37338 - protein, 9 aa, Neisseria
ISANSDEQV

SEQ ID NO: 37339 - protein, 26 aa, Neisseria
EAMEKVGKEGVITVEDGKSLENELDV

SEQ ID NO: 37340 - protein, 7 aa, Neisseria
MQFDRGY

SEQ ID NO: 37341 - protein, 7 aa, Neisseria
DAEKQIA

SEQ ID NO: 37342 - protein, 10 aa, Neisseria
FDKKISNIRD

SEQ ID NO: 37343 - protein, 7 aa, Neisseria
QVAKASR

SEQ ID NO: 37344 - protein, 7 aa, Neisseria
EDVEGEA

SEQ ID NO: 37345 - protein, 6 aa, Neisseria
NIRGIL

SEQ ID NO: 37346 - protein, 12 aa, Neisseria
APGFGDRRKAML

SEQ ID NO: 37347 - protein, 31 aa, Neisseria
ISEEVGLSLEKATLDDLGQTKRIEIGEENTT

SEQ ID NO: 37348 - protein, 41 aa, Neisseria; identical to SEQ ID NO: 13537

SEQ ID NO: 37349 - protein, 17 aa, Neisseria
TEVEMKEKKDRVEDALH

SEQ ID NO: 37350 - protein, 7 aa, Neisseria
AAVEEGV

SEQ ID NO: 37351 - protein, 6 aa, Neisseria
RARAAL

SEQ ID NO: 37352 - protein, 12 aa, Neisseria
LHTGNADQDAGV

SEQ ID NO: 37353 - protein, 7 aa, Neisseria
AVESPLR

SEQ ID NO: 37354 - protein, 8 aa, Neisseria
NAGGEPSV

SEQ ID NO: 37355 - protein, 10 aa, Neisseria
VLEGKGNYGY

SEQ ID NO: 37356 - protein, 8 aa, Neisseria
AGSGEYGD

SEQ ID NO: 37357 - protein, 10 aa, Neisseria
DPAKVTRSAL

SEQ ID NO: 37358 - protein, 14 aa, Neisseria
EIPEEKPAVPDMGG

SEQ ID NO: 37359 - protein, 5 aa, Neisseria
LRFDN

SEQ ID NO: 37360 - protein, 8 aa, Neisseria
AKGRNVVV

SEQ ID NO: 37361 - protein, 21 aa, Neisseria
HITKDGVTVAKEIELKDKFEN

SEQ ID NO: 37362 - protein, 18 aa, Neisseria
MVKEVASKTNDVAGDGTT

SEQ ID NO: 37363 - protein, 11 aa, Neisseria
TDLKRGIDKAV

SEQ ID NO: 37364 - protein, 17 aa, Neisseria
EELKNIAKPCDTSKEIA

SEQ ID NO: 37365 - protein, 7 aa, Neisseria
ANSDEQV

SEQ ID NO: 37366 - protein, 26 aa, Neisseria
EAMEKVGKEGVITVEDGKSLENELDV

SEQ ID NO: 37367 - protein, 7 aa, Neisseria
DAEKQIA

SEQ ID NO: 37368 - protein, 10 aa, Neisseria
FDKKISNIRD

SEQ ID NO: 37369 - protein, 7 aa, Neisseria
QVAKASR

SEQ ID NO: 37370 - protein, 7 aa, Neisseria
EDVEGEA

SEQ ID NO: 37371 - protein, 10 aa, Neisseria
GFGDRRKAML

SEQ ID NO: 37372 - protein, 31 aa, Neisseria; identical to SEQ ID NO: 37347

SEQ ID NO: 37373 - protein, 32 aa, Neisseria; identical to SEQ ID NO: 13563

SEQ ID NO: 37374 - protein, 17 aa, Neisseria
TEVEMKEKKDRVEDALH

SEQ ID NO: 37375 - protein, 7 aa, Neisseria
AAVEEGV

SEQ ID NO: 37376 - protein, 6 aa, Neisseria
RARAAL

SEQ ID NO: 37377 - protein, 7 aa, Neisseria
GNADQDA

SEQ ID NO: 37378 - protein, 6 aa, Neisseria
AVESPL

SEQ ID NO: 37379 - protein, 5 aa, Neisseria
AGGEP

SEQ ID NO: 37380 - protein, 6 aa, Neisseria
VLEGKG

SEQ ID NO: 37381 - protein, 7 aa, Neisseria
GSGEYGD

SEQ ID NO: 37382 - protein, 7 aa, Neisseria
DPAKVTR

SEQ ID NO: 37383 - protein, 9 aa, Neisseria
EIPEEKPAV

SEQ ID NO: 37384 - protein, 14 aa, Neisseria
QYFALAALCAALLA

SEQ ID NO: 37385 - protein, 5 aa, Neisseria
CEKAG

SEQ ID NO: 37386 - protein, 8 aa, Neisseria
SFVERIEH

SEQ ID NO: 37387 - protein, 8 aa, Neisseria
PDFAQLVQ

SEQ ID NO: 37388 - protein, 19 aa, Neisseria
DPFYEFFKRLVPNMPEIPQ

SEQ ID NO: 37389 - protein, 6 aa, Neisseria
AGMGSI

SEQ ID NO: 37390 - protein, 8 aa, Neisseria
AKLIGSDV

SEQ ID NO: 37391 - protein, 10 aa, Neisseria
IGNPKNLKPG

SEQ ID NO: 37392 - protein, 6 aa, Neisseria
WVAAIG

SEQ ID NO: 37393 - protein, 10 aa, Neisseria
AEQLKNTGKV

SEQ ID NO: 37394 - protein, 6 aa, Neisseria
AAEHTG

SEQ ID NO: 37395 - protein, 7 aa, Neisseria
RKAMDKA

SEQ ID NO: 37396 - protein, 7 aa, Neisseria
GCEKAGS

SEQ ID NO: 37397 - protein, 22 aa, Neisseria
GADKKEASFVERIEHTKDDGSV

SEQ ID NO: 37398 - protein, 7 aa, Neisseria
VQSEGPA

SEQ ID NO: 37399 - protein, 25 aa, Neisseria
PAPRTQNGSGNAETDSDPLADSDPF

SEQ ID NO: 37400 - protein, 20 aa, Neisseria
KRLVPNMPEIPQEEADDGGL

SEQ ID NO: 37401 - protein, 8 aa, Neisseria
LNDKREYT

SEQ ID NO: 37402 - protein, 10 aa, Neisseria
IGSDVQSDVA

SEQ ID NO: 37403 - protein, 7 aa, Neisseria
DATEELP

SEQ ID NO: 37404 - protein, 11 aa, Neisseria
IGNPKNLKPGE

SEQ ID NO: 37405 - protein, 7 aa, Neisseria
FGFDNSV

SEQ ID NO: 37406 - protein, 13 aa, Neisseria
VSAKGRSLPNESY

SEQ ID NO: 37407 - protein, 8 aa, Neisseria
NPGNSGGP

SEQ ID NO: 37408 - protein, 6 aa, Neisseria
YSRSGG

SEQ ID NO: 37409 - protein, 14 aa, Neisseria
EQLKNTGKVQRGQL

SEQ ID NO: 37410 - protein, 8 aa, Neisseria
FGLDKASG

SEQ ID NO: 37411 - protein, 15 aa, Neisseria
LPGSPAERAGLQAGD

SEQ ID NO: 37412 - protein, 12 aa, Neisseria
LDGGEIRSSGDL

SEQ ID NO: 37413 - protein, 7 aa, Neisseria
TPGKEVS

SEQ ID NO: 37414 - protein, 9 aa, Neisseria
WRKGEEITI

SEQ ID NO: 37415 - protein, 23 aa, Neisseria
AEHTGASSKTDEAPYTEQQSGTF

SEQ ID NO: 37416 - protein, 9 aa, Neisseria
THTDSSGKH

SEQ ID NO: 37417 - protein, 18 aa, Neisseria
RVSDAAERAGLRRGDEIL

SEQ ID NO: 37418 - protein, 19 aa, Neisseria
PVNDEAGFRKAMDKAGKNV

SEQ ID NO: 37419 - protein, 6 aa, Neisseria
MRRGNT

SEQ ID NO: 37420 - protein, 6 aa, Neisseria
GCEKAG

SEQ ID NO: 37421 - protein, 21 aa, Neisseria
GADKKEASFVERIEHTKDDGS

SEQ ID NO: 37422 - protein, 24 aa, Neisseria
PAPRTQNGSGNAETDSDPLADSDP

SEQ ID NO: 37423 - protein, 12 aa, Neisseria
PEIPQEEADDGG

SEQ ID NO: 37424 - protein, 8 aa, Neisseria
LNDKREYT

SEQ ID NO: 37425 - protein, 7 aa, Neisseria
DATEELP

SEQ ID NO: 37426 - protein, 5 aa, Neisseria
KNLKP

SEQ ID NO: 37427 - protein, 7 aa, Neisseria
AKGRSLP

SEQ ID NO: 37428 - protein, 13 aa, Neisseria
EQLKNTGKVQRGQ

SEQ ID NO: 37429 - protein, 6 aa, Neisseria
GLDKAS

SEQ ID NO: 37430 - protein, 9 aa, Neisseria
SPAERAGLQ

SEQ ID NO: 37431 - protein, 10 aa, Neisseria
DGGEIRSSGD

SEQ ID NO: 37432 - protein, 7 aa, Neisseria
TPGKEVS

SEQ ID NO: 37433 - protein, 8 aa, Neisseria
RKGEEITI

SEQ ID NO: 37434 - protein, 20 aa, Neisseria
AEHTGASSKTDEAPYTEQQS

SEQ ID NO: 37435 - protein, 6 aa, Neisseria
HTDSSG

SEQ ID NO: 37436 - protein, 18 aa, Neisseria
RVSDAAERAGLRRGDEIL

SEQ ID NO: 37437 - protein, 17 aa, Neisseria
PVNDEAGFRKAMDKAGK

SEQ ID NO: 37438 - protein, 5 aa, Neisseria
CSSWL

SEQ ID NO: 37439 - protein, 5 aa, Neisseria
PHEAF

SEQ ID NO: 37440 - protein, 4 aa, Neisseria
NTRG

SEQ ID NO: 37441 - protein, 30 aa, Neisseria
HPNIVRLFNPFVLRKWRALGYLTDFPRLNR

SEQ ID NO: 37442 - protein, 7 aa, Neisseria
GDEYFKV

SEQ ID NO: 37443 - protein, 6 aa, Neisseria
LDILAT

SEQ ID NO: 37444 - protein, 13 aa, Neisseria
VGEVSHDFDRYWA

SEQ ID NO: 37445 - protein, 8 aa, Neisseria
ATRIIRSG

SEQ ID NO: 37446 - protein, 7 aa, Neisseria
IGKGLQA

SEQ ID NO: 37447 - protein, 10 aa, Neisseria
SDSPAKGLDR

SEQ ID NO: 37448 - protein, 10 aa, Neisseria
GRLQDALKQP

SEQ ID NO: 37449 - protein, 11 aa, Neisseria
GTDALAKLVQD

SEQ ID NO: 37450 - protein, 7 aa, Neisseria
QATDVAA

SEQ ID NO: 37451 - protein, 15 aa, Neisseria
KIAEQMERTLADTTP

SEQ ID NO: 37452 - protein, 22 aa, Neisseria
PEAKLWKRIAAKILSLLPIEGL

SEQ ID NO: 37453 - protein, 5 aa, Neisseria
MKTRS

SEQ ID NO: 37454 - protein, 18 aa, Neisseria
PLEERTESRHFNTSKPVL

SEQ ID NO: 37455 - protein, 9 aa, Neisseria
HTPHNNGLS

SEQ ID NO: 37456 - protein, 7 aa, Neisseria
ESAEHSL

SEQ ID NO: 37457 - protein, 9 aa, Neisseria
WRNDISGRL

SEQ ID NO: 37458 - protein, 6 aa, Neisseria
AERGVR

SEQ ID NO: 37459 - protein, 12 aa, Neisseria
LLLDDNNTRGLD

SEQ ID NO: 37460 - protein, 5 aa, Neisseria
SHPNI

SEQ ID NO: 37461 - protein, 20 aa, Neisseria
DFPRLNRRMHNKSFTADNRA

SEQ ID NO: 37462 - protein, 17 aa, Neisseria
GGRNIGDEYFKVGEDTV

SEQ ID NO: 37463 - protein, 9 aa, Neisseria
VSHDFDRYW

SEQ ID NO: 37464 - protein, 5 aa, Neisseria
HSAHN

SEQ ID NO: 37465 - protein, 12 aa, Neisseria
RIIRSGNIGKGL

SEQ ID NO: 37466 - protein, 8 aa, Neisseria
GYNDETSR

SEQ ID NO: 37467 - protein, 7 aa, Neisseria
RYRETVE

SEQ ID NO: 37468 - protein, 5 aa, Neisseria
SPLYQ

SEQ ID NO: 37469 - protein, 7 aa, Neisseria
IQTGRID

SEQ ID NO: 37470 - protein, 19 aa, Neisseria
LISDSPAKGLDRDRRKPPI

SEQ ID NO: 37471 - protein, 12 aa, Neisseria
RLQDALKQPEKS

SEQ ID NO: 37472 - protein, 10 aa, Neisseria
VPTKSGTDAL

SEQ ID NO: 37473 - protein, 7 aa, Neisseria
LVQDGID

SEQ ID NO: 37474 - protein, 8 aa, Neisseria
VKYRKPLL

SEQ ID NO: 37475 - protein, 12 aa, Neisseria
ATKDKGLTGSSV

SEQ ID NO: 37476 - protein, 7 aa, Neisseria
VDGKRIF

SEQ ID NO: 37477 - protein, 12 aa, Neisseria
FNLDPRSARLNT

SEQ ID NO: 37478 - protein, 22 aa, Neisseria
ESPKIAEQMERTLADTTPEYAY

SEQ ID NO: 37479 - protein, 30 aa, Neisseria
VTLDKHNRLQWHDPATRKTYPNEPEAKLWK

SEQ ID NO: 37480 - protein, 5 aa, Neisseria
MKTRS

SEQ ID NO: 37481 - protein, 12 aa, Neisseria
LEERTESRHFNT

SEQ ID NO: 37482 - protein, 7 aa, Neisseria
ESAEHSL

SEQ ID NO: 37483 - protein, 6 aa, Neisseria
AERGVR

SEQ ID NO: 37484 - protein, 12 aa, Neisseria
LLLDDNNTRGLD

SEQ ID NO: 37485 - protein, 9 aa, Neisseria
PRLNRRMHN

SEQ ID NO: 37486 - protein, 7 aa, Neisseria
FTADNRA

SEQ ID NO: 37487 - protein, 10 aa, Neisseria
EYFKVGEDTV

SEQ ID NO: 37488 - protein, 7 aa, Neisseria
VSHDFDR

SEQ ID NO: 37489 - protein, 7 aa, Neisseria
YNDETSR

SEQ ID NO: 37490 - protein, 7 aa, Neisseria
RYRETVE

SEQ ID NO: 37491 - protein, 6 aa, Neisseria
QTGRID

SEQ ID NO: 37492 - protein, 15 aa, Neisseria
SPAKGLDRDRRKPPI

SEQ ID NO: 37493 - protein, 12 aa, Neisseria
RLQDALKQPEKS

SEQ ID NO: 37494 - protein, 7 aa, Neisseria
KSGTDAL

SEQ ID NO: 37495 - protein, 7 aa, Neisseria
LVQDGID

SEQ ID NO: 37496 - protein, 8 aa, Neisseria
VKYRKPLL

SEQ ID NO: 37497 - protein, 8 aa, Neisseria
ATKDKGLT

SEQ ID NO: 37498 - protein, 10 aa, Neisseria
LDPRSARLNT

SEQ ID NO: 37499 - protein, 14 aa, Neisseria
ESPKIAEQMERTLA

SEQ ID NO: 37500 - protein, 7 aa, Neisseria
TLDKHNR

SEQ ID NO: 37501 - protein, 17 aa, Neisseria
PATRKTYPNEPEAKLWK

SEQ ID NO: 37502 - protein, 8 aa, Neisseria
SKIESLAR

SEQ ID NO: 37503 - protein, 5 aa, Neisseria
QMRGV

SEQ ID NO: 37504 - protein, 10 aa, Neisseria
DIVERAQSKV

SEQ ID NO: 37505 - protein, 12 aa, Neisseria
AKIIEVLGDYAD

SEQ ID NO: 37506 - protein, 20 aa, Neisseria
HRFSEACAKSAKKIPDHVRK

SEQ ID NO: 37507 - protein, 7 aa, Neisseria
TARDFDD

SEQ ID NO: 37508 - protein, 7 aa, Neisseria
EKVGRNY

SEQ ID NO: 37509 - protein, 13 aa, Neisseria
AIADVSHYVRPDD

SEQ ID NO: 37510 - protein, 5 aa, Neisseria
NLSNG

SEQ ID NO: 37511 - protein, 16 aa, Neisseria
NQVWKWLSDGIGNPHK

SEQ ID NO: 37512 - protein, 14 aa, Neisseria
QIDTLYKLFKILQK

SEQ ID NO: 37513 - protein, 11 aa, Neisseria
LGPTPEKLATL

SEQ ID NO: 37514 - protein, 11 aa, Neisseria
KDYAALAEQFK

SEQ ID NO: 37515 - protein, 10 aa, Neisseria
VMMLRSMQQA

SEQ ID NO: 37516 - protein, 5 aa, Neisseria
YEPHC

SEQ ID NO: 37517 - protein, 24 aa, Neisseria
AYAHFTSPIRRYPDLTVHRAIKAV

SEQ ID NO: 37518 - protein, 13 aa, Neisseria
ADDAGRDVENWLK

SEQ ID NO: 37519 - protein, 9 aa, Neisseria
IFEGKISRG

SEQ ID NO: 37520 - protein, 7 aa, Neisseria
FGIFVTL

SEQ ID NO: 37521 - protein, 9 aa, Neisseria
LVHISDLGE

SEQ ID NO: 37522 - protein, 6 aa, Neisseria
MNKNIK

SEQ ID NO: 37523 - protein, 27 aa, Neisseria
LNLREKDPFLSREKQRYEHPLPSREWI

SEQ ID NO: 37524 - protein, 40 aa, Neisseria; identical to SEQ ID NO: 13714

SEQ ID NO: 37525 - protein, 7 aa, Neisseria
INRRGAV

SEQ ID NO: 37526 - protein, 19 aa, Neisseria
AADKLDLVKCRVEAHKDGF

SEQ ID NO: 37527 - protein, 6 aa, Neisseria
PMDEGD

SEQ ID NO: 37528 - protein, 13 aa, Neisseria
RQMRGVMHGDTVT

SEQ ID NO: 37529 - protein, 15 aa, Neisseria
RPAGMDRRGRREGTF

SEQ ID NO: 37530 - protein, 11 aa, Neisseria
DIVERAQSKVV

SEQ ID NO: 37531 - protein, 7 aa, Neisseria
YMDRGVA

SEQ ID NO: 37532 - protein, 12 aa, Neisseria
LEPEDKRLNQSI

SEQ ID NO: 37533 - protein, 15 aa, Neisseria
LEPDGVARFKPESGQ

SEQ ID NO: 37534 - protein, 11 aa, Neisseria
EVYPEQNRPAV

SEQ ID NO: 37535 - protein, 11 aa, Neisseria
LGDYADSGMEI

SEQ ID NO: 37536 - protein, 39 aa, Neisseria
IAVRKHHLPHRFSEACAKSAKKIPDHVRKSDLKGRVDLC

SEQ ID NO: 37537 - protein, 12 aa, Neisseria
TIDGETARDFDD

SEQ ID NO: 37538 - protein, 8 aa, Neisseria
EKVGRNYR

SEQ ID NO: 37539 - protein, 48 aa, Neisseria
HYVRPDDAIDADAQERSTSVYFPRRMIPMLPENLSNGICSLNPDVERL

SEQ ID NO: 37540 - protein, 9 aa, Neisseria
AGNIKEYRF

SEQ ID NO: 37541 - protein, 5 aa, Neisseria
LTYNQ

SEQ ID NO: 37542 - protein, 13 aa, Neisseria
LSDGIGNPHKAQI

SEQ ID NO: 37543 - protein, 17 aa, Neisseria
LQKKRLARGAVEFESVE

SEQ ID NO: 37544 - protein, 11 aa, Neisseria
MIFDDNGKIEK

SEQ ID NO: 37545 - protein, 10 aa, Neisseria
VRNDAHKLIE

SEQ ID NO: 37546 - protein, 7 aa, Neisseria
LKNKHTA

SEQ ID NO: 37547 - protein, 16 aa, Neisseria
HLGPTPEKLATLREQL

SEQ ID NO: 37548 - protein, 13 aa, Neisseria
GGGDNPSPKDYAA

SEQ ID NO: 37549 - protein, 11 aa, Neisseria
EQFKGRPDAEL

SEQ ID NO: 37550 - protein, 8 aa, Neisseria
YEPHCEGH

SEQ ID NO: 37551 - protein, 11 aa, Neisseria
SPIRRYPDLTV

SEQ ID NO: 37552 - protein, 13 aa, Neisseria
VLNRKTYTPNKSW

SEQ ID NO: 37553 - protein, 15 aa, Neisseria
FCERRADDAGRDVEN

SEQ ID NO: 37554 - protein, 19 aa, Neisseria
YMRDKVGEIFEGKISRGVA

SEQ ID NO: 37555 - protein, 12 aa, Neisseria
SDLGEDYFNFRP

SEQ ID NO: 37556 - protein, 33 aa, Neisseria; identical to SEQ ID NO: 13749

SEQ ID NO: 37557 - protein, 10 aa, Neisseria
ESGRRRKVKL

SEQ ID NO: 37558 - protein, 35 aa, Neisseria
ASAKPAGAAGKGKSKTTAEKKTARCGKVRGRGVPA

SEQ ID NO: 37559 - protein, 22 aa, Neisseria
AESGKKAKKPVPIKVKKRKGKS

SEQ ID NO: 37560 - protein, 6 aa, Neisseria
MNKNIK

SEQ ID NO: 37561 - protein, 19 aa, Neisseria
LNLREKDPFLSREKQRYEH

SEQ ID NO: 37562 - protein, 40 aa, Neisseria; identical to SEQ ID NO: 13714

SEQ ID NO: 37563 - protein, 6 aa, Neisseria
INRRGA

SEQ ID NO: 37564 - protein, 19 aa, Neisseria
AADKLDLVKCRVEAHKDGF

SEQ ID NO: 37565 - protein, 6 aa, Neisseria
PMDEGD

SEQ ID NO: 37566 - protein, 12 aa, Neisseria
AGMDRRGRREGT

SEQ ID NO: 37567 - protein, 10 aa, Neisseria
IVERAQSKVV

SEQ ID NO: 37568 - protein, 9 aa, Neisseria
LEPEDKRLN

SEQ ID NO: 37569 - protein, 14 aa, Neisseria
LEPDGVARFKPESG

SEQ ID NO: 37570 - protein, 11 aa, Neisseria
EVYPEQNRPAV

SEQ ID NO: 37571 - protein, 8 aa, Neisseria
YADSGMEI

SEQ ID NO: 37572 - protein, 8 aa, Neisseria
IAVRKHHL

SEQ ID NO: 37573 - protein, 28 aa, Neisseria
RFSEACAKSAKKIPDHVRKSDLKGRVDL

SEQ ID NO: 37574 - protein, 11 aa, Neisseria
IDGETARDFDD

SEQ ID NO: 37575 - protein, 7 aa, Neisseria
EKVGRNY

SEQ ID NO: 37576 - protein, 16 aa, Neisseria
VRPDDAIDADAQERST

SEQ ID NO: 37577 - protein, 5 aa, Neisseria
PDVER

SEQ ID NO: 37578 - protein, 6 aa, Neisseria
NIKEYR

SEQ ID NO: 37579 - protein, 9 aa, Neisseria
IGNPHKAQI

SEQ ID NO: 37580 - protein, 17 aa, Neisseria
LQKKRLARGAVEFESVE

SEQ ID NO: 37581 - protein, 11 aa, Neisseria
MIFDDNGKIEK

SEQ ID NO: 37582 - protein, 10 aa, Neisseria
VRNDAHKLIE

SEQ ID NO: 37583 - protein, 13 aa, Neisseria
PTPEKLATLREQL

SEQ ID NO: 37584 - protein, 12 aa, Neisseria
GGDNPSPKDYAA

SEQ ID NO: 37585 - protein, 11 aa, Neisseria
EQFKGRPDAEL

SEQ ID NO: 37586 - protein, 7 aa, Neisseria
PIRRYPD

SEQ ID NO: 37587 - protein, 9 aa, Neisseria
VLNRKTYTP

SEQ ID NO: 37588 - protein, 15 aa, Neisseria
FCERRADDAGRDVEN

SEQ ID NO: 37589 - protein, 16 aa, Neisseria
YMRDKVGEIFEGKISR

SEQ ID NO: 37590 - protein, 11 aa, Neisseria
IMAIEGERSGI

SEQ ID NO: 37591 - protein, 20 aa, Neisseria
NMGDRVAVRVARADLDDGKI

SEQ ID NO: 37592 - protein, 10 aa, Neisseria
ESGRRRKVKL

SEQ ID NO: 37593 - protein, 32 aa, Neisseria
ASAKPAGAAGKGKSKTTAEKKTARCGKVRGRG

SEQ ID NO: 37594 - protein, 22 aa, Neisseria
AESGKKAKKPVPIKVKKRKGKS

SEQ ID NO: 37595 - protein, 8 aa, Neisseria
AQSTANAA

SEQ ID NO: 37596 - protein, 6 aa, Neisseria
AGLTKL

SEQ ID NO: 37597 - protein, 5 aa, Neisseria
SATDF

SEQ ID NO: 37598 - protein, 6 aa, Neisseria
PHIYGA

SEQ ID NO: 37599 - protein, 9 aa, Neisseria
ELRKYADGI

SEQ ID NO: 37600 - protein, 7 aa, Neisseria
ATPSNPT

SEQ ID NO: 37601 - protein, 5 aa, Neisseria
VTPES

SEQ ID NO: 37602 - protein, 9 aa, Neisseria
SVHGMYKVS

SEQ ID NO: 37603 - protein, 6 aa, Neisseria
WTRHSR

SEQ ID NO: 37604 - protein, 7 aa, Neisseria
SYQISEP

SEQ ID NO: 37605 - protein, 10 aa, Neisseria
SCARFKNHAD

SEQ ID NO: 37606 - protein, 6 aa, Neisseria
NAADAS

SEQ ID NO: 37607 - protein, 12 aa, Neisseria
PAGLTKLDSSQI

SEQ ID NO: 37608 - protein, 10 aa, Neisseria
YEADSATDFT

SEQ ID NO: 37609 - protein, 13 aa, Neisseria
VQGSKNGKITKTT

SEQ ID NO: 37610 - protein, 7 aa, Neisseria
KVNDNLT

SEQ ID NO: 37611 - protein, 12 aa, Neisseria
GSATEYEKDSVL

SEQ ID NO: 37612 - protein, 6 aa, Neisseria
NINKLG

SEQ ID NO: 37613 - protein, 9 aa, Neisseria
KLNERHSFG

SEQ ID NO: 37614 - protein, 18 aa, Neisseria
HNSAELRKYADGIPKKAQ

SEQ ID NO: 37615 - protein, 5 aa, Neisseria
TPSNP

SEQ ID NO: 37616 - protein, 15 aa, Neisseria
IKADGHADVKGSDWG

SEQ ID NO: 37617 - protein, 28 aa, Neisseria
DINDRARVGVNYRSKVSHTLKGDAEWAA

SEQ ID NO: 37618 - protein, 12 aa, Neisseria
GAAAKQQWNDNM

SEQ ID NO: 37619 - protein, 7 aa, Neisseria
ANEKASV

SEQ ID NO: 37620 - protein, 5 aa, Neisseria
VTPES

SEQ ID NO: 37621 - protein, 9 aa, Neisseria
YKVSDKADL

SEQ ID NO: 37622 - protein, 8 aa, Neisseria
TRHSRFNK

SEQ ID NO: 37623 - protein, 29 aa, Neisseria
LFFEKEKNIANGKKSDRTTITPNWRNTYK

SEQ ID NO: 37624 - protein, 10 aa, Neisseria
GLGGSYQISE

SEQ ID NO: 37625 - protein, 21 aa, Neisseria
FDKPPVRNADYRMNSLPDGNR

SEQ ID NO: 37626 - protein, 7 aa, Neisseria
HIGKNHV

SEQ ID NO: 37627 - protein, 29 aa, Neisseria
NDTSYRTAKASGNDVDSKGASCARFKNHA

SEQ ID NO: 37628 - protein, 7 aa, Neisseria
TKLDSSQ

SEQ ID NO: 37629 - protein, 7 aa, Neisseria
YEADSAT

SEQ ID NO: 37630 - protein, 10 aa, Neisseria
QGSKNGKITK

SEQ ID NO: 37631 - protein, 9 aa, Neisseria
TEYEKDSVL

SEQ ID NO: 37632 - protein, 7 aa, Neisseria
KLNERHS

SEQ ID NO: 37633 - protein, 17 aa, Neisseria
NSAELRKYADGIPKKAQ

SEQ ID NO: 37634 - protein, 13 aa, Neisseria
IKADGHADVKGSD

SEQ ID NO: 37635 - protein, 7 aa, Neisseria
INDRARV

SEQ ID NO: 37636 - protein, 5 aa, Neisseria
YRSKV

SEQ ID NO: 37637 - protein, 9 aa, Neisseria
LKGDAEWAA

SEQ ID NO: 37638 - protein, 7 aa, Neisseria
ANEKASV

SEQ ID NO: 37639 - protein, 8 aa, Neisseria
KVSDKADL

SEQ ID NO: 37640 - protein, 5 aa, Neisseria
SRFNK

SEQ ID NO: 37641 - protein, 20 aa, Neisseria
LFFEKEKNIANGKKSDRTTI

SEQ ID NO: 37642 - protein, 13 aa, Neisseria
FDKPPVRNADYRM

SEQ ID NO: 37643 - protein, 6 aa, Neisseria
SLPDGN

SEQ ID NO: 37644 - protein, 19 aa, Neisseria
TSYRTAKASGNDVDSKGAS

SEQ ID NO: 37645 - protein, 7 aa, Neisseria
ARFKNHA

SEQ ID NO: 37646 - protein, 14 aa, Neisseria
RHLKNMQIKKIMKW

SEQ ID NO: 37647 - protein, 9 aa, Neisseria
LSLLGALGY

SEQ ID NO: 37648 - protein, 8 aa, Neisseria
AVLDVLGT

SEQ ID NO: 37649 - protein, 11 aa, Neisseria
HSYTGTVSKVY

SEQ ID NO: 37650 - protein, 8 aa, Neisseria
YQREVAQV

SEQ ID NO: 37651 - protein, 5 aa, Neisseria
QVQDG

SEQ ID NO: 37652 - protein, 5 aa, Neisseria
DFADY

SEQ ID NO: 37653 - protein, 9 aa, Neisseria
MFRRHRHLK

SEQ ID NO: 37654 - protein, 9 aa, Neisseria
TGYDSEAVR

SEQ ID NO: 37655 - protein, 8 aa, Neisseria
GTAGDVGF

SEQ ID NO: 37656 - protein, 15 aa, Neisseria
APVRRRASAKSGHSY

SEQ ID NO: 37657 - protein, 8 aa, Neisseria
SKVYDGDT

SEQ ID NO: 37658 - protein, 10 aa, Neisseria
IDGDGAKHKI

SEQ ID NO: 37659 - protein, 27 aa, Neisseria
DAPEMKQAYGTRSRDNLRAAAEGRKVS

SEQ ID NO: 37660 - protein, 12 aa, Neisseria
VFETDRYQREVA

SEQ ID NO: 37661 - protein, 7 aa, Neisseria
SAGKTDL

SEQ ID NO: 37662 - protein, 13 aa, Neisseria
KSYAKEQQDKADF

SEQ ID NO: 37663 - protein, 20 aa, Neisseria
QIQAERERKGLWKAKNPQAP

SEQ ID NO: 37664 - protein, 21 aa, Neisseria
AYRRAGRSGGGNKDWMDSVGE

SEQ ID NO: 37665 - protein, 9 aa, Neisseria
MFRRHRHLK

SEQ ID NO: 37666 - protein, 7 aa, Neisseria
YDSEAVR

SEQ ID NO: 37667 - protein, 13 aa, Neisseria
APVRRRASAKSGH

SEQ ID NO: 37668 - protein, 7 aa, Neisseria
KVYDGDT

SEQ ID NO: 37669 - protein, 10 aa, Neisseria
IDGDGAKHKI

SEQ ID NO: 37670 - protein, 7 aa, Neisseria
DAPEMKQ

SEQ ID NO: 37671 - protein, 19 aa, Neisseria
YGTRSRDNLRAAAEGRKVS

SEQ ID NO: 37672 - protein, 12 aa, Neisseria
VFETDRYQREVA

SEQ ID NO: 37673 - protein, 7 aa, Neisseria
SAGKTDL

SEQ ID NO: 37674 - protein, 12 aa, Neisseria
SYAKEQQDKADF

SEQ ID NO: 37675 - protein, 17 aa, Neisseria
QIQAERERKGLWKAKNP

SEQ ID NO: 37676 - protein, 16 aa, Neisseria
RAGRSGGGNKDWMDSV

SEQ ID NO: 37677 - protein, 11 aa, Neisseria
GSFQGPLDLLL

SEQ ID NO: 37678 - protein, 11 aa, Neisseria
TGQYLHYIAQM

SEQ ID NO: 37679 - protein, 8 aa, Neisseria
GLDALPRA

SEQ ID NO: 37680 - protein, 13 aa, Neisseria
EVYIADLMQAWLG

SEQ ID NO: 37681 - protein, 8 aa, Neisseria
HTRSHEVI

SEQ ID NO: 37682 - protein, 21 aa, Neisseria
MTAILRRLNEHGICRFHALFN

SEQ ID NO: 37683 - protein, 8 aa, Neisseria
IVNFIALL

SEQ ID NO: 37684 - protein, 6 aa, Neisseria
SFQGPL

SEQ ID NO: 37685 - protein, 6 aa, Neisseria
RKQNID

SEQ ID NO: 37686 - protein, 22 aa, Neisseria
LLLPRTEAVEDEEADPRAELVR

SEQ ID NO: 37687 - protein, 9 aa, Neisseria
ALPRAGRDF

SEQ ID NO: 37688 - protein, 8 aa, Neisseria
IAAETKLP

SEQ ID NO: 37689 - protein, 13 aa, Neisseria
SRAKHTRSHEVIQ

SEQ ID NO: 37690 - protein, 8 aa, Neisseria
RRLNEHGI

SEQ ID NO: 37691 - protein, 5 aa, Neisseria
NPEQG

SEQ ID NO: 37692 - protein, 6 aa, Neisseria
LAKEGL

SEQ ID NO: 37693 - protein, 11 aa, Neisseria
VQEDGFGEIRI

SEQ ID NO: 37694 - protein, 21 aa, Neisseria
LNHEGAHSDGIFGTRGGRDVF

SEQ ID NO: 37695 - protein, 6 aa, Neisseria
RKQNID

SEQ ID NO: 37696 - protein, 22 aa, Neisseria
LLLPRTEAVEDEEADPRAELVR

SEQ ID NO: 37697 - protein, 7 aa, Neisseria
ALPRAGR

SEQ ID NO: 37698 - protein, 8 aa, Neisseria
IAAETKLP

SEQ ID NO: 37699 - protein, 13 aa, Neisseria
SRAKHTRSHEVIQ

SEQ ID NO: 37700 - protein, 5 aa, Neisseria
RRLNE

SEQ ID NO: 37701 - protein, 6 aa, Neisseria
LAKEGL

SEQ ID NO: 37702 - protein, 7 aa, Neisseria
VQEDGFG

SEQ ID NO: 37703 - protein, 7 aa, Neisseria
RGGRDVF

SEQ ID NO: 37704 - protein, 10 aa, Neisseria
KSARTHAKIP

SEQ ID NO: 37705 - protein, 16 aa, Neisseria
PGESYPAQLQKLTGWN

SEQ ID NO: 37706 - protein, 11 aa, Neisseria
TSAQALSRLPA

SEQ ID NO: 37707 - protein, 7 aa, Neisseria
LRKVPEE

SEQ ID NO: 37708 - protein, 11 aa, Neisseria
NIAKIIETVQK

SEQ ID NO: 37709 - protein, 10 aa, Neisseria
LGALFGHLSD

SEQ ID NO: 37710 - protein, 5 aa, Neisseria
GAWAE

SEQ ID NO: 37711 - protein, 21 aa, Neisseria
NGKGYRKFAENLNQFLRKHGF

SEQ ID NO: 37712 - protein, 6 aa, Neisseria
MNRRTF

SEQ ID NO: 37713 - protein, 17 aa, Neisseria
CGRKSARTHAKIPEGST

SEQ ID NO: 37714 - protein, 10 aa, Neisseria
YGANPGESYP

SEQ ID NO: 37715 - protein, 9 aa, Neisseria
GGVSGDTSA

SEQ ID NO: 37716 - protein, 6 aa, Neisseria
LARKPK

SEQ ID NO: 37717 - protein, 18 aa, Neisseria
GGNDFLRKVPEEQTRANI

SEQ ID NO: 37718 - protein, 8 aa, Neisseria
ETVQKENI

SEQ ID NO: 37719 - protein, 14 aa, Neisseria
SDHPLYEDLSEEYG

SEQ ID NO: 37720 - protein, 34 aa, Neisseria
GNNNLKSDQIHANGKGYRKFAENLNQFLRKHGFR

SEQ ID NO: 37721 - protein, 14 aa, Neisseria
CGRKSARTHAKIPE

SEQ ID NO: 37722 - protein, 6 aa, Neisseria
NPGESY

SEQ ID NO: 37723 - protein, 7 aa, Neisseria
VSGDTSA

SEQ ID NO: 37724 - protein, 6 aa, Neisseria
LARKPK

SEQ ID NO: 37725 - protein, 15 aa, Neisseria
DFLRKVPEEQTRANI

SEQ ID NO: 37726 - protein, 8 aa, Neisseria
ETVQKENI

SEQ ID NO: 37727 - protein, 8 aa, Neisseria
EDLSEEYG

SEQ ID NO: 37728 - protein, 10 aa, Neisseria
NLKSDQIHAN

SEQ ID NO: 37729 - protein, 8 aa, Neisseria
KGYRKFAE

SEQ ID NO: 37730 - protein, 8 aa, Neisseria
WAGLSAAV

SEQ ID NO: 37731 - protein, 12 aa, Neisseria
YRGVLRLMKTIG

SEQ ID NO: 37732 - protein, 8 aa, Neisseria
PLPAPLHI

SEQ ID NO: 37733 - protein, 24 aa, Neisseria
RVPSAFKAKLLADMSDLQKSARLG

SEQ ID NO: 37734 - protein, 13 aa, Neisseria
AAVMQFWQPLVWG

SEQ ID NO: 37735 - protein, 8 aa, Neisseria
VLCNVLSD

SEQ ID NO: 37736 - protein, 7 aa, Neisseria
ALAELQR

SEQ ID NO: 37737 - protein, 6 aa, Neisseria
RLNTLP

SEQ ID NO: 37738 - protein, 10 aa, Neisseria
EGTPEHVQTA

SEQ ID NO: 37739 - protein, 17 aa, Neisseria
YAEPVRLPAPLTGIADG

SEQ ID NO: 37740 - protein, 9 aa, Neisseria
NTPHPRPKI

SEQ ID NO: 37741 - protein, 21 aa, Neisseria
EAGRQAGGRARTLAGNTDGFG

SEQ ID NO: 37742 - protein, 10 aa, Neisseria
KTIGSDPRAA

SEQ ID NO: 37743 - protein, 8 aa, Neisseria
RRVPSAFK

SEQ ID NO: 37744 - protein, 20 aa, Neisseria
LLADMSDLQKSARLGQPDTT

SEQ ID NO: 37745 - protein, 8 aa, Neisseria
LKQRNVPR

SEQ ID NO: 37746 - protein, 7 aa, Neisseria
TPLETAS

SEQ ID NO: 37747 - protein, 18 aa, Neisseria
GVLTKKSGSDYLLPKQDL

SEQ ID NO: 37748 - protein, 17 aa, Neisseria
ELQRLGADIRLETRVCR

SEQ ID NO: 37749 - protein, 8 aa, Neisseria
NTLPDGKV

SEQ ID NO: 37750 - protein, 9 aa, Neisseria
LPEGTPEHV

SEQ ID NO: 37751 - protein, 13 aa, Neisseria
PGQAPDCPQNEVS

SEQ ID NO: 37752 - protein, 11 aa, Neisseria
VSDRVGAFANR

SEQ ID NO: 37753 - protein, 7 aa, Neisseria
PHPRPKI

SEQ ID NO: 37754 - protein, 16 aa, Neisseria
EAGRQAGGRARTLAGN

SEQ ID NO: 37755 - protein, 8 aa, Neisseria
IGSDPRAA

SEQ ID NO: 37756 - protein, 5 aa, Neisseria
RRVPS

SEQ ID NO: 37757 - protein, 20 aa, Neisseria
LLADMSDLQKSARLGQPDTT

SEQ ID NO: 37758 - protein, 8 aa, Neisseria
VLTKKSGS

SEQ ID NO: 37759 - protein, 7 aa, Neisseria
LLPKQDL

SEQ ID NO: 37760 - protein, 17 aa, Neisseria
ELQRLGADIRLETRVCR

SEQ ID NO: 37761 - protein, 5 aa, Neisseria
PDGKV

SEQ ID NO: 37762 - protein, 6 aa, Neisseria
GTPEHV

SEQ ID NO: 37763 - protein, 10 aa, Neisseria
QAPDCPQNEV

SEQ ID NO: 37764 - protein, 6 aa, Neisseria
VSDRVG

SEQ ID NO: 37765 - protein, 83 aa, Neisseria; identical to SEQ ID NO: 13365

SEQ ID NO: 37766 - DNA, 36471 bp, Neisseria meningitidis
gaaaattcagcagcagcaggaagattgccagcatttgcgcggcggttttaaacttaccgacggtggcgacggcaacgctgttccttttgcccatttgcgccatccattcgcgcaatgcggaaatggtaatttccctgccgatgatgatcatggcaaacaaaacataggtccggtcgagtttgaccagtaaaagcaaagagacggcgaccatcagcttgtcggcaacgggatcgaggaaggcgccgaaatccgaggtctgtttccacaaccttgccaaaaatccgtcaaaccagtcggtcaaggcggcaacggcaaaaatgacggcggcggtgagattaatcgtttcctccgcgaaccacggaaaaggcaggtaaaaaagggctgtcaggacaggaatgagcaagaccctcaaccatgtgaggaagatggggagattccaaggcatcggttttctctgtgcagactgtaaagttgtgattataacggttatcctcataacccaaaacgtaaaattgctgcatgggcattcccccgccccgccaatctgttttcacattcttttcaaacgcaggaaaatggcgggcaataaaagcaaaatacccagtttcaggctgaaaacggcaggttgtgccaacacttcgacaaggcggtcttccgtgcgggcaaaatctttattgcttatagacactgccactgttgcggtattccaacagaacgccgtttaaaaaacctttgccgacggtttcgcttaaaacggctctaacctgctccgccctgatggttctgccgatattgccgcctgtgcacaaactgtcgaacccatagcaggaaagccggtaatgctgcccgtctgcatccagtttgattgcccgtccgctgcggttgagggcggtaacggtcaattccgcatattcgaatgttttttcttgttcgtgaaatgccgtcaggtaaggtgcaataaaaacggcggacaacagcagacagcttatggcggcaaaccatacccagcgataatatagtggattaaatttaaaccagtacagcgttgcctcgccttagctcaaagagaacgattctctaaggtgctgaagcaccaagtgaatcggttccgtactatttgtactgtctgcggcttcgtcgccttgtcctgatttaaatttaatccactatatttcacgcttaccccttgtttctcaaatgccgtctgaaataagcggcttaatatattgtttacagtattgggaagcataacagacaaaatgccgtctgaaatattttcagacggcatttcttatccgaaacggattatttttgcgtttcaaccgcttccaatgcacgcagggcataagtgtaagcggcacccgcattcagggcaatggcggttgccaatgcacctgcgatttcgctgtcggtcgcaccggctttggtggcggcggcggcgtgaacactgatgcagctctcacaacgtgtagtaatggcaacggcgatggcaatcagttcgcgtgttttagcatcaagtgcctctgcagctgccgcttgttccaatgcgccgtaggcctgcagcattttaggatgcgccttacccagctcgccgaacgattttttaaccaatgcggtatgttctttccaatctttaaacattttcttttcctttctcttgcgtttaaccctgatacgcgcttgcgtatctgttttcgatgtgcgtattattgcaattattcagttgtgtttctcgtttaatcatctcattttatggttcaaaaagatttatggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaagcgggcaaaaataaatcggggcttcaaacgcaaatgccgtctgaaaaggctttcatacagcatttgcgtaccgcgtcatttcaagggctgcatcttcatcacttccatcaaaaagttggtaaatgcggggttgttgggtttgacatccatatttttccaacgctgctgccagccgcgcaaggcattctggatatacagcttggactgttccgtattgattgcgccccgctggctgtctatcgccgaacgcaggtagatttcatacatactgtcatcgacggcattgcgtccgaccaggcgttttctgaagttgttcagatattgcgccgcctgaaccttggtcattttaccgatacccacctgatagcccaagcgcgtcgcttcatcgctgattttggcaacatccgtccaatgcgaagaggcaaggcggaaaccttttgcaggtgcttccgttttgacggtattgataggattcacggggatttccgtcaatgtgggcacataaatagactggcagccggaaagaactgccgcaatggaaagagggataaggtattttttcatgcccccattataatcaagtttgccttgagaaaacaaattgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataaaaaatgccgtccgaacatccttcagacggcatatcgggctttatttccccgccttcacatcctgccactggcgcaccataaacttcaatgccgccggctggataggcaccatgataaagctgtttttcaaatcctcctcggttgggaaaatcgtattgtcgtttttaaattcgtcttccatcagctcacgcgcaggcttgctcgaaggcgcgtaagtaacgaaattgccgtttttcgccgacacttccgggtcgaggaagtcgttgatgtatttgtgcgcgttggcgacgtttttcgcatctttcggaatcacgaaagaatccacccaaatccccacgccctctttgggcatcatcacgcggattttttccttgccgcccgcttcttcggcacggcgtttggcgatgttcaaatcgccgccgaaaccgattgttacgcaggtatcgccgcgcgccaaatcatcgataaagccggacgaagtaaagcgtttgatattggggcggtttttcttgagtagggcggttgcctccctgatgtcttccgtattgctgctgttcgggtttttacccaaatagttcaacaccataggatagatttccgccgcgctgtccaaatagctgatgccgcattgcttgagtttggacgtgtattcggggtcgaacaccaaatcccactggttgtccggcagcttgtccgtacccaaagcctttttcacgcgttcggtattgatggcgaaggtatttgtcccccaataaaacggcacggcgtattcgtggccgggatcgaccccgtccatcagcctcatcatttcggggttgaggtgtttataattgggaatcagcgacttatcgattttctgatacgcacctgccttaatctgcctgcccacaaacgcattggacggcgcgacaatgtcgtaaccggacttgcctgtcagcaccttgctttccagcgtttcatcgctgtcgtacacatcataagtaaccttgatgccgtttttcttttcaaaatcggcaacggtttccggatcgacatattccgaccagttgtaaattttcaatacgttttggttttccgccggtgccggtttttcggcaggcggtttgtccgaaccgccgcacgctgcaagcagcaaagcagtcaggacggccaggggcagatgtttggtcattatcattccttgcatatcgggttggagaaagcggccattatagccgatattggcaacagggcttcagacggcattcaaaatcccgccacactcttccgaaaaccgccgcttccatagctagaaacagggatttgcggtaagataccgccgttcgttttccctgcttttaccatgacaagacatttgagagacattgaaaaaattatgaaaacctccgaactgcgccaaaaattcctaaaattttttgaaaccaaaggccacaccgtcgtccgctcttccagcctcgtgccgcacgacgacccgaccctgctgtttaccaacgcgggcatgaaccagtttaaagacgtattcttaggtttcgacaaacgcccgtacagccgcgccaccaccgcgcaaaaatgcgtacgcgcaggcggcaaacacaacgacttggaaaacgtcggctacaccgcccgccaccacaccttctttgaaatgatgggcaacttctccttcggcgactacttcaaacgcgacgccatccacttcgcttgggaatttctgacttcccccgaatggctcaacatccctaaagacaaactgttggcgaccgtttacgcggaagacgacgaagcctacaacatctggttgaacgaaatcggtatgccgtccgagcgcatcgtccgcatcggcgacaacaaaggcgcgaaatacgcatccgacaacttctggcaaatgggcgacaccggcccttgcggcccctgctccgaaattttctacgaccacggcgaagaaatctggggcggcattcccggcagtcccgaagaagacggcgaccgctggatcgaaatttggaactgcgtatttatgcagttcaaccgcgacgaacaaggcaatatgaacccgcttcccaaaccttccgtcgataccggtatgggcttggaacgcatagccgccgtcatgcagcatgttcacagcaactacgaaatcgacttgttccaagacctgctcaaagccgttgcccgcgaaaccggcgcgccgttcagaatggaagaacccagcctgaaagtcatcgccgaccacatccgctcctgctcgttcctgattgcagacggcgtcttgccttccaacgaaggccgcggctacgtattgcgccgcattatccgccgcgccgtgcgccacggttacaaactgggtcaaagcaaaccgttcttccacaaactcgttgccgatttggtcaaagagatgggcggtgcctaccctgaattgaaagaaaaacaagcccaaatcgaagaagcattgaaaaacgaagaaagccgttttgcccaaacgctggaaaccggtatggctttgttggaaaacgcgctggtyaaaggcggcaaaacactcggcggcgaaatcatcttcaaactctacgatacctacggtttcccatacgacttgactgccgacatctgccgcgaacgcaatatcgaaccggacgaagcaggcttcgagcgcgaaatggaagcccaacgcgcacgcgcacgcgccgcccaaagcttcaaagccaacgcccaactgccttatgacggtcaagacaccgagtttaaaggttatagcgaacgccaaaccgaatccaaagtcctcgccctctacaaagacggcgagcaagtcaacgaattgaacgaaggcgacagcggcgcagtcgtcatcgactttaccccgttctatgcagaatccggcggccaagtcggcgatgtcggctatatcttctcaggcgaaaaccgctttgaagtacgcgatacccaaaaaatcaaagcggccgtattcggtcaattcggcgtacaaacttcaggccgtctgaaagtcggcgacagcgttaccgccaaagtggacgacgaaatccgcaatgccaatatgcgcaaccacagcgcaacccacttgatgcacaaagccctgcgcgatgtattgggcagacacgtcgaacaaaaaggctctttggttaccgccgaatccacccgtttcgacatttcccatccccaagcggtaactgccgaagaaattgccgaagtagaacgccgcgtcaacgaagccattttggcgaacgttgccgtcaatgcagccattatgagcatggaagacgcgcaaaaaaccggcgcgatgatgctcttcggcgaaaaatacggcgaagaagtgcgcgtactgcaaatgggcggtttctctaccgaattgtgcggcggcacacacgtttcacgcaccggcgacatcggcctcttcaaaatcatcagcgaaggcggtattgccgcaggcgtgcgccgtatcgaagccatcaccggcctgaacgcactcaaatgggcgcaagagcaagagcgtttggtgaaagacattattgccgaaaccaaagcccaaaccgaaaaagacgtactggcaaaaatccaagcaggcgcggcacacgccaaagcattggaaaaagaattggcacgcgccaaagccgaactcgccgtccacgcaggcgccaaactcttggacgatgcaaaagacttgggcgcagccaaactcgttgccgcccaaatcgaagccgacgcagccgccctgcgcgaaatcgttaccgatttaaccggtaaatccgacaacgccgtgattcttttagcggcagtaaacgacggcaaagtctccctgtgcgccggcgtatccaaaccgttgaccggcaaagtgaaagcaggcgatctggttaaatttgcagccgaacaagtcggcggcaaaggcggcggcagaccagatttggcgcaagccggcggcacggatgccgacaaattgcccgccgtgttggatagcgtgaaagactgggtcggcgcgaagctggtttgatgtgggaaaggcagcctgaaaggtttcaggctgccttttgtgcaaagaggccgtctgaaaggtctcgtttgccgtaggttgggtcgcgacccaacaaattttgtgaagtataaaaatgttggtcatgacccaacctacctgcctttttgtacaaagaggctatctgaaaggccttgtttgccgtatggtgggtcgcgacccagcagatttttattagggtatgacccaagctacttgctacgataaaaaaggatttttaaatgagcattagccttattggactacacattaccatagcaatcattttgttttttactacaaattttatgggaaaaaaatcatctatatttggctattaccaactgtcttttagcgaagaaaatcactctccggcatttaatattttttacagagcatttacccctatattatttatcgttattttttcttgggttgttactagtcttgaaattcccatttctcttgaaaagataaactatgtagtaatttattattttataattagattgttatctgtatttgtttttgagaaaacacacatagttaactggtttaatcaactaacaatacccatactatccataacattatcatttatagtatataacaaaatgattttgcccaaaagttttctacttccatcctcacaagaagtagctactactttttgaatagcgcttggtggttacatatataatatattaaataatgaatcagggcatttaaaatcttataaagaaagaagagtaaattatgtaaaacacatgcacaaaaaatttgaaagttattttggtaaaattatagataaaataatcaaagaggatagttataataatgatgattttttaaccgataagaaaaaagcactaatatattcagttttaatttatgagaattttaataggggactagtttatagatattttgaaaaaaattattttgtactggtagaataaaaacatttggaataatgcaagtaacctcagcagagtacctttccaatgaggaaagtataaaaaaaggcggaaatattcttatggaaaaatacaatgaaaaatataatgaatctattgatggcaataaaactctctataaatcatattatgaatcaagaagagagagtattaaaaactacaacccagatgcaaaatacattaatgaaattgaatcaatttacatgatgcttggagaaatctatccaaatgcaccagacttcatgtcaccacattttgagggggactgctctgagggggaataaaatcattatttattctttattagttattagcaggatttgtcgggcataaatgcccgacctacaaattcaattttttcaaacctctgccaaatattttcatctttgcaaggctgtctgaaaacccaaaccccattttcagacggccttttttcgctaaaatccccataccgttcaatccgaaaacacaggagaatcatcatggaagttaccatctccgccatcatcaatggcgaatttgccgaccaatacggcaagcgcggtagtcagtttaatgaaaacgggatgctgatttaattctatttcctttgaaactaccaataacctgcctccatcataaaactaaaagcaagccgtagcctgcattcccacaaaccgcgtgcgttgccatgtcacacaccctacctgcgggcgacgcaaaccttaagagacctttgcaaaattccccaaaatcccctaaattcccaccaagacatttaggggatttctcatgagcaccttctttcaacaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttgtcgaagacccgttatgtggtcgaacaaagcttcggtacgctgcaccgtaaattccgctatgcccgggcagcctatttcggactgattaaagtgagtgcgcaaagccatctgaaggcgatgtgtttgaacctgttgaaagccgccaacaggctaagtgcgcccgctgccgcctaaaaggcagcccggatgcctgattatcgggtgtccggggaggattaagggggtgtttgggtaaaattaggcggtatttggggcgaaaacagccgaaaacctgtgttgggatttcggttgtcgtgagggaaaggaattttgcaaaggtctccagcagtttgcgcatacatgccgtaacggcaaccttatacggcttaccctcggacagcgggcgttggtggaaatcccgaataagcggttcaaaacgtgtcgctgccacggtagccatatacagtgccttaagcaccgcagaccttccgccaaagcagcggcttttgaatttggcttccccgctcttcctcgggtgcggggcaatgccgaccaaactcgctatccgtttgtgcgacagccgccccaattcaggtagcatcgccatcagcgtagccgtcgttatcgaaccgatgcctttgatttgctccgccacttgggctttgccgtcaaaatgcgtgtgggtgtggtcgtcgatttgtttgtccgattcgtcaatcagccggtcaaaatgggcaatcagttgtttgacgcttccgacttgcgtttcgtgaacctgatgcagacggtttttctcggcagtccgcatatccgccgattggttgcggcggttaaccaaggcttccaacacttcttccgcttctgtgggcgggtggtagggcatggtttgccaatcttctttctgtgccttcatctgtgcgaagaaggcaggcattttggcatctttggcgtcggttttggtcagcgactgcgattgggcaaactgatgcgtctgacgcgggttggcgataatcacggctatgcctgctcggtggatggctttggcggcggggatttcgagacctccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgattcacttggtgcttcagcaccttagagaatcgttctcttcgagctaaggcgaggcaacgtcgtactggtttttgttaattcactatatctgtgcgttacgacggcatgccgtctgaagggtgtttatgtctgcatctaagaaatttccgattcctttgagctatttcagcatcgcgctgggcttgtttgccttggggctgtcgtggcgttacggcgcgtctgtcgggctgctgcccgccttggccgccgaatcgctgcttgcggcggcttcggtcgtctggctcttgctggtggcggcatacctgatcaaaatgtttgcgtaccgaaacgattttttgtctgatttacgcgacttggtgcaatgctgcttcatcagcgcgattccgattaccgctatgctggagggactcgcgctgaagccctatcaggcaggcgcggcggcagtcctgatttatgtcggcgttgccggacagttggctttttcgatgtatcgggcggccggtctgtggcgcggcctgcattccttggaggcgacgacgccgattatttatctgcctacggttgcgacaaactttgtcagcgcgtcatctctggcggcgttggggcatcatgattatgcagctttgtttttcggcgcgggtatgttttcctggctgagcttggaagcctccatcttgggcaggctgcgcacggcggcaccggtcggcacggcggcgcgcggcgtggtcggcatccagcttgcgcccgcctttgtcggctgcggcgcgtattttgccgtcggcggtaaagtcgacggttttgcgttggcattaatcggctacggctgcctgcagcttttgttcttgctgcgcctgacccgctggttttgggaaggtggttttacgatgagcttttggggattttcattcggtttcgcggcaatggcaggatgcggtctgcatctggcggcttccggcgtattgtcgggcttggggctgacgcttgccaccgccggatcggcaggcgtggcgctgctgcttgtcggtacgctgcaccggatagcgacggggcgtttcttggtacgcagctgatgcgttttgccgccttgtcaaaaatgccgtctgaaacgctgggattcagacggcattttttatttcacacccttacaggtagaatttttcgatgactttcaaattgtcgtccaatttgtacaccaacggctgaccggtcgggatttccaagcccataatgtcttcgtcggaaatgccctcgatgtgttttgccagcgcgcgcagggagttgccgtgcgccgccaccaagacgcgtttgccgctcaaaatcgcgggggcgatttggtcttcccaaaacggcaatacgcgctccagcgttactttcaggttttcgccgtcgggtacgacatcggcaggcagatgggcatagcggcggtctttgtgtgcggaaaactcatcgtctttgtccaaaagcggcggcagggtgtcgtagctgcgccgccagatgcggacttgctcgtcgccgtattgttcggcggtttgttttttgtccaggccttgcagttggccgtagtggcgttcgttcagccgccacgttttgatttgcggtacgaacagttggtcggattcttccaaaacgatgttgcaggtcttaatcgcgcgggtcaggacggatgtgaaggcgatgtcgaactcatagccgttttctttcagtttcttgccggcggcggcagcctcggcaagcccctgctcgctcagcttcacgtcgcgccagcctgtaaacaggtttttcgcgttccattcgctttgtccgtggcggataaataccagttccatatcgtctccaatgtgtgaaagtgggaaagccttatttataacatattttcacatttcccgtatttgattcagattcagacacgcgcccactatggtttgccgttttgatttacaataatgtcctttgctttacattccgcatacacaatgaatacgcaagcgcacgccccacataccgattccaatacgctgatgctcggccgatacgccgaacgcgcctatctcgaatacgccatgagcgtggtcaaaggccgcgcgctgcctgaagtttcagacggccagaagcccgtgcagcggcgcattttgtttgccatgcgcgatatgggtttgacggcgggggcgaagccggtgaaatcggcgcgcgtggtcggcgagattttgggtaaataccacccgcacggcgacagttccgcctatgaggcgatggtgcggatggcgcaggattttaccttgcgctatcccttaatcgacggcatcggcaacttcggctcgcgcgacggcgacggggcggcggcgatgcgttacaccgaagcgcggctgacgccgattgcggaattgctgttgtccgaaatcaatcaggggacggtggattttgtgccgaactacgacggcgcgtttgacgaaccgctgcacctgcccgcccgcctgcctatggtgttgctcaacggcgcgtcaggcattgcggtgggcatggcgaccgagattccgccgcacaatttgaacgaagtgacgcaggcggcgattgcgttgttgaaaaagccgacgctggaaaccgccgacctgatgcaatatattcctgcccccgattttgccggcggcggtcaaatcatcacgccggcggacgaattgcgccggatttatgaaaccggcaagggcagcgtgcgcgtgcgtgcgcgttatgaaatcgaaaaattggcgcgcggacagtggcgcgtcatcgtaaccgagctgccgccgaacgccaattccgccaaaatccttgccgaaatcgaagagcaaaccaacccgaaaccgaaagcgggtaagaaacagctcaaccaagaccagctcaataccaaaaagctgatgctggatttaatcgaccgcgtgcgcgacgagtccgacggcgaacatcccgtgcgactggtattcgagccgaaatccagccgcatcgataccgataccttcatcaacacgctgatggcgcaaacttcgctggaaggcaatgtgtcgatgaacttggtgatgatgggtttggacaaccgccccgcgcagaaaaacctgaaaacgattttgcaggaatggctggatttccgcaccgtaaccgtaacacgccgtctgaaattccgtttgaaccaagtggaaaaacggctgcacatcctcgaaggccgtctgaaagtctttctgcacatcgacgaagtgattaaagtcatccgcgaatcagacgacccgaaagccgatttgatggcggcgttcgggctgaccgaaatccaagccgaagacattttggaaatccgcctgcgccagttggcgcgtttggagggtttcaaactcgaaaaagaattgaacgagttgcgcgaggaacaaggccgtctgaacatccttttgagcgacgaaaacgaaaaacgcaagctgattgtcaaagagatgcaggcggatatgaaacaatacggcgacgcgcgacgcacgctggtggaagaggccggacgcgccgtgctgacgcagaccaccgccgacgaacccatcacgctgatcctgtcggaaaaaggctggatacgcagccgcgccggacacaatctcgatttgagccaaaccgcgttcaaagaaggcgactgcctcaaacaaaccctcgaaggcagaacggttttacccgtcgtcatcctcgattcatcgggcagaacctacacgctcgatgccgccgaaatccccggagggcgcggcgacggcgtaccggtttcctccttaatcgagctgcaaaacggcgcgaaacccgttgcgatgttgacaggattgccggaacaacattatttattatcaagcagcagcggctatggcttcatcaccaagctgggcgatatggtcgggcgcgtgaaagcgggcaaagtggtgatgaccgcagacagcggcgaaaccgttttgccgccggttgccgtctatgcctcctcgttcatcaaccccgactgcaaaatcattgccgccaccagtcaaaaccgcgccctcgccttccccatcggcgaattgaaaattatggcgaaaggcaaagggctgcaaatcatcggattaaacgccggcgaatcgatgacgcataccgccgtttcttccgagctggaaatcctgattgaaagcgaaggcaggcgcggcgcggcgcacaaagaccgcatccccatctccctgcttgaggcaaaacgcggcaaaaaaggcagactattgcccatatcgggcagcctgaaacagctttcttcccctaaataaacccggttccgcacatattatggtgatttccaacccccgcgaacttgaaaaactcaaagaccggattcccaatctgatcaacatcatccgcgtcgccatcgtttttccgctgatgattatgcacatcctcgggctggaaaccggcagccgtgcgaacctgcacgcttcgtggacggcgtgggcgttttatgtttggctcgccattgcctgctggctgattttcttttccattatccatccgcattggcaatggcagtcgctgaaaatgccgcgtttcagcgcggtagcggacatcacgatgatcggcgtgctgacctacctgttcggcggcatcgattccggcttcggcatcctgatcctgcccttcgtcgtctgctcctgcctgctcagctacgggcgctaccccctgctctattccagctacgccgccatcctgctgatattcaacgccattgccgacggcgatatcggcaaatacccgctcatatcggatgcccgaaccgcctcggcaaccttcatccttgtcgccgcctcctatctttccgccatcttcacctcactgtcggtcaaatacatcgaccgtgccggaaaactcgcctacgacagccatatcgcctaccaccgcatcaaaggcttgagccaaaccgtactcgaacgcgttcaggaagctgtcgtcgtcatcaatgccgaagggctggcggtgctgttcaaccggaaggcgaaagaccttttccccgcgctcgaaatcggacggcgcgccggtctgtccgattctgccgccgaactgtgggatcaagcctctccgcacactttcgaatacgtcctcggcacacccggcctgaacgccggcatccgcgccgttccggtcaacaaagggtcggacaagctgctcatcctctacatccgcccgcaaagcgaaattcaggcagaagccctgtccgtcaaacttgccgcgctcggacaactgaccgccaacctcgcccacgaaatccgcaacccgatgtccgccatccgccacgccaacgacctgctgcgcgaaaatatggaagcgggggcggcagatccgttcaacgccaaattgtgcaaaatcatcgacggcaacatctgccgcatcgacaaaatgctcgaagacatttcctcgctcaacaagcgcaacaaaaccgaacgcgaaaccatcggcctgataccgttttgggaagaattcaaacaagagttcctgctcggccatcccgatgccgccgactgcatccgtccggacattcaaggcggcagcccgaccgcctatttcgatcccgcccacctgcggcaaattatgtggaacctcgccaacaacgcgtggcggcacagccgcaaacagcccggctcgatttccgtcaccatccgccccgcgcaaaaaaacaccgtctgtatcctctttgccgaccgcccgaagtgcaggaacacctgttcgaacccttttacaccacggcggaaaacggcaccggcctcgggctgtatgtcgcccgcgaactggcgcacgccaatttcggcgatttgacctacctaccggaagccaaatgtttcgaactcacattaccggaaaaaaccaatgactgaactgcaacaccccgtcctcgtcgtcgatgacgaaaccgacattctcgacctgatggaaatgaccctgatgaaaatgggcttgcgcgtccataccgcgtcaggcgttgccgaagccaaaaacaagctcgacagccaacgctattcgctcgtcctgaccgatatgcgtatgccggacggctcggggctggaagtcgtccaacacatcaacagccgcctgctcgatacgccggttgccgtcatcaccgccttcggcaacgccgatcaggcacaggaagcgttgcgttgcggcgcgttcgaccccgataccatgcagatacaggactatctcgaccaaatcgaacgcgacatcatcgaacaaaccctcaaacaaaccgaaggcaaccgcacgcaggccgccaaacgcttgggcatcagcttccgttccatgcgctaccgtatggaacgcctcaacatcggctgacgacaaaacggcatccgcaccatctccgcccacccgaaaaaatgccgtctgaaacggcacgggaaagcgggttcgccccacgcccgaacggacacaaaacaccatgaccgacatccttattgacaacaccgccaccgaaaccgtccgcaccctgatacgggcattcccccttgtgcccgtttcccaaccgcccgaacaaggcagttacctccttgccgaacacgataccgtcagcctcaggcttgtcggggaaaaaagcagcgtcatcgtcgattttgcctccggcgcggcacaataccggcgcacaaaaggcgggggcgaactcatcgccaaagccgtcaaccacaccgcgcaccccaccgtttgggacgcaaccgcaggattggggcgcgacagcttcgtcctcgcctcgctcgggctggccgttaccgccttcgagcaacatcccgccgtcgcctgcctgctttcagacggcatccgccgcgccctcctcaatcccgaaacgcaaaacaccgccgcgcacatcaacctccatttcggcaacgccgccgaacaaatgcccgcacttgtccaaacacaaggcaaacccgacatcgtctatctcgaccccatgtatcccgaacgccgcaaaagtgccgccgttaaaaaagaaatgacctacttccaccggctcgtcggcgaagcgcaagatgaagcggcactcctgcataccgcacgccaaacagcaaaaaaacgcgtcgtcgtcaaacgcccccgcctcggcgaacaccttgccggacaagaccctgcctaccaatacacaggcaaaagcacccgcttcgacgtttacctgccctacgggacggacaagggataacgcccataaaacaagacaccgaaaaatttgccgttcttatgcaaacgagaaaccggtttttgcgtttcgactgttttggataagtcatcacaccttaaagtttgtcattcccacagaagtgggaatccgattcattcagttttatagtggtttaaatttaaaccactatagttgttttcgagtttcaggcaacttccaaaccgtcattcccacggaagtgggaatctagaaatgaaaggcaacaggaatttatcgtaaatgactgaaaccgaacggactagattcccgcctacgcgggaatgacggggcgggcagatgccgtctgaaattccgtcattcccgtgaaaacgggaatctagaacttctgatttttcagacgacttttgaacattgccgccacccaatgatctggattcccacctgcgcgggaatgacgaggtttcaggttgctgtttttaagttgctgtttcgggttgctgttttttatggaaatgacaaggttttagattgcgagaatttatccgctcctccgtcattcccacggaagtgggaatccagaaatgaaaagcaacaggaatttatcataaatgaccgaaaccgaacggactagatttccgactgcgcgggaatgacggggcgggaggatgccgtctgaaattccgtcattcccgtgaaaacgggaatctagaacttctgatttttcagacgacttttgaacattgccgctacccaatgatttggattcccgcctgcgcgggaatgacgatgtaaaattatccgggattcaaaaagacaggctttcacatccgtgggaatgactgcggaaagatgatttttatagtggattaacaaaaatcaggacaaggcgacgaagccgcagacagtacaaatagtacggcaaggcgaggcaacgccgtactggtttttgttaatccactatattttgtcataaaaatccgcaccttaatcagttggcggttaaatcaaacttttagggtgcagattactttttatgatttcagacagcattttgacaggcggcagcctatttcggcaataccaaaaacttaatcagcagttctttgaatacaaaaccgaacacgcccaagcccaaaaccaaaaacaaaatggcgatgccgaatttgcctgctttggactccttgcccaaattccaaacgataaaacccaaaaaaataatcaagccggtcaggcagattttcaacgcccaatcggcaaaaaccgcttcatccatatttttttcctattgttgatgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtagtacacggcttgaacctgcggctgcgcttgcagccattgtgcgattttcagggcgttgtcgaactgtttttccatacgcagcgacagggtttccacgccgctcaacaactgccacgcattaaacggcgacatcgccagcccgcaagagttgcaatacatggcgacctgcgccaacaactcttccgaacccgccaacacgccgcccatcacacgcccgtgtccgtctatggctttggtcgcggaggaaacggaaatatccgcaccgtgtttcaaaggctgcgagccgacgggcgacagcaggctgttgtccaccaccaagagcgcgccgatgccgtgcgccaattccgccaaggcttccaagtcggccacttcgcctaaggggttggacggcgtttccaaaaacagcagtttggtattggctttgacggcggctttccattcgtttatatcagtcggcgacacgtggctcacttcgatgccgaatttggcaacgatgttattgataaagccgacggtcgtgccgaacaggctgcggctggaaatcacatggtcgcccgcctgcaaaaaggtgaaaaacgccgcctgaatcgcagacatacccgccgaagtggcgaccgcgcgttccgcaccttccaaagcggcgatgcgtttttcaaaggcggctgtggtcgggttggcggtacgggtataagtgaaccctttgattttttttgaaaacaaatcggcagcgtgttgggcgttgtcccacatgaagctgctggtcagaaacaatgcctgattgtgttcgcggtattcggtttgttctttgccgccgcgtatggcgagcgtttgcggatggagttttttgctcatcggtgattcctcggttttgtccgttcggcaacggagcgtgcgcccgttgtttaatttgttaatattttgcgcctgttctatgatgctttcaagtcggatgagaatgcaaatgccgtctgaaacggctttcagacggcatggcaatcagcgtttgtattttaactcgtacttgatgtcgttgaggattttgcggacatcgtgttccaacacgtcttcgactaccgcccccgcctgctcgtgcagcatctgctggagctgataggtgaaaaccgccatctgcttttgcaccgccgttcggatgatgccgttgacggtatcggtcagatgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgccttcaacacacgggctcggctctcatcgtccagtttcggcacaggcgcgtccgttccggtttcagaggggcgggacagcggcgcgtaagtcggcactgccttcatacggcgcgtctgacgcaggttttccaaacgtttttcccaattcggctctttattcgcatccattttcggcttccggttcttaatctttgcaagcagacaaacccgcgcccaaagcgcggtttgatataatggcgcattttaacagattcgcgaggatacatcatgggcagcatcgaacagcgtttggaatatctggaagaggcgaacgacgtgctgcgtatgcagaaccacgtcctgtccaccgcattcaaagccttaatccgcgcccttcccgccgaaaccgccgaaatcgcggtcgagtcgattcagcttgcttttgaggacgccttggcagaattgagctatgaggacagcccgcatacggatttgttccacgacgttacttatgcgtttttccgtgaaaaagaacgttaattttatgttaaactgattttttaggctttttgattaccgaaaggaattttgatgaatatgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataagcccgcccgtccgaacacaatgccgtctgaagccctttcagacggcattgttcatcaatcggcctacaatgaactgcctgctgatttctccctaccgcaaagcaacaggcaaagattacaaatatcaaaatccgagtaaaacagtattttattaaaacaaattgataatcaagagattagaattatgtattgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttgaggcgccatgccgtctgaacacaaaatctgccttcagacggcatttccgcccccggttgcggtacaatccaccatttcatcactcggcgacccacaccgtgaaaatcctcattttaggcaacggacaggtaggttctaccgtcgcacaaaaccttgccgccatacccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataaaccgccccattccggacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgacgaagtttcagacggcatcgcccgcctgttttgatatagcggcacccccccgacaaaaaaacaatccggaacgcatctgaccgttccggcttgttttcaggcgaatccgccgcatcagaacatactgcgcacgcccatattgacctgccaagtctagcgcatcgtgtgcatcgaagacctttgcgcctcaaaataaagctgccttccgttgtcggcattaccacgcaaaaaaatgaattgcttgatattccaatgttttttatatgtttttatattgtgatgcgatcagacaaacgcccccctgacatttgtttagacggcatcgtattgctaaatttctataagtatgtataatgtccgtttccacgcgcccatcgtctagaggcctaggacactgccctttcacggcggcaaccggggttcgaatccccgtgggcgtgccaattcaaaaacctgcttgtttcaagcaggttttttattatgagtcgtcattcccgcaatttttcgtcattcccgcaaaagcgggaatctagagcgtagggttgaagaaaccgttttatccgataagtttccgtgccgacaggtctggattmccgcctgcgcgggaaggacggcagagggtggacgatgccgtctgaagcctgacaaagcatttgatgccgtctgaaacttcgtcattcccgcaaaagcgggaatctagagcgtagggttgaagaaaccgttttatccgataagtttccgtgccgacaggtctggattcccgctttcgtaggaatgacggaattttaggtttctgtttttgtggaaatgacgaataaagcgtgccggtttatgctcgccgcaacacgcggttcagacggcattgctctcttttttcattatcagtgggtgtagcaactgtatttttcaccccgtcgggcaaaaatacagttgctacgatgcaccccgccgccctgccctgtgccttgtcctgcaatacggcatataatgcaccacaaacccccgcgctgcggttttcagacggcatcgccgtgcttttttacaggcattagccctttttatcggacgcaatattaaggaggaacaaatgaaaagctcttttgtgcaaacgcttaccatcgccggttcggattcgggcggcggtgcgggcattcaggcggatttgaaaacatttcagatgcgcggcgtgttcggaacgtgcgtcatcaccgccgttaccgcgcaaaataccttgggcgtgtcggcggttcatctcgtcccgaccgaaaccatcaccgcacaaatccaagcaatcagggaagacttcgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgcttcccgatacggatgtattgacccccaacctgcccgaagcggaagctctgaccggcgtgcatattgaaaaccgtaaagatgcggaacgtgcggcaaaaatcctgcttgattacggtgtcaaaaatgtcgttatcaaaggcggacatttgaacggcagcacaagcggacgctgcacggattggctgtttacacaaaatgaaacgctggaattcgacagcccgcgctttccgaccgcccacacgcacggcacgggctgcacgttttccgcctgcatcaccgccgagttggcaaaaggctcggacgtttgcgaagccgtacagactgccaaggcctacatcacggcggcaatctcaaaccctttggaaatcggcgcaggacacggcccggtcaatcattgggcgtatcgggactaaccgtaaaaatgccgtctgaaacaaaatgttcagacggcatttttgaggattattcaggctttttcgccagcatcgttacaaatttaaaccgtatcggattgccgttttcgtctttggcatgcatagaacccaattcttctttatattcgaccagttcccaatcccgataataatccttcagctcgccctctttaaatttaaaagggaacggcatcggacaggggaaatccgccgtatccattgccgatacaatcaagttgtacccgcccgccgccgtatgcgcctgcatatcggcaatcacgtcgggtacgcgctgcggcatcaggaacatcagcaccactgttgccacaatataatcaaactcgccctgcaaggcggcggcgttcaaatcatattccagcgtgcggacgttcaaaccctccgcctctgccagctccgccacgtttgccaaggcggcgggattgtgatcgactgcagtaacttcaaaccccttcaaaccgagaaacagcgcgttgcgcccctgtccgcagcccatatccaacgccctgcccgccggtacggtatcccgtgccgccgcgaccgcagaatgcgtggcactcatcccgtattttttgtgaaaatagtctgccgccgcgcaatacagcgacaaacggatttcggcatcgtccgttttcggtttgacagaaaacacctgctgcggcgcaaacacacaatcgccgccgtctgccgaccaaacttctgccgacccgtccggtgcacgaacttcgacatcgccctgcaacacattcaggcagacccactccccttcctcagacgaatagcccgacaacaaaacttccggcaggttttccactttccatacaggcatctgtccgaaacaaaacaactcgccactttgacccactatccgctccttcawattcaaaaataaagttgcacattatatgcctattttaatccgccgcaatctttcagacggcacggcgcgcaaaccgcttataatcacgccggacaccacacaaaggcacaataatgaaccaaaccgtttacctttacaccgacggcgcgtgcaaaggcaatcccggcgcgggcggctggggcgtgttaatgcgctacggtagccacgaaaaagaacttttcggcggcgaagcgcaaaccaccaacaaccgcatggaactgactgccgtcatcgaaggactgaaatcgctcaaacgccgctgcaccgtcatcatctgcaccgactcgcaatacgtcaaaaatggcatggaaaactggatacacggttggaagcgcaacggctggaaaaccgcctccaaacagcccgtcaaaaacgacgacttgtggaaagaactcgacgctctagtcggacggcatcaagtcagttggacttgggtgaaaggacacgcgggacacgccgaaaacgaacgcgccgacgatttggcaaaccgtggcgcagcgcagttttcctgactgccgctccggcaaaaatgccgtctgaaaccgctaatgggcttcagacggcatcgtcctccaccgtcattcccgcgcaagcgggaatccaaaccgtcgggcaacggcaatattcaaagattatctgaaagtttgaagttctagattcccgttttcacgggaatgacgaaaagttgcaagaatgacggagtttcaggcggcatccgaccgccccgtcattcccgcgaaagcgggaatctaaaaacccaacgctgcaagatttatcagaaacaactgaaaccgaacggactggattcccgcctgcgcgggaatgacgggattttagtaaccgtagcaaccgcctgcgcgacggctaaggggcttcagcaaccgtagcaactgcctgtgtgggaatgacggacaatgggcttcagacggcatctcttgcctgccgctaaaacagtttgccgcacaactgttcaaacgcgtccgatatgtttcaacacacaggacgacacataaagcacctccctatgtgtcgtcctgatttggaaggggttacaccccctcccaaataaagtctgatcctgccgccctaaagggcggggtttcaaccgaaaaggaaatacgatgaagtggtacaattagcggcaatgcggacagacaaattaaactatagtggattaaatttaaaccagtacggcgttgcctcgccttagctcaaagagaacgattctctaaggtgctgaagcaccaagtgaatcggttctgtactatttgtactgtctgcggcttcgttgccttgtcctgatttttgttaatccgctatatcagaaattaccctaccgttttttaaacactttcaggaataaggaaaaatgaccgcccaaccctgccccatctgcacggcgcaaaatgaagacgttttgctgcaaacccccaacctccgcgtcatcgccgtccataacgacagcggttcgcctgcattctgccgcgtcatttggcgtaagcatattgccgaaatgaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgtctttccccgcgccgatttgggcaaaccccgtccggaaacacggtatgaccctgccgcaagattggacggaacagcttaaaaagctgctttaagcccgccgatgccgtctgaaaccgtatgaaagggaaattatgaccgaaccgacctcccgccgccgttttctgaaaacctgcaccgccgctgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgtcggttttaccgtaaccaaccaacaggcgggcagccgccgtttccaacggtttgccggcacggacacgcaacgtgccgccgatttccaagaggtcgcttccggccgcgtcgccacgcctaaagtgctgatgggtttgcgcggcggttacggtgcggcgcggattctgccgcatatcgattttgcttcgctcggcgcaaggatgcgcgaacacggcacgctctttttcggattcagcgacgtatgcgccgtccagctggcattgttggcaaaaggcaatatgatgagttttgccggcccgatggcttatagcgattttggcaaacccgcccccggtgcgtttacgatggatgcctttatcaagggtgcaacccaaaaccgcctgaccgttgatgttccttatatccaacgcgccgatgtcgaaaccgaaggcatattgtggggcggcaacttaagcgtcctcgcctcgctcgccggcacgccttatatgcccgacatcgacggcggcattttgttcctcgaagatgtcggcgaacagccctaccgcatcgaacgtatgctcaatacgctgtatctttcgggtattttgaagaaacagcgcgccatcgtgttcggcaatttccgtatggaaaaaattcgagatgtctatgatccgtcttatgatttttctgccgttgccaaccatgtttcgcgcacggcgaaaatccccgtgctgacgggcttcccgttcggacacattgccgacaaaatcactttccctctaggcgcgcacgcccgaatccgtatgaacggaaacagcggttattcggtcgcgtttgaaggctaccccacactcgatgcgtccgccctgactttggataccctgctcccaccgccggatttgcccatcttccccgaaagcggtgttgccgatatttcggaataaacccgcaaacggacaaatgccgtctgaagccttcagacggcatttcccaagacggcggcagattacagcaatgcccgaatatcggcttcgatttcttcgggcgtaacactaggcgcaaaacgctcgaccacttcgccgtcgcggttgacgaggaatttggtaaagttccatttgatgtcgccttcgtcgcgcttctctcccaaagctgcgagcttcaacacgaaatctttaaacagatgattgcctttatcttgcggtttgacggatttcaggtaggcatacaagggcgcggtatttgctccattgacttcgattttgtcgaaaatcttaaacttcgtgccaaacttcatcatacacacttgggcaatttctccgctgctttcgggagcctgttcgcggaactggttgcacggaaaatccaaaatctccaagccttctgcggtatattgtgcatacagcttctgcaaagcctcgtattgcggggtcagaccgcaacgcgttgccgtgttgacaatcagcagaaccttgccgcgatagcctgacaaatcaaccgcattgccttctgcatctttcatttgaaaatcgtaaatacccatttttatccttatctgatgtaaaccgatgccatctgaaacgtgcttcagacggcatgaaagcagcaattgtatagccgattaaaataaaaaatccacatccttttccattcccgtcccaatccgcaataaaaaactgcacccgaaaacgggtgcagttgctcatttcataccgcaaaacttatttgtcgcggccgaatacgattttagtggcttggatggcgacacagattgcaccgccgataaagaccaagtcagctgccgtacgtacccaacgcaaggtatcgaggatttccatttgcaggaactcttcgctgcgggcataccacagaccgtgcgtgatggaggcgtatgcctgaatcgcgccgacaggcagcaggctgatggcaatcataccggccaagccgccgttgagcagccagaagccccaagtcatcagtttgtcgtcaaactgcgcgttcggtttcaaataacgggcaaccagcaatacgaagcccaatgccaagaaaccgtacacaccaaacaaggcggcgtgcgcgtgaacggcagaagtgttcaaaccttggatatagaacagggaaatcggcggattgatcaggaagccgaatacgccggcaccgatcatattccaaaaggcgactgccacgaagcacatcagcggccaacgcaggcgtttcgcccagtcggacaggtgttggtaagaccagtgttcgtatgcttcacggcccagcaacaccagcggcacgacttccaaagcggagaagcaggcaccgattgccatagaggcggaggtagagccggagaagtacaggtggtgcagcgtgcccggaacgccgcccaacataaagatggcggcagcggccaaagtggaggcagtggcggtactgcggcggacaaagcccatattgtagaagacaaaggcaaaggcggcagtggcaaatacttcgaagaagccttctacccacaggtgaaccacccaccaacgccagtattccataacggcaatcggggatttttcgccatagaacaggcctggtgcgtagaatacgcccacaccgaccatagaagctacgaagatagccaacaggtttttgtccacgcctttttctttaaaggcggaaaccgtgcaacgcaacatcaggaacagccataacagcagaccgaccatcaaaaggagttgccagaaacgtcccaaatcgaggtattcgtaaccttggtgtccgaaccagaagttaaattccgggggaaggatgtgcgtcaacgcgaagaagttgcccgcgtaagaaccgccgaccacgatgaagagggcgatatagaggaagtttacgccggcacgttggaacttgggatctttaccgccgttgacaatcggcgcgaggaacaaacctgccgtcaaaaagccggttgcaatccagaagatggcggattggatgtgccaagtacgggtcagggcgtaggggaaccagtcggacatttcaaagcccaacgcctcgtcaatgccgtagaaaccctggccttcgacggtgtagtgcgcggtcagtccgcccagcaatacttgtaccacaaacagggcgaccgtcaggaagacgtatttgcccaatgctttttgcgaaggggtcagttggattttggaaatcgggtcttcagacggcacttccacttcctcgtgtttggtcaggaaggaataaccccacatcagcaaaccgatgcccatcagcagaagaacaacgctggtgaatgaccacatatagttttcagtggtcggtacgttgttgatcaaaggttcgtgcggccagttgttggtgtaagtaaaattctcgtcaggacggttggtcgaagcagaccaagaagtccagaagaagaagttgaacagtttttcacgcgcttcttggcttggcaatgtattgtttttcattgcaaagtgttcgcgagtggtttggaacttaggatcgtcgctgtacacaccgtggtagtaaggcaggatgctttcgatggctttcacgcgcgtatcgctgatgacgacgctgccgtcttccttcacgcggctttgattgcggtattcgtcggccaggcgtgttttcaagacggcttgttcctcgggggaaacctcgtcgaattttttgccgtaagtctgttgcgcggtcaaatccaaccaggcaaccaactcacgatgcagccagtccgccgtccagtccggagcctgatatgcaccgtgacccaaaatcgaaccgacttccataccgccggtagtctgccatgcagactgacctgccaaaatatcgtctttcgtcatcaagaccttgccggatgcggaaacgacctgttcggggtaaggcggggcttttttgtaaacctcgctgcccatatagccaagaatggtaaagcataccgggtac

SEQ ID NO: 37767 - DNA, 35042 bp, Neisseria meningitidis
cgaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctggcaaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaaaggcagcccgcattttgtagaaaaccgcaatgccgtctgaaagcccttcagacggcatttgtttccccaaacgcatcatcctgccgcaagcctatgccaatccgttttatcgcatcggcaactcaaagaaaaatccatttcattcccacgcagggaagccggtttttgatttcggttatttttggttgtttcgggtaatttatgagtcgtcattcccgcaaaagcgggaatcagtttttttaagtttcagccatttccgataaattcctgtggctttagctttccggattcccactttcgtgagaatgacgtggtgcaggtttccgtacggatggattcgtcattcccgcgcaggcgggaatctagaccgttcggtttcggtttttttggttagtgccgcaacattaaatttctagattcccactttcgtgggaatgacggcggagcggtttctgctttttccaataaatgcccccaacctaaaatccgtcattcccgcgcaggcgggaatctagacattcaatgctaaggcaatttatcggaaatgactgaaactcaaaaaactagattcccactttcgtgggaatgacgtggtgcaggtttccgtatggatggattcgtcattcccgcgcaggcgggaatctagtccgttcggtttcggtttttttggctaatgccgcaacattaaatttctagattcccactttcgtgggaatgacggcggagcggttgctgtttttcccaataaatgccccccaacctaaaatccgtcattcccgcgcaggcgggaatctagtccgttcggtttcggtttttttggctagtgccgcaacattaaatttctagattcccactttcgtgggaatgacggcggagcggtttctgcttttcccaataaatgcccccaacctaaaatccgtcattcccgcgcaggcgggaatttagacattcaacgctaaggcaatttatcggaaatgactgaaactcaaaaaactggattccctctttcgtgggaatgacgtagtgcaggtttccgtacggatggattcgtcattcccgcgcaggcgggaatctagacattcaatgctaaggcaatttatcggaaatgactgaaactcaaaaaactggattcccgctttcgtgggaatgacgcgattagagtttcaaaatttattctaaatagctgaaactcaacgcactggattcccgcctgagcgggaatgacgaagtggaagttacccgaaacttaaaacaagcgaaaccgaacgaactggattcccactttcgtgggaatgacggaatgtaggttcgtgggaatgacgggatgcaggtttccgatggatggattcgtcattcccgcgcaggcgggaatctagacattcaacgctaaggcaatttatcggaaatgactgaaactcaaaaaactggattcccacttttgtgggaatgacgcgattagagtttcaaaatttattctaaatagctgaaactcaacgcactggattcccgcctgagcgggaatgacgaatttcaggttgctgtttttggttttctgtttttgtgaaaataatgggattttagcttgtgggtatttaccggaaaaaacagaaaccgctccgccgtcattcccgcgcaggcgggaatctagtccgttcggtttcggtttttttggctagtgccgcaacattaaatttctagattcccactttcgtgggaatgacgggatgtatagtggattaacaaaaaccagtacggcgttgcctcgccttagctcaaagagaacgattgtctaaggtgctgaagcaccaagtgaatcggttccgtactatttgtactgtctgcggcttcgtcgccttgtcctgatttttgttaatccactataaatttaatccactatattttttgttccaaagtcaaaatatgccgtccgaacattcgggcggcagacaaaacggcactgcccgataaaggcagtgccgttgtccgtttcaaaccgtgaaacatcagcccaaattaaaggctttatgcaataccctggttgccagttccatgtatttttcatcaatcaatacggaaactttgatttcggaggtggaaatcatttggatgttgataccctcttcggcgagcgtgcggaagattttggcggctacaccgacgtgcgaacgcatacccaaaccgactgcggagactttgcatacggtgtcgtcgccatcaatagaagccgcgccgatactgtcttggcgttccgacaggatttccaaagtctgcttgtaatcgccgcgcggtacggtaaaggaaaaatcggttgtgccttcgctgccgacattttggataatcatatcgacttcgatgttggcatcggcaaccgcgcctaaaatctgataggcgacgccaggtttgtcgggtacgccgcgcacgttgatgcgggcttggtttttatcgaatgcgataccggttacggcagctctttccatgttgtcgtcctcttcaaaggtaattaaggtgccattgccgccgtcttgcaggctgctcagtacgcgcaggcgcactttgtattttccggcgaattctactgaacggatttgcaaaactttcgaaccgaggcttgccagttcgatcatttcttcaaatgtaaccgtatccatgcggcgcgcttcgggtacgacgcgggggtcggttgtgtaaacgccgtctacgtcggtatagatttggcactcgtcggctttgagcgcggcggcaagcgcgacggcggaagtgtcggaaccgccgcgtccgagcgtggaaatatcgccttcactgctgatgccttggaagccggcaacgatgacgactttgccggcggtaaggtcggcacgcattttttcgtcatcaatgctttcgatgcgggctttggtgtgggcggtatcggttttgagggcgacctgccagcctgtgtagcttttggcatccacgccgatgtctttcaatgccatcgccaaaaggccgatggttacttgttcgccggtagctaagacgacgtccagctcgcgcggatcgggatgctcttgcatttcgtgcgccagtgcgaccagtcggttggtttcgccgctcatggcggatacgacgactacgatgtcgtgtccttcggcgcgggctttggcgacacgtttggctacgtttttgatgcgttcgggcgagcctactgatgtgccgccgtatttatgtacgattaacgccatgtttcgtgctttcttgtgggggttgtcgggcagcttggtttgctggaaaaagggttattattactattttttacatggaattcaagaacggactgcgctttcccgcctgccgtttgacagcggtcagcgaaaaacctgttctttcagattgttgacaaaatgccgtctgaacggttttcagacggcatccggacgacaatcaggcggcggacaacgcattttgctggtgttgcagcagttcgcctatgcctttttgcgccagtgcaaccagtttgcccaattcgtccaaactgaacggcgcgtcttccgccgtcccctgtatttcgatgatttttcccgatgcggtcatgacgatattcacatcactgtcgcaaccggagtcttcgggataatccaaatccaaaagcggcacgccgttcactacgcctactgacacagcggcaacggcttcgcggatggggttttcactcaaaatgccgtctgaaaccagtttgccgacggcgatttgcagcgcgacaaacgcaccggtaatcgaagccgtgcgcgtaccgccgtctgcctgaatcacatcgcagtcaatcaagatttgtcgttcaccgagtttttccatatccacgaccgcgcgcagggaacgcccgatcaaacgttggatttcttgtgtgcgcccggactgtttgcccgccgaagcttcgcggagcatccgggaagcagttgaggcaggcagcatcccgtattccgccgttacccagccttggtttttaccgcgcagaaacggcgggacgttttcatctatggaagcggtacaaatcactttggtattgccgcattcaataaggcacgaaccgtccgtatgcggcaggaaatgaggggtgattttgatatcgcgcaggctgtcggcggcgcgcgagatgcggatgtaatcaggcatactgccctcccgttaaaaacagataaattaaaaagccttaaatatgaaaaatcacatttaaggccttcaaactgaaaatttctacgcctcttcggctttgctgcggataatcaaaagcggcaggtggctttggcgcattaccgtttcggcaaaactgcccattaaaaggtgcatcagcccggtacgtccgtgcgtacccaacaccagcaggtcggcaccgttttcatcggcataatcaaccaaatcctgcgccatttcacgcgcacccttattggcaaccagcaggtgtttgacggtattttccacacccagttcctgggcggtgcgctcggcggcatccaaaacttcgttgccttgcgcgacggcggcggcttcgtagctttcgtgttgcaaaaattcgggggcgagtgccatatattcggcaggattggcaacgtgcaccaaagtcaggcgcgcaccgttgaccccggcaagctcggcggcatgtttcagggcattgatggacgtttcactgccgtcaacggcaacaaccaaatgtttgtacatatcgtattctccttttgcaccgcctcgcggtgccctcttgtcggatgggcgcagggacagtttgcgctgtttcattatagacccgccgtcgggctttatacaacagccgaacagcccgaccgctttccagtataatatgccgcttccgtgcagtcaggcattttttgccggctttcgttcactttttgatttgacgcaatcttgcaggattcgaccatgtccgacaacgctttgacctcttcgcgacgcttcggcggcatcgccagactctacggagactctgccttggcgcacttttcacaggcacacgtctgcgtagtcggcgtgggcggtgtcggctcgtgggcggtcgaggctttggcgcggacgggcatcggacgtttgactttgattgatttggacaacgttgccgaatcgaatgtcaaccgccagctgcacgccctgaccggcgacttcggcaaagcaaaagttaccgccttgcgcgaacgcattacacaaattaatccgcaatgcgaagtgtttgaaattgaagatttcgttaccgaagacaatttgccggaatacttcggaaaaggttttgatttcgtcatcgacgcgatcgaccaagtgcgcgtcaaagcagcaatggcggcttattttgtggaacgcaaacaaccgtttgtcctcagcggcggcgcgggcggacaaaaaaatccggcgttaatccaaaccgccgatttgagccgcgtaacccacgacccgctgcttgccaacctgcgctacaccttgcggaaacgctacggattcagccgcgatacgaaagcaaatatgcgcgtgccttgcgtgtattcgaccgaaaatatcgtgccgccgcagtctagggaggcttgttcggcagatgccgctccgcaaggcttgtcgtgcgccggctacggtgcaagcatgctcgttaccgcttcgttcgggctatattgcgcacaggcggcggtggaacacatcgcagacaaaaaataagcaatgccgtctgaaacaggattcagacggcatttgaacaaactatggttatgatttaagacaacaaaggatacggataaaaaataacataaaatatatgattcctaataatataccaagtatcggagagctatttaatggaattcgttaataatttagttattttttcatttttattactaatgcttattccgatattttttgtagtatatggtatataccataagatacgttatcgcaaaatatgtatcctaagaacaagttttatattattagtggtaatactttgcagtatgtattacatatattgccgttatcttgaccaacaaaaagtagcttattattgcatagatgaacaatgtatttctattgttcatctatacaaagattatggtataaactctcccacatatgcgagaatttacgcaggaaaaatattgtttagatttcaagtaagagctaaaaattacgctgaattacttatggaagatgatatatcaattagtaaaaaaattttggggaataaatttatcatttatgggtcgctacctgtaatatacggtaatgtagataatattgaagtaaaagaagctactggttatatagatagatccagtactgattatattgtctcaagaaacttaaaattcagacatttatattaattaagaggttttagcaagagtgccgtcaaaatatagggcgcatcatcgaattcgcgaaagacaaacgctacgatgaacgtttcaaggatttgaaaaaagaatccataggctatctgaaccggcatcccggtttggtgtccgactacctgaaggcggcaatcaagctgtcggttcagaaaaaccaacatcagcacgcctaaaaccgtattcacaacctgctccttttcaaaacatttgcatttaaaagccgttataatgccgtctgaacatctgcccgaccacattatacgtgaatgtcggcagattgttttcttttgtaaacttatattaaaatccacttaccgattcacgccatgccgcccatccctgccccatctgcaccatccgagcacactgtcgcatgggtattcggccaacccgttaccgatttgccccaggatttgtttattccgcccgatgcattgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaatacgccccaagccgccaccaaaaatcgggagacacgccatatgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaaaccggcagaaaaagcgcacaattcctgtttctgccgcataaaatcttttaaaataccgcctgatttgaatttaaccgaaagaccgaacttcatgaacctacatcaaaccgtcgaacacgaagccgccgccgcctttgccgccgcaggcatcgccgacagccctattgttttgcagccgaccaaaaacgccgaacacggcgatttccaaatcaacggcgtgatgggtgcggcgaaaaaagccaaacaaaacccgcgcgagttggcgcaaaaggtcgccgaagcattggcggacaacgccgtgattgaaagcgcggaagtcgccggtccgggcttcatcaacctgcgcctgcgccccgaatttctcgcgcaaaacattcagacggccttgaacgacgctcgtttcggcgtggcaaaaaccgacaaaccgcaaaccgtcgttatcgactattcttcgcccaatctggcgaaggaaatgcacgtcggccacctgcgttccagcatcatcggcgacagcatttcgcgcgtgttggcatttatgggcaataccgttatccgtcaaaaccacgtcggcgactggggtacgcagttcggtatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgttttggcattgtggaaacagtttgtcgatatttcgctctcgcacgcccaagccgtttacgacacgctgggcttgaagctgcgtcctgaagacgtggcaggcgaatcgaaatacaacgacgatttgcagcccgtggtcgatgatttggttcaaaaaggtctggcggttgaggacgacggcgcgaaagtcgtgttcttggacgaatttaaaaacaaagaaggcgaacccgccgcatttatcgtgcaaaaacaaggcggcggcttcctctacgcctccaccgatttggcgtgcctgcgctaccgcataggccgtctgaaagccgaccgcctgctgtacgtcgtcgaccaccgccaagccctgcacttcgaacaacttttcaccacttcccgcaaagcaggctatctgccggaaaacgtcggcgcggcatttatcggcttcggcaccatgatgggcaaagacggcaagccgttcaaaacgcgcagcggcgacaccgtgaaactggtcgatctgctgaccgaagccgtcgagcgcgccaccgctttggtgaaagaaaaaaatcccgaattgggtgcggacgaagccgctaaaatcggtaaaaccgtcggcatcggcgcagtcaaatacgccgacttgagcaaaaaccgcaccagcgactatgtgttcgactgggatgccatgctctcgtttgaaggcaacaccgccccctatctgcaatacgcctacacccgcgtgcaaagcgtgttccgcaaagcaggcgaatgggatgcaaatgcgccaaccgttttgaccgaaccgctggaaaaacagcttgccgccgagctgctgaaatttgaagacgtactgcaaagcgtggcggacacggcgtatccgcactacctcgccgcctacctctatcaaattgcgaccctgttcagccgcttctacgaagcctgtccgatactcaaagccgaaggcgcaagccgcaacagccgcctgcaactggcaaaactcaccggcgacacgctgaaacaaggcttggatttgctgggcatcgatgtgttggacgtaatgtaaaaccgcaccgcccgattgcggacaacagcctcgccatccttatccgaatctgaaaaaagcggcgcgatacaccgtatccgccgcccctcccaaaatgcgaaacaaacaaacgccaagcaagcaagcaagcaagcaagcaagcaagcaagcaagcaagcaaaaaattataacccccttcctgccgacgcacgcactttccgcgcggcgcattccccttttcccgcccctcaaatccgccttttcttcaggcagggtttcagcccgcctcttttccctgttttcctttccccgacacgcgtgcgctccccctgccgcactgtgctgcactttcgcgcccggacggcatcgttccgccatccggttctctgttttacatacccctgtttcagaaagaaatgcagatgtttcaacacacaggacgacacataaagcaccgccctatgtgttgccctgatttggaaggggttacgcctcccaaataaagtctgatcctgccgccccgaaggacagatgtccgagtggcgaagtttcaaccgaaaaggaaatacgatgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataacaacaatgccgtctgaacgcaccaacagccttcagacggcattttgcagacagaccgacccttcaagcccacttttttcatcatctccgataaattgctttgtatagtggattaacaaaaaccagtacggcgttgcctcgccttagctcaaagagaacgattctctaaggtactgaagcaccaagtgaatcggttccgtactatttgtactgtctgcggcttcgtcgccttgtcctgatttttgttaatccgccataaagaccgtcgggcatctgcagccgtcattcccgcgcaggcgggaatccagaacgtggaatctaaagaaaccgttttacccgataagtttccgcaccgacagacctagattcccgcctgcgcgggaatgacgggattttaggtttctgattttggttttctgtccttgtgggaatgacgggatgtaggttcataggaatgacgtggtgcaggtttccgtatggatggattcgtcgttcccgcgaaagcgggaatccggaaacccaaagccacgggaatttatcggaaaaaccgaaaccgctccgccgtcattcccgcgcaggcgggaatctaggtctgtcggtgcggaaacttatcggataaaacggtttcttcagattttacgttctggattcccactttcgtgggaatgacgggatgtaggttcgtaggaatgacgtggtgcaggtttccgtatggatgggattccctcttgcgtgaggctgacagatgccgtctgaaagactttcagacggcatagctttttctctttgaatttatagtggattaacaaaaatcaggacaaggcggcgagccgcagacagtacagatagtacggaaccgattcactcggtgcttcagcaccttagagaatcgttctctttgagctaaggcgaggcaacgccgtactggtttttgttaatccacgataaatttgccacaaaaaagctgcctcaaatgaatacccgggcagctttttgttgatatgactccaatcagcggtgttgcggattgtaacgtttttccaaacgcaggaatatccagcctaagaaagtcgtcatcaacagataaatcagggcgacggtgtaaagcggttcttcataaaccgaataccggcccgtaatcgtattctgaacatacgccaactccgccacagcaatgaccgacagcagcgagctgtctttcaagagcgtgatgaactcgctcgccaaaggcggcagcatgcggcgcaatgcctgcggcagaatcacatagcgcatcgcctgcggataggtcagccccaaagaacgcgccgcctccatctgtcctttgtctatagactggatgcccgcgcggaaaatctcacagatatacgcccccgagttggcgatcagtgccaaagaaccggcaatcagcggcccgtatccgcgacgcagcgcgattgccgcctcgccgctgaccaaaatgccgtctgaaggatggacgaaaaacggaaaccacacatacgcccaaatcacaatctgcacaaacagcggcgtaccccggaacagcgtaacatacagcagcgaaactttacgcaacgcccacgccagcacgcgcatcggcgcaccggctttttccaagtgaatcaggcgcgccaacgccaacaacagacccaataccgaaccgcccgccgttgccacgaccgtcagccccaaggtcgtcagtgcgccgtaaagaaacatccagcggtattcgtaaataatgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaacgtcaggattacccttggcagggatagatgactttcgcaccctcttccgtccccaaaatcaacacatcggcggcatcgcgggcgaatatgccgttttcgagcacgccggtgattttgttgatttcgtcttccatcgtcagcggctgatcgatattcaagccgtggacatcgacgatttggttgccgtaaaacgtggtgtagccgatacgcagttcgggctgtccgcccatagcgagcagtttgcgcgaaacaagagagcgcgcgctttcgacgacttccacaggcagagggaatttgcccaaacgtgaaacatatttgctttcatccgcaatgcagatgaatttttcggacgcgctggcgacgattttttcgttgaggtgcgcgccgccaccgcctttaatcatttgcagggcgtggttcacttcatccgcaccgtcgatatagaccgccaaccccgatacttcgttcaaagaaacgacgggaatatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctgatgttttgaattgaagttcagacggcatcgagcagcagcctgacgatgtatgcgtcctgcggctgcgtcagtttcaaattgcgcacgtcgccctgtatcagtagcggacgcacacccaatttttccacggcggacgcttcatcggtaatgccgtccaagttttccgcagccaatgcgcggtgcagcagcccggcgcggaaaagctgcggcgtttgcgcctgccaaaggctcgtccgctcgacggttgcactaatgttcccaccgtccgcgcacttgagcgtatcggcaatgggaattgccaaaatcccgccttcggcggcgttgcccgcctgttctatcaaccgcgtcaaagcttcagacggcaggcagcaacgcgcggcatcgtgtaccagaatattgtcggtttccgccgccaaaccggtttccaacagttttgccacaccgttgcggacggtttcggcgcgggtctgtccgccgtttttccacacccgaacctgtggaaatgccgtctgaaccttatcggcaaacgtgtcttcgggcgagacgacaacgacggtcaaatcgacggcctcatgccgttcaaaaatcccaatcgtatgttctaaaacggttttgcttccgatttcgacatattgcttgggtttgtccgcaccgaaacgcgccccgatgccggcggcgggaatcagcgcgatatttttgcgcttcatgcgtccgtcccgccgttttcagacggcacggcttccttgcgccagatacaggcttcgcccaagccgtccaaatattgcccgtgcgccgccaactcgttttcgtccgccctgatgactttcagtttgccgctgcgtttggtttcggtatgcaccacgggtttggtttccattttttcctctgcggccgcacccatcaggtcgaactgccgccgcgtcatagcaagatagacttcgcccaaaagttcgcagtcgatcaatgcgccgtgcaggacgcgcttgctgcggtcgacggaaaaacggttgcacaaggcatccaggctggctttctgcccggggaacatttcgcgcgccatcgccagggtatcggtaacggtacagccgagttcctcaacggtcggcaaccccatccggcggaactccatattgaggaagcccacgtcgaatttggcattgtggataatcagttccgcaccgcgcaggaaatcggcaatctgcctgccgacctctgcaaacggcggcgcgtttttcccttccaaaacctgtatcgtcaagccgtggacgcgtgccgcctcttcgggcatatcgcgctcggggtggacatagaggtgcaggtttttgtcggtcatttggcggttgaccatttccaaaccggcaaactcgaccaagcggtcgccgccgtcggcatacagaccggtggtttcggtatcgaggatgatttggcgtgtcgtcatatcggtgtctttcttctatcttcgtaaattgcttattttttaagcaatgtatttttctgttttcatttcaatgcacaaacccacttattcacagtgtgttcacaacattgggcaggcggattgtgtattttggggacaattttttcagacggcattcaaggttttttcctgattgccgccgcgcctaaaaaccgcctttcgcgcttaatcaaaaataccgacaacggaatattgcccaaagcgacaatcagatacaacaaggaaatgctgtcaaacaaaaacagcaacaccgcgctcaaaacggcagcggaaaccataaaaataccgttaacgatattgttggcggcaacggcgcgggcgcggaaagtctcgctactggcggtttgcagccaggtatagagcggaacggagaaaaatccgccgaaaaagccgatcagcgtcatcaccgccatcacgggatatgcccatccttgcgataaaaaccaaaaaatgccgttcagcccttcaaaacggtgtccgtgcgtcagccacaccaaaaccaagccgcaaaccgtcaaacccaacgcaccaaccgttacccaagccaacatcaggcgttccctgctgaacttggcacacagtaccgaaccggcggcaataccgatggaaaacagagcaagcatcaggttgaaaacattgtcgttgccgcccagatggatttgggtaaaggtcggcagttgcgtggtataaaccgcgccgacaaaccaaaaccacgaaataccgataatggcggtaaaaacgggcttgtgccgcaccgtttcacgcagcagggattttgtgccacggacaatattccactcaatttgtgtatcggcagccttggcgggtacggacggcataaacaggctgccgaccgtgcctccgacggcgaccagcaaaaccagtatcccgacaatataaggcggtacacctgccaccgccgttcccaaaatctgaccgaacaggatggcgacaaacgtacccgattcaatcaggctgttgcccatcatcaactctttgtcgtcgagataatcgggcaggatggcgtatttcagcggcccgaacagcgtcgattgcgcgcccatgcaaaacagacacgccaaaagcagcggggcagaccggatataaaacccgtatgccgccaccgccataatgatcatttccagcaccttgacccaacgcgccaaaacggccttgtcgaatttgttacccaactgccccgacagcgaggaaaacaggaaatacggcaaaataaacagcaacgcgcccaagttcaacatctgtccggcaggcaggaagccgttttgccccaaaccgtaaaacccaatcatcacaaacagcgcggttttgaacacattgtcgttgaacgcgccgagaaactgcgtagcgaaaagaggtgcgaaacggcggcttttaaccagtcccaaaccgccttttttagcgtacatcgttttccctctctttttcaatcagtttacttgtcgaatcatcatccatcaggatgcggtgcgccggcccttccaagtcgtcaaactgcccgtttttgcccgaccaccaaaaaaaccagccgatgacaaacgccaaaataatgctgatgggcaccaatataaacatgctttccatcacatattccctgtcaaatcgttcaaaacaaaagtctgccccgacacggtcagatattcgttacgcaaagttccgacgggagcttcgtcaaaaaacagctcgatacggtctttgaccacgcgccaatattgggggatttccgtctgaccgaacggcgacaggacatgattttccattccgccttcaagtttgacggcaaaacgcccgctttgcggccgtgcttccgattcgtcgtcggcaagcaggatgaaaaagcctatatgccgtcccgattggtcatgaatactgaaataatgcataaatttcccacccgccttttttcagacgacaccaactaaaaacagggcgaatgtaccagtttggacgggaagaatgcaaagaaattctccctcccccagccgaaaacaccggcaaaccgcatatcccccttttttccgtcaaaatgcctgacttccgccattttcacgcaaacgcccgattaagccaagcaattgcaaagattttttgctagaatagcctgcttcttttatcaaccttttcagacggccccactactttcccgcccaggaaggcaaaacggattcggcacgaatccggttagtatccgtgtccgattccaatgccgtctgaaactttccggagtaagaaaatgtcccaaaaattgatcttggttttgaactgcggcagctcgtccctcaaaggcgcggtcctggataacggcagcggcgaagtcctgctcagctgccttgccgaaaaactcaacctgcccgatgcctacatcacattcaaagtaaacggcgaaaaacacaaagtcgatctgtccgcacatcccgaccacaccggcgcggtcgaagccctgatggaagaactcaaagcccacggcctcgacagccgcatcggcgccatcggccaccgcgtcgtcagcggcggcgaactgtacagcgaatccatcctcgttgacgacgaagtcattgccggcatcgaaaaatgcatcccgctcgcccccctgcacaaccccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgttacggcgcgcacggtaccagctaccgcttcgtcgccgacgaaaccgcgcgcttcctcggcaaagacaaaaaagacctgcgtatggtcattgcccacttgggcaacggcgcgtccattaccgccgtcgccaacggcgaatcgcgcgacaccagtatgggcctgaccccgctggaagggctggtaatgggtacgcgcagcggcgacatcgatccttccgtattcggcttcctcgccgaaaacgccaatatgaccatcgcccaaatcactgaaatgctgaacaaaaaatccggtctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggtttggacgcactggtctttaccggcggcatcggcgaaaactccgacatcatccgcgaacgcgtgatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgacactgcccgtttgagcggtctgtaaggttttatccgcacacgaactgcctccggaaatggaggcagtttttttatccggctttccatgcttaaacagcactgcctcttttcagacattgacggttgcagccgcttacctgaaccttatagtggattaaatttaaatcagtacggcgttgcctcgccttgccgtactatctgtactgtctgcggcttcgtcgccttgtcctgatttaaatttaatccactataatgattaactattttttaatcatgttattattttccataaaatacatgacattaagatgtttttccacaaaagatacacacaccggcaaacaccggctgtgtttatcttttcttatgcctattttttaatcatcgtatttttatcttttaatttcaatacgcaaactaacttatacacacggttttcacatctttagactgcttccgtgtgtatagtggatattgccgttttcctttctgacaaaaatgccgtctgagaacttcagacggcatttgaaacatcggaatcagcggttttgttcataccactcgataaacttgtctgctttgacaaaacccagcagcggctcgctgcggctgccgtcggagcggacgacaaacacgcccggcggcccgaacagaccgtattctttcaacaacgcctgatgttcgggcgtgttggcggttacgtcgatttggaaaaagcgttccatatcgactgcctgatgcacttccggctgattgagcgtgtaagccgccatttctttgcaggaaatgcaccagtcggcataaaaatccaaaacgacgggtttgtcgggatgttctttcaacgccgtatccatcgctgccttcagcgcggcagtatcggcaaacattttgccgtgttccgaagatttgcctgcttcggctggtggattgagggtcaggaaatggtgcagcgcggtcgttttgccgtttgcgccctgccagccgaaccacgcgccgcctatcagcaatataccgcccaatgcgaatgccacagctttcggacggcgtttctgcctgcgtccgttgaccagcagcataaaggcaggaaccagcatcagcagcgtgtacagcgcgacgacgagataatagggcaagtgcggcgtggcgaggtaaacggcgacggctagcaggatgaagccgaatgcgtatttgacggcattcatccaatcgcctgccttaggcaggatatgcccgccgaacgtgccgatggcaatcagcggaacgccggtgcccaacgccaaagtgtaaagtgccaaaccgcctaaaaccgcatcgcccgtctgaccgatgtagcccaaagcaaatgccagcggcggggcgacgcacggcccgacaatcagcgcggacaatatgcccataataaagacggaaacgattttaccgcctgaaagcctgctgctttgattctgaaaatacgactgcacggcgttgggaagctggatgttgaacagcccgaacatagacagtgccaagacgaccattaaagccgatgccgccaataccacccaagcctgctgcaaccatacggtcagcagtgcgcccgtcagtccggcaacaatgccgaccagcgtataagtcagagccaaaccctgaacataaacgacggacagcacaaacgcccgcgccttgcccgcctttttgtcgccgaccacaatactggaaacaatcggcaacaggggatacatacaggcggtaaaactcaggcccaaaccagcgagaaaaaacgccaaaagattggcgttgagcgtatcccaagacagcttgaaacggctgtcgccgccctcatcccccttcgggggcggcagcgccccgctgccgttttgagaggaaggctgcaaaaagcggtctttggcggatgccggttcgtcggtttgcggatggtaagtgccgttgccgaaaatatcaaactcggtatccacgggcggatagcacacgccggcttcggcacagccctgataggtcaaaaccaatttatacggttcgccgacagcctttgcataaggaaaggcaacctgcgcctcgtgatggtaaaccgtctgcctgccgaaaaactcgtcttccttctcttcgcccttgctgaaagaaggctgtcccaacaaatccgccggatcggtcttgccgacgattttcgcctgatacatatagtatccgtcggcaatcctgaaacggacgttcacaccgtcgtcggcaacggcaagctccggcacgaatgccttttccggcggcagcagatcgttcgcatccagcgcgaaagctcgtccgcacaacatcaaaaatacggcgaacaggcaaatcagttttttcataatcgaatccgtttcagacaaataatttgtctgcattataaatggtaaggttgacggtgggatttaatttatgtaaaacccgccattatccgaacctatttccataaacatcttatcgaacccgccatgtacgatgtcaatacccacgatgtccgccgctttttcgcccgcgtgtggcagcagcggctcaatccgctgcaactgagcgcactggaacagaaagccctccgcattgtcgaagcccatcccgaataccaccgttatctcgaacgcatcgaagaccatctggacaccgactggctgcccgaaaacggcgaaagcaaccccttcctgcatatgtcgctgcatctgtccgtccaagaacaggcgggcatagaccagccgcacggcatacgcgcaatccacgacaccctgtgcgccaaacgcggctggctggaagccgaacacgaaatgatggaggcactggcggaaacactgtggacggcgcaacgctacggcaccggtttggatgtcaatttctacatgacccgactgcgcaaactcatcggcttgggtgcagaagatcaagccagattgaacccgcatgaaatcgcctgaccataccaaccgcctgcaaaatgccgtctgaagcggaacaacccctttcagacggcattcattttcccccaatcatttccacaacgcctttttcagcataatcaaccaatccttcttatccaaaacggggcgttgtgcaaacacatcgtatcggcacgcgtccagtttctgcaaaatcaactgcgcccccaacacaatcatacggagttccaaaccgatacgcccattcagttcccttgccaaaggcgaacccgccttcagcatacggaacgcacgccgacactcatacgccatcagccgctgaaacgccgcatccgcccgtcctgccgcgatctgttcctcagaaacaccgaatttcaacaaatcgtcctgcggaatataaaccctgcctttttgccaatccacagccacatcctgccaaaaattcaccagttgcaaagccgtacagatgccgtcgctttgcgccacgcacaccgcatccgttttcccgtacaaagccagcataatgcgtccgacagggttggcggaacgccgacaataatcggccagctcgccgaaatttccataccttgttttaaccacatcctgagaaaatgcagaaagcaaatcataaaacggctgcaaatccaaaccgaacggcacaaccgcctcggcatccaatcgtgcaatcaaaggatgcgccgaccggccgcccgatgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaacacaaccgccgcgccggccgattaccgttaacctgttcataaactgtacagcacatatttcaatgtaaatctttgttattttattgcggtgtaacttttttacaacattcttaaaaccattccgacctgtctgccgactttcccaatccgccttaataaatcatacaagatactgaaattatattaatctctataatatttatccctatcgaatttttaacagcaaaaccgttttacaggatttatcaatccgcccgccagaaaacttttcattcaaacctttttcccatctgtacgacattgcaatcccttattccatagtgcataattacgcaaattcagcgatgaatttccaacccggtttgtagtatggtcgataaagacctatttgtttcaataatttaaattggttctaaaggttactaaaatgaaaaaatccctgtttgccgctgctttgttgtctttggttctggcagcctgcggcggtgaaaaagccgctgaagctcccgctgctgaagcacctgccgccgaagctcccgctactgaagcacctgccgccgaagctcccgctgctgaagcacctgccgccgaagctcctgctgctgaagctgccgctaccgaagcacctgccgctgaagctgccgctaccgaagcacctgccgctgaagctgccgctaccgaagcacctgccgctgaagctcctgctgccgaagctgcaaaataagcattttccgcttgcaaaaaagcaggatacgttcagtatcctgcttttttgatttttcagacggcatcagattcccttcctcaatcttctccctacccttccgacaaacatgcttgaccttcataccgaattttcccgactcctaccggcagatgaaattgccgaaccttctccgacgcttttaaaagaccagcgcaaccgctttacgtctgcaccagacatcattttgcagccgctcagcgttaaaagcgtgcaaaccattatgcgtttctgccaccaacaccgtattccggttacgccgcaaggcggcaatactggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggtagcgaaggtacattgggcattatcactgccgccacgctcaagctgtttgccaaccccttagacaaagcaaccgcatgggtcggcatacccgacatcgaatccgccgtccgcctgctgaccgaaacccaagcacactttgccgaacgcctatgcagttttgagctgatcggccgttttgccgccgaattgtcttccgaattcagcaaactccccctgccgacacattcagaatggcatattttacttgagttgaccgactcattacccgacagcaatcttgatgatcggcttgtcgaatttctttataaaaaaggctttaccgacagcgtgttggcgcaaagcgaacaagaacgtatccatatgtgggcgttgcgcgaaaacatctccgcatcgcaacgcaaactgggcaccagcatcaaacacgatattgccgttcctatcgggcgcgttgccgactttgtccgccggtgcgccaaagatttggaacagaatttcaaaggcatacaaatcgtctgcttcggacatctgggcgacggcagcctgcactacaatactttcctgcccgaaatcctcagcaatgaagtctatcgttacgaaaacgacatcaacagcacagtctatcgcaacgtccttgcctgcaacggcacgattgccgccgaacacggcataggtatcatcaaaaaacagtggctggacaaagtacgcacgcctgccgaaatcgccctgatgaaaagcatcaaacaacaccttgatccatataacattatgaatccgggcaaactgcttccgtaaccggcatttctgatttgcatacacaacaaagaaagggacaatagatccgattgtcggtttagcgcgagctcgtgagtgcggttaaaaattggtggaaattacacgaaaaatgaccgcacttttaaaataaaaaaatcggcagtgaatttccctgccgattttattttgttacaacttaacttaaaacgtccactgtaaattcaacgcaccttgtttagcttgatgatgtttgcctgtttggcggttgaatgtggcttgtaaggttaagtgagatttgattttcactgctacacctaattggctctcaattgccgtcttattgtttatcactcgacgctctccgtccatttccacaccgaaaggtttgttgtggtaaagcgcgttcacagcggcgaaaggttcaatagcgatatttttatagagtgaaaattgagctttagcttgaacgccaacccgagtttgtaattggcgggagccaagtaaattcacgtgggcattttcgctatcgctgaattttccgtttacccccaaataagtcaattgtgcctgtggttgtaggtaaacacgaaggctgttgccctttttagtgaagtgttccgccaataacgcattgtaacctgcttcaattgaggcagtaataccttttgaagtaaaacgttctgtaccatcttcagtgttgatacggtggcggaagcgttgatattgcatccagctatccgcatacgcacctgtctgtttgtcctgaagttggtgccaagtggcgtaaacgcctgcaccaaagcctttcacatttcccgttgtaagattgtctgtatctgggttgtggaaagtgctacgttgttctgcttgtccgcccattaagccaatagaaagttgattactttcgttttgccatgtgaatacttcgccgccgagttgcacacctttacgatagccttctacaggtgctgttttgccttgcacccattggttggaatgtccgtcaatcacacgcaaccacaagcctttgcgtggtaaagtgcggtcgaaaatatcgctgtttttgttgttcaaacgcaaggcgaataaggtattggcggcttgagcctgttgtgcataaatcgccatatcatcgcgttcttgcactttggtaaaaaagccctctgggcgttgttgtaaagaaagcgtataaattcccttttggtgtttgccagaaagacggaatgcgtgtttatctgctgtgccatttactttgataatttgatgcccatcgaggctttttaaatcgtctattggattttcgaagatgatgtcggaagtgccagtaacatttttctcaaaaattaatgcagtatttttcgcttctttaggatcgtaagcaaaacgaaaacgagctccgccagcataatcttcttttacgagtaaactttcacttttagtattaaaacggatgtctgcattcgttgtttttaatttcccaacattagaatcccaacggggctcccagagagaattttctaagcggaattcatccaaactaatcgtttgcccgataacgtgcgagttgtctgtaacctcaatatagtggaatggatctaaaccagaatatagatgtgctgcaaaagaaacataattttcaatatgatgaattacttgattagcccattctgtataattcccgacagataaaatttcgctgttgatatgactattttttatttttggacctaaggagaatatatgactttttactataagaggatgggatccaaatttttcagcttggcaagtactataatcacgtatcttagtgttagaattaaaacattccttaaaatatttccgtatttgttcttctgtgtccccatttctttttgcaacccctaaacctcgggcgaagccaactaggtaaccttcggtatattcttgatcataaaaagaaatcttttttgagttattgatgttttcgaattggtatgttctagggtatagtgcgggaaagggtggaacttttggattatcctcggttataagataagtttcttttttccaatattcactcgttttatcgcggagtttttttaagcgggtaatttcatcattagtgagcttggttttgtcgtaaacgtaatcaacagccaaaagcggagaggtataaagaatagaaaaaaatagacttacaataaatgattttttaaacttctgcttgcttgcttgcttgcttcgagtttcataataaattttcctttgtcaagtaaaaataaatggggcgtggattttagcataaaactgaacaaaaaatgtcatttatctcacatttttctctatttatttcttgtttattaaaagtaaacgtttgctttttgctattttgtcaagccagtttgaaaatgtgtataattgccctcgttatttacaaaaatttcaggaaaaatgaccgcactttacccttggctaatgccaatttatcatcaaattgctcaaacctttgacgaaagcttggggcatcatgccgtgctgattaaagcggatgctggtttaggtgtagaacgtttacacatcaggcggcagccttgcccataccgtctgaagcactgtttccacaatcagcgcgtatgcttaatcaaccgctgtttctcgcgtttccaatccgcctctttcatactctggcgtttgtcgtgctgtttcttaccttttgccaaaccgatttccatcttgatttttccgcgtgaaaaatgcaaatccagcggcacgatggtgtagccggcacgttcggttttgccgattaatttgttgatttccgactggttcaacaagagcttgcgcggacgtacggcatctggtttaatgtgtgtcgaggctgtgggcaaagccgtaatatggcagccgaccagataaaacgcgtcttttttccaatagatataactctctttaagctgtacgcgcgcggcgcggattgctttgacttcccagccttccaagaccaaaccggcttcaatccggtcttcaatgaaaaaatcgtgaaatgcttttttattgttcgcaatagccataaacatcctatcaatatccgccgtcagacggcataaacccgaaaacagaacccatcataccgcctcttcaaccgcctgcacaatcttctcgggatacagcctgttgaggcagtcggtatgccccagcggacattcccgcttaaaacacggcgaacattccaagtgcaggctgacgattttcgccctatcgctcaaaggcggcgtatgcgtcgggctggaagaaccgtaaaccgccaccaccttcctgcccaaagctgccgccaaatgcatcaatccgctgtcgttacacacgaccgtgtccgccaacgacagcaaatccattgcctgcgacaaatcggttttgccgcacaaattgacacacataccgtctgaaaggcggttgatttcctcggcaatttcatcatctttttgcgaaccgaacagccaaacctgccaacccgccgccagataatgtttgcccaactcggcaaaatgccttgtcggccaacgctttgccggcccgaattccgcacccggacaaaaagccagaacaggctttccaatatccaagccaaaggtttcgacagaaatttcccgccgccgttcatcaatggaaaactcggggaatcccgaatgcccgtcaaaatcttcctgactcggatgcgcgagagccgtatatcgatccaccatcaaaggcagacgttccttatccagcctgcgtatatcgttcaacagaaaataacggctttcaccgacataacccgtccttttaccgatacctgtcgccagcgcgatgattgccgatttcaaagaaccgggcaacacgataacctgatcgtatccgcgccgccccaaatccctaccgacccgccaacggcgtttcaactccaacgcaccatgtccgaacgaattctcaagaatttcattcacttccggcatacgctcgaacaccgccatcgaccacttcggtgcgaacacatcaatcgtgcaaccggggtgaagttccttcaaacggcggaacaagggctgggtcatcacgcagtcgcctatccaactgggggaaataatcaggattttgatggacataacaagaaaccgaaatcagacaggcagaattttaccgcgaaaccgttggaaaacctatcttgccgcattccgaacgccggacgtgcaaatatgaaaaagcccgaacattcaagttcgggcttcaaaattctggctccccgacctgggctcgaaccagggacctgcggattaacagtccgtcgctctaccgactgagctatcggggaatggggcgtattatagcgtc

SEQ ID NO: 37768 - DNA, 23533 bp, Neisseria meningitidis
gcgggggcttccatcgcagtcatgcacaacatctgcatcaaatggttttgcaccatatcgcgcaacgcgccggtaatgtcgtaaaactcaccgcgctcttccacaccgagctgttcggcgatggtcaactgcacgctttcgatatatttattgttccacagcggctcgaacattacattggcaaaacgcagcgcaagcaggttttgcaggctttctttgccaaggtagtggtcgatgcggtaaatttgcccttctttgaaataacgcgcaacatcggtattgatttgctgggaagaagccaaatccgtacccaacggtttttccaaaactacgcgcacattgtcggcattcaaaccgatcgcagcaaggttttcacaggcttgcgcgaagaatttgggcgcggtggacagatagatgacgacgttgtcggtttctttgcgcgctttgaccaaatcgcccaaagcggcaaaatcgtccggctgcgtaacatcgactttgagatatgcgaaacgttcgacaaacgatgcccaagcctcatcggaaaaattttctttcacatggattttggaactggtttccaccttcgccagaaaaccttcggtatccaactcgctgcggctgacccccaaaatacgcccttcgggatgaagcagaccggcaacatgcgcctggtacagacagggcaacagcttgcgcatcgccaaatcgccggtcgcaccgaacaacaccaaatcaaaatttgtttgtgtactcatcgtattatctcgtcaggaaagaatttttcgatgccgtctgaaacctgtttcccccatcacgctgcatcgcaatatcggaaacaaaggcaggcggcataatgagtagtaatactacacaccgctacactttttgtctattcccatttttacaatttatttgacctagtccaaaaatcgggcaggtttcccctattccgttacaacaatcgaaagattctgcgatttaaatcaaatttcttttcaatgcctgatttttttgtaacaaaattacaaattttgtactataataacacccgcttcccactttcagacggcataccttttaaaatatagtggattaacaaaaatcaggacaaggcgacgaagccgcagacagtacagataatacggaaccgattcacttggtgcttcagcaccttagagaatcgttctctttgagctaaggcgaggcaacgccgtactggtttttgttaatccactatacttaccgtctgaatacccgatacaaaaatcagaaacgcacaaacaaatccccaataccccccccgttccgacaggagaccgaccgtgaacactactcctatccactccaaactcgccgaaatcaccgggcgcattattgaacgcagccgtccgacgcgtgaaaaatatctggcgaagatccgcagtgccaaacaaatgggacgcttagagcgcaaccagctcggctgcagcaacttggcacacggctatgctgccatgcctaaaagtatcaaaatcgaaatgcttcaggaaaccgtccccaacttaggcatcatcaccgcctacaacgacatggtttccgcacaccagccgtttaaagacttccctgaccaaatcaaagacgaagcgcagaaaaacggcgcgaccgcccaagtcgccggcggcacgcccgccatgtgcgacggcatcacgcaaggctacgccggcatggaattgtcgctgttctcccgcgacgtgattgccatgagtaccgccatcgggctgtcgcatcaaatgtttgacggcagcctgtttatgggcgtatgcgacaaaatcgttccaggtttgatgataggcgcgctttcgttcggtcatattccgggtatcttcgtccccgcaggcccgatgtccagcggtatcggcaacaaagaaaaagcccgcacccgccagcttttcgccgaaggcaaggtcggacgcaacgaacttttgaaaagcgaaatgggttcttaccacagcccgggcacctgcactttctacggcacggcaaactccaaccaaatgatgatggaaatgatgggcgtgcacctgcctgccgccgccttcgtccacccttacaccgacctgcgcgaagcgctgacccgctacgccgccggacacctcgcgcgcggcatcaaaaacggcacgattaaacctttgggcgaaatgttgaccgaaaaatcctttatcaacgccttgattggcctgatggcaaccggcggttcgaccaaccacaccatgcacctcgtcgctatggcgcgtgcggccggcgtgattttgaactgggacgacttcgacgaaatttcctccatcatcccgctgctcatccgcgtttatccgaacggcaaggccgacgtgaatcactttaccgcagcgggcggactgcctttcgttatccgcgaattgctgaatgcaggcctgttgcacgacgatgtcgataccgtcgtcggacacggtatgcgccactacaccaaagagcctttccttatcgacggcaaactcgaatggcgcgaagcccccgaaaccagcggcaacgacgacatcctgcgcaaagctgacaacccgttctcccccgacggcggtctgcgcctgatgaaaggcaacatcggacgcggcgtgattaaagtgtccgccgtgcgcgaaggctgccgcattattgaagcgcctgccatcgtgttcaacgaccaacgcgaagtgttggctgcgtttgaacgcggcgagttggaacgcgattttgtgtgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtccggcaaagttccagcctccatccacatgacacccgaagccctgatgggcggcaacatcgccaaaatccgtaccggcgacctgatccgcttcgactccgttagcggcgaactcaacgtcctgattaacgaaaccgaatggaatgcccgcgaagtcgaaagcatcgacttgggcgcgaaccaacaaggctgcggccgcgaactcttcgccaacttccgcagcatgaccagcagcgcggaaaccggtgccatgagtttcggcggcgaatttgcctgatgcgcgtttcagacggccttttcagaccgaaggccgtctgaaaaattattcaagcgttttaagatagacgtaggttggattctcgaatccgacacagccgtccaagatgtcggtttcttgaatccgacctacaacctgtcccatcttaataaaataccccattccacccggagaaccgaaatgtccaaactgaccccccgcgaaattttgaccgccggcgcagttgtgccggtaatggcgattgacgacttaagcaccgccatcgatttgtcccacgcccttgtcgaaggcggcatccctaccctcgaaatcaccctgcgcacccctgtcggcctcgatgccatccgcctgattgccaaagaagtgcccaacgccatcgtcggcgcaggtacggtaaccaatcccgaacagctcaaagccgtcgaagacgcaggcgcggttttcgccatcagcccggggctgcatgaatccctcgccaaagccggccacaacagcggcatccccctgattcccggtgttgccaccccgggcgaaatccaactggctttggaacacggcatcgacaccctcaaactcttccccgccgaagtcgtcggcggcaaagccatgctcaaagccctgtacggcccttacgccgatgttcgcttctgcccgacaggcggcatcagcctcgccaccgcgcccgagtacttggcactgcccaacgtcctgtgcgtcggcggctcttggctgacaccgaaagaagccgtgaaaaacaaagactgggacaccatcacccgcctcgccaaagaagcggcggcgttgaaacccaaagcctgattcgcatcgtaaaaatgccgtctgaaaaacctttcccgtttcagacggcattttgccgattgagggcacagtcggcatacacggcagcactgatcagacataccgcccctaaaatgcccatccgccttccgcataataaaaataacgttcagttcattcgacagcagccggacagcccatactacgcggctgaaaaaatgccgtctgaaacgcattcagacggcatccacttaaaaaaaacaactgattcaacgccgattaatccgcttccaaaaccactttcatcacttggttttcggcggcgtgtttgaacacgtcgtaggctttttccaattcactgaatttgaaatgatgggtcagcattttggtgtaatcgacggagctgctggaaatcgccttcatcagcatttcggtggtattggcgtttaccagaccggtagtgatggcaagctttttaatccagagtttttccagtttgaaatcaacggattgaccatgtacaccaaccacagcgatatggccgccgggtttcacaatgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataaggcgtacggacgtattcggcctgagtaccgtcaatcatgtaacccaaaatccaaccgccgttacggcagtgtgaatagagttgggttttgcagttgtcgcaagtgcaacatttgctgacgcatgaaataatgactttatcgccgactttgatgttttttacagcctcgccgacttcttctacaataccgatgccctcatgaccgagaatacggccgtcggcaacttcggggtttttgcctttccaaatacccaaatcggtaccgcaaatcgtggttttgacgattttcaccaccgcatcggtcggatcgataatctgcggacggggtttttcttcaaaacggatgtcgtttgcgccgtgataaaccattgctttcatgctgatactccttgcttgttgataaataatttcaataccgcaataaagtttctttatatgagttatatgcccctacaaaaaataagtcaataagaattattttcacaatgttatacaataacataccgttttaaatataaataaaaccaccgattgatattaatgaacacacccatccccttctccgaacggctcatccgctggcaaaaacaacacggtcgccaccacctcccttggcaggtcaaaaacccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgcgtactctgccgcgtgttcgcccgcgacggcaatccgcaggacaaaaaatttgaaaactcgctctggacacttgccgaaagcctgctgccgtctgaaaacgccgatatgcctgcctatacacaaggtttgatggatttgggcgcgaccgtgtgcaaacggacgaaacccttgtgccaccaatgcccgatggcggacatctgcgaagcgaaaaagcaaaaccgcaccgccgagctgccgcgcaaaaaaaccgccgccgaagtaccgaccctgccgctttactggctgattgtccgcaaccgggacggcgcgattttgctggaaaaacgccccgccaaaggcatttggggcgggctgtattgcgtgccgtgttttgaaagtttgaacgggctttccgactttgccgccaaattctccctgaccatggcagatatggacgaacaaaccgccctgacccaccgcctgacgcaccggctgctattgattacgccctttgaagcacaaatgccgtctgaaagcccttcagacggcatttggataaagccggcgcatttgaaagattacggtttgcccaagcctttggaaatttatttaaacggtaataggttagaataaacaaaataaacccattgaactgttgtttgcaggtatcgcagcaagaacaaccgatgaatttgggtcgtattttaggcggcgggataatgttcaaatgggacatttggaacggaagaagtcggcaatttaaaaaggatttaaaaagcaaagaaggtcaaaaacatgaacacaaacttaaatgacaaagacaaagccatggataccgcaatcaggtttcagaaaaggatgaggattccgaaatttttctttttaattctcggaatcacaatggttttggcatttatccaagacgtgataacgggttctaattttctgcaaataacaattaatgtaaaattttcgtaaaaatttatcggcttttaaaacaaaattgactaaaatagtcgcgagtttttactgcaataaaggagattgcaatgaatatgaaaaccttattagcactagcggttagtgcagtatgttcagttggtgttgcgcaagcacacgagcataatacgatacctaaaggtgcttctattgaagtgaaagtgcaacaacttgatccagtaaacggtaacaaagatgtgggtacagtgactattactgaatctaactatggtcttgtgtttacccctgatttacaaggattaagcgaaggcttacatggtttccacatccatgaaaacccaagctgtgagccaaaagaaaaagaaggtaaattgacagctggtttaggcgcaggcggtcactgggatcctaaaggtgcaaaacaacatggttacccatggcaagatgatgcacacttaggtgatttacctgcattaactgtattgcatgatggcacagcaacaaatcctgttttagcaccacgtcttaaacatttagatgatgttcgcggtcactctattatgatccacacgggtggtgataatcactccgatcatccagctccacttggcggtggcggcccacgtatggcatgtggcgtgattaaataattcgattgttcgaaacgaaaagtgcggtgaattttgaccgcacttttttgctagatatttagcattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtttcaattcataagtttcccgaaattccaacataaccgaaacctgacaataaccgtagcaactgaaccgtcattcccgcgaaagcgggaatctagaccttagaacaacagcaatattcaaagattatctgaaagtccgagattctagattcccgctttcgcgggaatgacgaaaagagacctttgcaaaattccttttccccgacagccgaaaccccaacacaggttttcggctgttttcgccccaaataccgcctaattctacccaaatatccccttaatcctccccggatacccgataatcaggcatccgtgctgccttttaggcggcagcgggcgcacttagcctgttggcggctttcaacaggttcaaacacatcgccttcaggtggctttgcgcactcactttaaccagtccgaaataggctgcccgggcgtagcggaatttacggtgcagcgtaccgaagctctgttcaaccacataacgggtcttcgacaaatatcggttgcgtttggtttgcacttccgtcagcggacggttgcggtgggctttgcgcataatgccgtccagcaactgatgttcttccagatgttgccggttttccgcactgtcgtagcctttgtcggcatagacggtcgtacctttgggcagtccttccaacaacggcgacaggtgtttgcactcatgggcattggcgggggtaatgtgcagtttctcgatatagccttctgcatcggtacgggtatgttgtttgtaaccgagtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaaaagcagcctacacgcccatcccccgccttctacccgttctgtaaatcatacagatagcggtaatatccgttcggcttcgccagcaattcctgctgtgttcccgcttccacaatcctgcctttatccatggcaatgatccggtgtgccgttttaacagtggacagacggtgggcgataatcagcaccgtccggttggcgcaaatggcctgcatgttctgcataatcgctcgttcactttcataatccagcgcgctggtggcttcatcaaaaatcagaatgcgcggattggtgattaacgcgcgggcaatcgcaatacgctgccgctgtccgcccgacaagccggccccttgttcgcccaccacggtgccgtagccttccggcagctccataataaactcgtgtgcgcccgccagtttggctgcttcgataatgcgttccagcggcatacccgtatccgtcagcgcgatattgtcgcgtatgctgcggttgagcagcacattctcctgcaagaccacgccgacctgccgccgcagccaggcaggagcggccaaagccaaatcgttgccgtccaccaacacccgtccctgctccggtacatacagacgctgcaccaatttggtgagtgtggatttgcccgaccccgaacgtcccacaatccccagcacttcccccgcccgaatccgcaggttcaaatcctgcaaaatcagcctgccgtccgccttatagcggaaatcgacatgttcgaacgtaatctccccccggatatcgggcaaagccaaatgcgaagacgcattctcggtcggcgcattcagaatatcccccaaacgcgccaccgaaatccccacctgctggaaatcctgccacaactgcgccaaacggataacaggcgccgccacctgtcccgagagcatattaaacgcaatcagctgccccaccgtcagcttgctctcaattaccagccgtgcgccaatccacaacgtcgccaccgtcaccagcttctgaatcagctgcaccccctgctggccgaccaccgccaacttcgttacccgaaatcccgaagccacataagccgccaactgattgtcccaacgctgcgtcatctgcggctccaccgccatcgcctttaccgtacccaccgcagtgatgctttctactaaaaacgactggttgtctgcattgcgcgcgaacttatcgttcagacgcgtccgcagtatcggactgataaatgccgaccaaaacgcataggcaggcaacgaagccaataccacccaagtcagagtggagctgtaataccacatcaccgccagaaagataaacgaaaacgccaaatccaacaccgaagtcagcgcctgaccggtcaagaaattgcgaatctgctccaattcccgcacccgagccaccgtatcacccactcgtctgtgctcgaaataggataaaggcagggaaagcagatgccggaacaaacgcgcgcccaattccacatcaatacgtgaagtcgtatgtgcaaacagatacgtccgcaaaccgcccaacacaatctcaaacagcgacaccaccaacaaagccaccgacaccacatccaaagtagagaatccccgatgtaccagcaccttgtccatcaccacttggaaaaacagaggcgtaatcagcgcaaacagctgcaacaccaccgacaccaccaatacttcaaaaaacaaccggcggtatttgattaccgccggaataaaccaggtaaagtcaaactttgccaaactgcccaataccgaagcgcgggaagcaaccaatatcagtttgcccgaatatctgttagaaaattcggcaaaagacaataccgcagacttattcgtaaccaaatcctgtatcaaaaattgggcatgctcaccctcaccgtctgttttggccaaaatgaaatggttgccgtcatcacaccataccaatgcgggtaaagtcgccatagccaaacgtttaataggctggcggactacctttgccttcaatcccaaagatttggcggctaacagccattgcgtttcatttaaatcgctctgtgcggaagtacaaaattcatgctgtatatcggcaggattggcggcaatgccgtggtaatgggcgaggatgatgagggcggaaagggcggggagcggtgcggatacgatagacataaataaaatatagttagattggatgtggataacggctggctggaaaaggaatatattaagtagaaagaaatatataaataaaacagcagaacgcattgtaaggatatatatgggaattgtaaagagaaagtatggaaaagttctcgtttcaggaaggtaaaacggcttaggaatcgagttagatgaggatgcctcgcacctctcgtgcctcctgcataccgttaaggcacagggttaaggtgcaggctgctccgaactctgttgcggtcgggtaatgttattttttgtgtttcaggcagcctgaaatatctgtatatttttgttttaaatagattttaaagattgataactgttcttgacgatttttcaagaaaggagtaaatttcaagaaaggagtaaagtgacttattatcaatgacaagcaacgcgcgaagtgacaaggaaaactatctacttaaattctaaggaggcttcgaatatcataaaccaatcagaaacatagagataaaaattatgtacaaatataatcctcttatacaatttattgcacagttgattatgtcttatggagcaagcgtagggtgggcacttgctgccccacgcgtttcatatttcaaggcagcctgaaaccgtgtgggcataaatgcctaccctacatcccaaaaaacaagcgcagcctgcgtgtgtagggtgcgaactttcggcaggtagacacgcagttttatattttcaagctgagggatgcttaagaaaagtacaaaacattaaaaaataaggggctgtactagattagccctaaatccacaccaatcccgcaagatttttagctgtcgggacggtgtgccgaagttaaatcgaaattcgcattctttcaagaacagcgggaaagatttgcgatcaattccgttctatttgcgcaagacgcgttttgcctgattccaaaagttctcaatgccgtttatgtggttctgacggtcagcaaattccttggaatggttgatgcggtaatggataaaaccgcttacgtccaacttgtcgtaactgctcaggctgtcggtataaacaatgctgtccggcatgattttctgtttgataacaggcattaaagtatcggacttggcattatctacgacaacggtatagacccgtccgttacgtttcagaatgccgaagacaaccacttttcctgccgcaccgcgaccacgtttgcctttacgccgtccgccgaaatagctttcgtccaactcgacagagccctcgaaaacctcattggcagccaaggccagataatggctgatgaccatacggattttgcggtagaacaggactgccgaattgggatggatacccaaaatatcggcagcagaacgggcggtaacttcgagtacaaaaaaacggagcagctctttctgtacttttttctttaatttgcagtgtgttatcttcatatttcgggggtaacatatctgctaatctagtacagcctcaaacaaaaaagagaaattttaatttcgctaaatcgcataaagattaatcaagagtatcattaaatgatatgagtgagcatctataatgccaagaagagttgttaagacataacgattattgaaatagattgtaaaatagatacttagatagtctgaaaaacggatttgtgaaactttttattacgcgccatcatttgaaaatgaaacttaaaaaacacttatcataataaatattttctttacgttgtttgctaataaactcagtgcaatatcagcgcaatattttatggaaattttatggataacaaaaaagaatttattaataatttaacaaataggtatatgtggatctatccattggtcttaaatattctatttctacctttttaccagtcctaccaatctttttttattgcgcttggttgtttgtttgcactggttagaaaaatgcaaagcttagattttaaattacaaaatcatattgtattgttaaatataaaaagtgcttgggcagataaaaaagtatttttgattaggatagtagtgtcatggttggcagtaatggaaatatggatgtgttttatttcggaatcatcaacgtgggtatgcggtgctttttgtttaaatagtgaaatattggaaaaaatttttcgtggctttggttattctggtagtttatattttttatttatattgatgattgatctcaataagttaagagagagtatttgaatttcattttttgtttgacttaaactcaaggagagtaacaatgattggtagtggtgatactaaacaatgcaaaaaattttctgcgtgtgatggaaaataccacgtctacgatcccctcgccctagacttggacggcgacggcatagaaacagtcaccgccaaaggcttttcaggcagcctgaagactgagagagtgaatacgatgagtatacactctatgccactaaattgatattcactaaatcataccagctatattttatttaatgagacatatgaaaaataaaaattatttactagtatttatagttttacatatagccttgatagtaattaatatagtgtttggttattttgtttttctatttgatttttttgcgtttttgttttttgcaaacgtctttcttgctgtaaatttattatttttagaaaaaaacataaaaaacaaattattgtttttattgccgatttctattattatatggatggtaattcatattagtatgataaatataaaattttataaatttgagcatcaaataaaggaacaaaatatatcctcgattactggggtgataaaaccacatgatagttataattatgtttatgactcaaatggatatgctaaattaaaagataatcatagatatggtagggtaattagagaaacaccttatattgatgtagttgcatctgatgttaaaaataaatccataagattaagcttggtttgtggtattcattcatatgctccatgtgccaattttataaaatttgcaaaaaaacctgttaaaatttatttttataatcaacctcaaggagattttatagataatgtaatatttgaaattaatgatggaaacaaaagtttgtacttgttagataagtataaaacattttttcttattgaaaacagtgtttgtatcgtattaattattttatatttaaaatttaatttgcttttatataggacttacttcaatgagttggaatagttttggtaattttatgagcgcacgctcatccgcgttagcagaatttggaaatatggttgctaatttagtttctgcaaaaaatgagaaagatatctcgaaacgtaatgaatattacaaacaagctggttatagtgcattattagcatttggtaatttggctagtaatattgcaccaggtagtacgtcatcgcatattgtaaacggaacaaatgcctctgtgattgcaagccgtctctctggaaatatatcttcagctattcaggagcataaagatggtaaagttaatatcaaccgttttcaaaatattttagcggatttatattcattgggagggttaggaagtacattaatagagaagaatggaaatatgcagagttgggggattccattagcaattgctggagatataattgcagcaacggctattgccacaggagatactggtacgatatctacagaggaattttataattttgacaactggaaaggttttgggtatgagctatttgaagactggtctcgttgggtatacgactggctgcccgacggctggaatctgtggaaagaattggacagaaaccgttcaggccaataccacatctacgaccccctcgccctagacctagacggcgacggcatagaaacagtcgccgccaaaggcttttcaggcagcctcttcgaccataacggcaacggcatccgcaccgccactggctgggtttctgccgatgacggtttactcgtccgcgatttgaacggcaacggcatcatcgacaacggcgcggaactcttcggcgacaacaccaaactggcagacggttcttttgccaaacacggctatgcagctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcacgaacaaaatgctatccattagccatgttcgggaaaacacgatttccccgtttgttttaggctgtctaaacaaataaccataaatgtatatcattatttaaaataaataaaagtatttaactattattgacgaaattttagagaaagagtagactgtcgattaaatgacaaacaatagtgagaaaggaaatatttactatccgagcacagagcatattttaggtagcctgtaactgttcctgctggcggaagaggatgaaggttgacttacccgagaataaatgtcctgttgtgtgatatggatgccatgccgcgaagcaattgatgcaatcacggcagtcctacttgaatgaaacctgtcgttgcagaatttgaaaacgctatttttaagaaaggataaagggagaaagaatttttggtttttaagctgcatgaaaccgtgttggaataaatgcacacctacgataattaataattttcgttttttattctacaagctatttatatatgattgctaaaagtttattttttagatgccaaaaaatatattttatatacttcatattgtttatatgtctttatttgaatatatcttacgatggggaaatatttatatattttataataaattttactcatttgctaatatgtcatggaatattacttgtattttgtagaatttttccatatgaaaatattccatttactatttttctgaactttattagtttatttttaatatttttacctcttatatttaccataagagagctaattgattcatattatattgagtcgataattaatttattcttaattttaattcctcacgttatttttttaatttacttgaaaggaaagcagatatgacatctgcaaattttaatattaacggttttggagatgtgaaattaacaccctattcaccactcttgggatataaagcttgggattcatttattggttctattcaatccttatctgatttaatctataatgtggataacaatagaaataaaatggaaattactgttaataatgctattcaagctgcagatagctttttaagcagtaattggaagagataacaaaataacaaaataacaaaataacaaatactgcttctttacttgcatccttcgataacattttttaaatttaagaaatgtatctcgagatatacgagaaacaggaaaatttaaacctaatgatattcaacaagcaattggtgatatattcattgctgctggtgatggattacaatatataaaacaacaaacagaggcgatggctcaaagcaaattcttaccaactaaattaaaaactggtttaaatgatgtccttaattctagaatgctaaaatcctctactgttttacagcatgaattgaattaaataaggattatggaaacgagaggcttggcgaatctataatgaatatagatgattttacaccaagtaagatagcaaacttttttgcggatcctgatacatacagcaatgtattagaagaagtatctaggtttatatattccttagttcctgatgatgcaaacccttggaaagggggcgaagattatattggacgagggataagtgaatggggagagttactggaaaaatggtataaacaagattttctcccttatcttgaaaagaatgggaccaatttccgaaatttgaagattggctgcctgaattccctgaatgggcaagagagtggttgaaattagctctcaaacgttcaggcaaatataacgtttacgatcccctcgccctagatttggacggcgacggtatagaaaccgttgccaccaaaggcttttcaggcagcttatttgatcacaccaacaacggcatccgcaccgccacgggctggattgctgcatatgacggttttcctgtgcgcaaattaaacagtaacgggggcattattagcacgacagataccatattccaatctttgcatacatggcttgatcatcaaccaagatgatatttcccaagcacagcatgatgcatgccattgaaaaatatagaaaattaattgaaagcttaaatggatattgaaatgaatgatcacatagtacaaattataagaaggttcgggctaggtaggatatttttttattcgtatagcaaatcatctataataattttttcttcgtatgttgtttattatataatttacaattatcaatttaattacctttcgcttttaatttatttattaccaatattgtgcagtatatatatgtttatattttttttagggaaaactaaggatacattaacgacagagcgaagaaaaaaattttttaattctatttttccacttagaattctaatgataataggttctgagaaaaagaggttaggcatcggtagtttttatttgctaaacctactatggattatttggtgtcttatgattcatagagaacaagtcccattaaataacttaaccctcctattatccttcatattttcattattttttttattatgtgattttgttttattattgaatgtttatgtttatttttttaaattaagagaggcttaatatggttaatcaaatcaaatctgataataattcagtttctattgaatttatataagattttataactgcaagtacggatgtaattaatctgagttacgaaaattttcgtaaaaatttttatacacaaatgtcaactgattctaccaattatgcagccaaacatgaaagtttaggaaaatcggtacaacgtgaattacaaaaaacacaaagtcagttgagacaagttgtaagaaaaatgcagagtaaatataatataaataataaagcacgagtagcagaaatatctttgttaaggcaaatgcaaagccaattttctcgaaaatatgtaaacaaaaatcttggtaacagcaacactttggctcaacaaggcagctacaccaaaaaagacggcacaaccgcgcaagcaggcgatttgctgttggctgctgacaacctgcacagccgcctcacggacaaaatgctatccattagccatgttcgggaaaacacgatttccccgtttgttttaggctgtctaaaacaaataaccataaatgcatatcattatttaaaataaataaaagtatttaactatttttgacaaaattttagaaatagagctagagttttagttaagtagaaattgatagtgcttcaagggaagtattctctatgtttgcattaaagggggtctgataaagctattattcattactatggacttttatttcattattttcaggcggaaatctcatagccgttttgaatttttctcttccttattaattatacaaataattagtatattctgatatggattttttggaaatttttattatgtctgcatttagaaaaatattattaataatatcttgcctattgattgctagctgcagttttgttgaaactattttttatatggctattagcccagaacctgttgtggtagactttcctcttggtaaaaaaacaaaaagatctattgaactcaaacagaaaattggtaaaccttatgcaatatcgttaggaactaattttatacattatgatccaaaacagggggagaggtggattgatgataagttaaactatccatataatatatcggttaaaatatttaaagtggaagaagatggtaaaaaacttattatagatgagttgcttacagagagaagtagaaaattaggaggcggagtatttggagctgggggaaaatacagtatgcatatttatgatttttatttgccggaaggggaatatttatttgagatttctgataatagtgaatatattccactttacgatgaaataaataattctataagaatagtagttaatgcacgaattcagtaaatttttctagaaatgtggggttacttatggctgattattatgcgataactgtaaaatttgcgaagcagggtacgccactgaaacaagagggggtgtatccaagacgggtacgtttgggttgaactgtattcggctagagataaaaaaatcggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaaattctcaatgccgttaatgtggttctgacggtctgcaaattccttggaatggttgatgcggtaatggataaaaccgctcacgtccaacttgtcgcagctgctcagactatcggtataaacaatactgtccggcatgattttctttttgatgacagggagtaacgtttcagacttggcattatctacgacaacggtatagccccgtccgttgcgtttcagaatgccgaagacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtactgccgaattgggatggatacccaaaatatcggcggcagaacgggcggtaacttccagcacaaaaaaacggagcagttctttctgtacttttttctttaatttgcagtgcgttatcttcatatttcgagggtaacatatctgctaatctagtacagccccaaaaatataccaaaaacagcaaaacaaattgtaaggataggtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcatcggaactatcataggtatggagagaacgattacagcactagcgtaggttcctgtattaacggtttcacggtacggtattacccgtttattcgggaaaagcagcagctcacacagcaggagttggtaggttatcaccaacaagtagagcaattggtacagagttttgtaaacaatccaagtaaaaaataatggggctgtcctagataactaggataaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctggttccaaaagttctcaattccattaatatggttttgtcgttcagcaaaatgtgtgctgtgattgatacgaaaacgaagtttcagcgaagctaaaatggctaaattcgcgcacatctaatacatcatagctacgataacaatccgtataaataatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaatagctcaatgagtttattttgtttatactggcttagacgactttttctcatagggataattctaacttaatttgaatttccctagttatctaggacagcccctattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggtatccgagct

SEQ ID NO: 37769 - DNA, 46594 bp, Neisseria meningitidis
cggggcttacaacatcggcgcaatcgacaaaaagaccatgcgcgactttgacaagtcctgcctgaccgaaatcaaaccgttgagcggcggagacatcaaggcaatcagggagaaggaggcactatcgcaagccgctttcgccatctatctcaacgtgggaaaaaatcacgtttcggcttgggagcggggcgttaaaaagccgagcggcgcggcgttgaagctgctgaccatcgtcaaaaacaagggcatcgaagccattgcgtagccgacttggcaaacggcaaaatcagcaagttcacaatagacgcgctgctgaatatgcctgccaagacaggcaagaccgccgaactgaatatcagggcgtagccgcataaatgcccgaccgcatcaaaccaagccgaaacggcggcggtgcagacgacatagcccgacagcaaggcacggcgcagacgggcgcgaaacccgaaacatcaccgaccgcgaggtacggggattttttgcgcccgttgcagggggggattggatttaagcggcgcgggcttgaaggcaaaacgggtggggcacagaactgtttaaatgcagtctgaatctcaaacgatttcagacggcattttgaaacaatggctcaaattctcgatccccttcccttaacgccgacgttttttattaacgcgccccttatttctgacactttgctcataaaccggcataacggtcggcaacaaccgttttagattttctatacgggcattgtttgtcggatgagtagaggtaatagcataaataaagccgttttggtcgttttcctgattcattttttcccaaaccctgacagcggccgccggatgatagcctgcctgcgccatcaacatcattcccccctcatcggcttcttcttccaagctgcggctataaggcaaggtaagaccgtacgtccccaaaatatccatacccaatccgaccaattccggattagtatccggttttttgtctaatataatctgcgtgcctatctgcgccgccgtattggtcaagatttgctgcccgaccttatttttaccgtgttcatgcagggcgtgcgtcatttcatgccccataatggcggcaatttcgtcatcggtcagcttgagtttgtcgactatccccgtataaaacgccatttttccaccgggcattgcccacgcgttcagctcatcgtttttgaaaaccgtcattttccagtcaaacttatggctggtattatttgccgcatcggcataaggcagcatacgtcgaaatactgcctgcaccctgcgggctgttctggatgtggtatcgacattgccggcagacttgtttaactcaaccgttttcatataatctttggcagccgcagcgttcattgtggcggaatcatgaccgtaaacatcagcaacgaccgcacaagcccccaataccgagattactgccgacaggcagagtatccgtttaaaggaaggaaggaaggaaatttcatatttaggtttactccttaaaaaattaaatttcaaaaaaatgccgtctgaatccaaaacggatttcggacggcatcttaacattgtttaatgtttttaaaaagatttacaccacgatgttctccagtctgcccggtacggcgatgattttcttggcaggcttgccttctatgaatttcaccgcgccttcagcggcgtattcggcagcttcttcagccggtttgtcgaaatcacgcataaattgccaataattctccaacttttttacggctgctgctgccttttgcggcaatattgcgctgaacttcaactgttttcaaaatggcagaagaataaatatcccttgtgaattcagtatcatgatttgaaatcaaaataccttgggagttgggcgcaatttattgattttttgtaaagtccgcgaccaatgaattcgatcgtattttggtcgcgcagaatttgcaactgttggcggattttgtctctgatatggttgttttggggaaattggatggatagtttgttttcaaattcatacatttgcgacaatgtgaattcttcggggagttggtcgatacatttcataacagccagaagccagcctttgcgctccgcattttggttgcgtaaaaacaaattggattgccattttttcagaacggtttcgggttcgataatgcgggaattgtctattaagaatattttgccgctttcaggcaaaggggcgagattgatagaacacataatgtggttcggccggtttttaatgcctttatttctgggaataatcatatccggcgtgatgaaatgtttgggtacaagcaccaattgccgtatggagtaatccgcttttttatatgcaagaaagaaaaagttggggttggtatctgaccggatgcgctccaacatggtgtgatatgcaccgtcaggcacgctgttgcctatggttttttgatttttactctttaattcatattgctcgtggcaatttgggcaaaagaggtctgcaacaggtttgttattggcaaatctctgcatcggcttgcttccgcaacaggggcagtagccgtttttttccaaccaagcctcgctcattacacggattttatgggttgctttattttgttgctttcccaattcggtatcgaaaaataaattcatgttttggattttgagatttcagttattcggggttcgtcatgcagacaacacaatccaccttaaaaaggccgtctgaaaccctgtttccaagtttcagacggcctttatccgtgtggctaaaccttaaaagcggttagacgacgatgttcaccagtctgcccggtacgacgatgattttcttcgccggtttgccttccatgaatttcaccgcgccttcggtggcgagtgcggcggcttcgaggtcggctttggatgcgtcggcggcaacagtgattttgccgcgcagtttgccgttgacttgaaccatcacttcgatttcggatttgaccaaggcggcttcgtcgactgtcggccagcctgcttcccacagtttcgcgccgttcaattcgctccacagggtttcgcagatgtgcggcacgatgggccacaacaggcgtacggcggtttccaatacttcttgggcgacggcgcgtccttgttcgccgccggtgtcggttttgtcgtattggttgagcaattccatcacggcggcgatggcggtgttgaactgctggcggcggccgtagtcgtcgctgactttggcagtggtcgcgtgcagtttgtggcgcaggtctttgagttctttagacaaaccgtcttggctgcctgcgaacgctttgaccgcttcgccttgcttcaagtattcgtaaacggtacgccacaggcggcgcaggaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaggacggcggaaatggggcggcctttgtcgtcgaacgtcagctcgacatcggcggggttgatccaatctttgccgcctttgtcgttttcgcggtagtaggtttcgcaaacgaccatgccttgcgtcagcaggcgttcaaacggttcgtcaacattgactagaccttcgtcgcgcatcagtttggtgaagaaacgcgcgtacaagaggtgcaaaatcgcgtgttcgatgccgccgatgtattggtcgaccgcgccccagtatttcgcggcggcaggatcgaccatgccgtctgaaaattttggcgacatgtagcggaagaaataccagctcgattccatgaaggtgtccatggtgtcggtttcgcgtttcgccgcgccgccgcagcatgggcaggcagtttcgtaaaactcgggcatttttgccagcggcgaacccatgccgtcgggtacgacgttttcaggcaaaacgaccggcaattggtcggcagggacgggtacgtcgccgcattgttcgcaatggacgatgggaatcgggcagccccagtagcgttggcgcgaaatgccccagtcgcgcaggcggtattgggttttcggttcgcccgcgccttggctttgcagcttggcggcgacggcgtcgaatgccgtctgaaaatccaagccgtccaagtcgccgctgttgaccaatacgccgttttctttgtcgccgtaccattcttgccattggttttcgtcaaatgcgttgtcgccgacggcaatgacttgttttttcggcagattgtatttggtggcgaactcaaaatcgcgttcgtcgtgcgccggaaccgccatcaccgcgccgtcgccgtagccccacaatacatagttggcaatccacacttccagcttgtcgccgttgagcgggttgacgacgtagcggccggtcggcacgccttttttctccatcgtcgccatatcggcttcggcaaccgaaccggctttgcattcggcaataaatgcctgcaattcgggtttgtcggcggctgcggcggctgccagcggatgctcggcggcaacggcaacataagtcgcacccatcagcgtgtcggggcgggtggtataaacttgcaggaatttcgcgtaatcgccttccaagccttgtttgctgtcgtctgaaacggcgaagcgcacggtcataccgcgcgatttgccgatccagttgcgctgcatggttttgacttgttccggccagtgttccagcttgtccaagtcgttgagcagctcttcggcgtaatccgtgattttgaagtaatacatcgggatttcgcgtttttcgatcaatgcgccggaacgccagccgcgtccgtcgatgacttgctcgttggcaaggacggtttggtcgacagggtcccagtttaccgtgccgtttttgcgataaacgatgcctttttcaaacagcttggtaaacagccattgttcccagcggtagtattcgggtttgcaggttgcggtttcgcgcgcccagtcaatcgcaaaacctaggcttttgagctgggttttcatgtattcgatgttatcgtacgtccaagcggcaggggcgacgttgtttttcatcgccgcgttttccgccggcatgccgaacgcgtcccaacccataggctgcatgacgttgaagccgtttaaaagtttgaagcggctcaatacatcgccgatggtgtagttgcgcacatgccccatgtgcagcttgccgctgggataggggaacatggagaggcaataatatttgggtttggaagcgtcttcggagacgttgaaaatacgggcgtcgtcccattttttctgcgccgcaggctcaatggcggcgggccggtattgttcttgcatagtcattctgttttcgcttaaaaacgttggaaaaataaagtcggcatcaattataacaggttgccggaagcggcgaatcggcagattgccggcaggatgcgtaaattcgcacgcgcattattccgtatgccgtacaaatacaccgcgtttattgatacgcacgttttttatgctaatattacaaaccaaaatcaaatgtttaaaactctcctgatgcggctcttccgaacaaaaggcagacgggcatcgggtaaaagaggattctgcatatgaaaatcaaacaaatcgtcaaaccgggcttggcagtattggcggcgggcgttctgtctgcctgcgcaaccaaaagcaacgtcaaagccgacggcacgaccgacaatccggttttcccgaaaccctattccgtaacgctcgacaacaagcgcggcacattcccgacttatgacgaactggatcagatgcgccccggcctgaccaaagacgacatctacaaaatcctgggccgcccgcattacgacgaaagtatgtacggcgtgcgcgaatgggattacctgttccacttccataccccgggcgtaggtatcgaccctgaaaacacttccggcgtagaagatgttactacctgccaatacaaagtgattttcgataaagacaaatttgcccgcagcttctactggaaccccgtcttcccgaaagatgccgcctgtccgccgcccgcacccaaagccgagccgcaagtcatcatccgcgaaatcgtgccggcaaaaccgaaacgtatccgccaataatccgacatgccgttccgcctgtttttagggatattatgcggcctgtcaatggttgcccccgtatatgcacaggggcagccggatacggtcggcgactttatccaaaagaaaaaagtcatcgtcgatacatccaaagcggaactctgtttcgctgacgaccgtcagtgccaccccgtcctcatcggtgttgccacgcccaaggggacgttcgggctgacgctgaacagtaccgacaagcccggatacggcggcgaagtcatcggtttcaagcaggagggtgattttcttttcgccctgcaccgcgtttggaatcagataccgtcggaaaggcggaacgaacgcatcgcctccccgtccgtgtccgacaggattatgaccaacggctgcatcaacgtcagcgatgcggtgtacgaaaaactgcgtcattattttgtgttggaagtgatttgaaacagacggataccgcacgcgccggtatctgttttcacattgccccgatgcctgaaacagactgtccgccacgtcatgccgtctgaaaccggcgcagatgccgccaagccttcagacggcattgcctgcccgctccgaccgaacaacaaccatctttgggagaaccttatgcccgaacaaaaccgcatcctctgccgcgaactgagcttgctggcattcaaccgccgcgtgttggcgcaggcggaagaccaaaacgtcccccttttggaacgcctgcgcttcctgtgcatcgtttcatccaacctcgacgagtttttcgaagtccgtatggcgtggctgaagcgcgaacacaaacgctgcccgcagcgcaggctggacaacggcaaaatgccgtctgaaaccatcgccgacgttaccgaagcggcgcgctccctgatacggcaccagtacgacctgttcaacaacgtccttcagcccgagctggcacaagaaggcatccatttttaccgccgccgaaattggacagacacacagaaaaaatggattgaagactatttcgaccgcgaattgctgccgatcctgacccccatcggactcgacccttcccaccccttcccgcgcccgctgaacaaatcgctcaacttcgccgtcgaactcgacggcacagacgcgttcggcaggccttcggggatggcgattgtgcaggcaccacgcatcctgccgcgcgttgttcccctgccgtccgaactgtgtggcggcggacacggcttcgtcttcctctcctccatcctgcacgcccacgtcggaaaactcttcccgggcatgaacgtcaaaggctgccaccagttccgcctgacgcgcgacagcgacttgaccgttgacgaagaagacctgcaaaacctccgcgccgccattcaaaacgagttgcacgaccgcgaatacggcgacggcgtgcggctcgaagtcgccgacacctgtcccgcctacatccgcgactttctgctcgcgcaattcaaactgaccgccgccgaactctatcaggtcaaaggcccggtcaacctcgtgcgcctcaacgccgtccccgacctagtcaaccgccccgatttgaaatttcccacacacacgccgggcagactgaaagccttgggcaaaaccgcgtccatattcgatttggtgcgccaatcgcccatcctgctgcaccacccctaccaatcgttcgaccccgttgtcgaaatgatgcgcgaagccgccgccgaccccgccgtgcttgccgtcaaaatgacgatttaccgcaccggcacgcgttccgaactcgtccgcgccctgatgaaggcggcactcgccggcaaacaagtaaccgtcgtcgtcgaactgatggcgcgttttgacgaagccaacaacgtcaactgggcgaagcagctcgaagaggcgggcgcgcacgtcgtgtacggcgtgttcggctacaaagtccacgccaaaatggcactggtcatccgccgcgaagacggcgtgctcaaacgttacgcccatctcggcacgggcaactaccaccaaggcacatcgcgcatctacaccgacttcggcctcattaccgccgacgaacaaatcaccgccgatgtgaacatattgtttatggaaatcacaggtttgggcaaacccgggcggctgaacaaactctaccaaagtccgtttaccctgcacaaaatggttatcgaccgcatcgcacgcgaaaccgaacacgcaaaagccggcaaaccggcgcggattaccgccaagatgaattcgctcatcgaaccgaccgtcatcgaagccctgtatcgggcaagcgcggcaggcgtacaaatcgatttgattgtgcgcggtatgtgcaccttgcgcccgggtgtaaaaggcttgtccgaaaacatccgcgtccgctccatcgtcggcaggcagctcgaacacgcgcgcgtgtattacttccataacaacggcacggacgatacctttatctccagcgcggattggatggggcgcaacttcttccgccgcatcgaaaccgccacgccgattaccgcgcccgaactcaaaaagcgcgttatacatgaaggactgaccatggcactggacgacaacacccacgcgtggctgatgcagcccgacggcggctatatccgcgccgcacctgccgagggcgaatccgaagccgacctgcaaaacgatttgtggacactgctcggaggctgacccgcaccgccccaatcaaaaaccatgccgtctgaaacctttccgtttcagacggcatggttttacagcaatctaaacagggcggaccggagtcaaaaacacaccttcgccattcctgcacaagcacttcccctatacgctcccaaccccaagccgccgcattccagacggcattatagtggattaaattttaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaagaagaaaatcatgccggacagcattgtttataccgatagtctgagcagctgcgacaagttggacgtgagcggttttatccattaccgcatcaaccattccaaggagtttgcagaccgtcagaaccacattaacggcattgagaatttttggaatcaggcaaaacgcgtcttgcgaaaattatagtggattaacaaaaatcaggacaaggcgacgaagccgcagacagtacaaatagtacgaaaccgattcacttggtgcttcagcaccttagagaatcgttctctttgagctaaggcgaggcaacgccgtactggtttttgttcatccactatacctttccgacagccgaacaaaaccccgaatccgtctgcacggttcggggtatatctccaatacgggcatcgtgttccggaaaaccgtcaaatccgcatcggcatcacaatatatttgaaattcggattgttcggcacggtaaacagcgtcgagcggttggcatcgccgaaggcaagctgcatatcgtcggaatggatgttgcgcaacacgtccatcagatagccgatattgaaaccgacttcgagttcgccgccctgataggcgatttcgatttcttcgcgcgcttcttcctgctcgttgttgctgcacacaacgctcaacaggccgggttgcaaaaacaatcgcgcaccgcggaatttttcattggcaagaatcgatgcacgttccaacgcgcccaacaattctgccctcgacaacacgaaaatcttgtcgttgtccaaaggaatcacgcggttgaaatcggggaatttgccgtcgatgaccttgctgacgatggtcgtgccgttgcattggaaacgcacctgtttgtccagcagctcgatttgaatcggatcgtcggggttgttcaacagtttgaacagttccagcaccgttttgcgcggcaaaatcacttcggcgcgcggcaaatccgcatcaatcgcgcaggctgcataggcaaggcggtgtccgtcggtcgccacaaggcgcaactggctgccctcaacctgcatcagcagaccgttgagataatagcggatgtcctgcaccgccatgctgtactgcacttgcgacagcatggttttgaaacgctcctgctccagcgagaaagtcgcgctgatgtcctcgccgacattcatcatcggaaaatcggcggcaggcagggtctgcagggcaaaacgcgatttgcccgccttcagcgtcagacggctgtcgtcccaatccagcgacaccagcgcaccggcaggcagcgcgcgcaaaatatcctgaaatttcttggcattggtggtgatgcggaagtcgcccgcgccgccctcgggacccgcagtgtcgatttggatttccaaatcggttgccaagagtttggtctgaccgccttttccctcaatcaggacgttggacaggatgggcagggtgtggcggcgttcgacgatgccggtaacggcttgcaacggcttgagcaggctgtcgcgctcggcttgtaaaatcaacatgttcgctcctttaaatcggtttgtatagtggattaaatttaaatcaggacaaggcgacgaagccgcagacggtacaaatagtacggaaccgattcacttggtgcttcagcaccttagagaatcgttctctttgagctaaggcgaggcaacgccgtactggtttaaagttaatccgctatatctttacccttcggacggcatgggcaatatcatgtcgtctgaaaacgttttccatcagttttgaatcagaatcagcagcttttcataatcctgagccaattccggatcttcttcgcgcagtttcgccactgccctgatgccgtgcataacggtcgtatggtcgcgcccaccaaacgaatcgccgatagacggcaggctcaaagtagtcagttctttggtcaggctcatcgccacctggcgcggacgggcaatgtttcgtgtccgtttcttaccgagcacatcgctgattttgatgcggtaatatttcgccaccgcatcgatgatgatgtcggcggtgatgactttgtgcttctcggcaataatgtcctgcaaagcggtacgcgccaaatcgatgtcgatgacgggacggttcataaagcggctgctcgctccgacacgattaaacgcgccttcaagctcgcgcacgttggaacggatcagattggcaatgaacagcgcggcttcgtcttcgatactgatgcccgccgcttccgcctttttctgcaaaatggcgatgcgcatttccaattcgggcggctcgagttccaaagtcagtccccatgaaaaacgggatttgaggcggtcgtccatgccttcgattttcgcaggcaacacatcgcaagtgaggatgagctgttttttctcgttgtggaaatggttgtacagatagaaaaactcttccatcgtacggtctttgcctttgatgaactggatgtcgtcgataatcagcaggtcgtattgcttgtattgctgcttgaacacgtcgtaagtgttgttgcgaaccgccttcataaagctgcggatatagtcatccgaatgcatatagcgcactttggcatcgggacggtttttcagcagctcgttgccgaccgcctgcacaaggtgggttttgcccaaacccgtgctgccatagaggaagaacgggttgtaactctgccccgggctttccgcaatcgcctgcgccgcagccgccgcaaggcggttgcccttaccttctaccaacgtatcaaacgtgtaatccggagacaggttggtctgctcgtaacgcgcctcttccgcatcgcgctgcacgtccgtccgtgctttggcaactgccaccgattccggccgggaagcagacccggcagcctgacgcggctcgtgcggcaggtttttcatacgttccgccaaaatatccgccgccgttttcgacgcagcgggtttgacaggctcttcagacggcagctcgtccaacagaacctcctgcacgggcattccctccgacaccgcatgcaaggacggctcggcaggttcgacagcaccttcaaccgccgccatctcataacgcacgccttctcccggtttgaatacgaaggcggaacggccggcagccaactcttccctcaccgcttctatttttccggcaaactggctcttgagcatattgcaggcaaactggttcttgccgtacaccacccatacgccaccctcctcaccaacggtaaggggcgcaatccattgcgcaaactgcccttgaggcaacatatcgtgaagacggcggaggcacagcggccaaaactctgctaatgtcatggataggctcgaatcggtaaaaatgaaatcgaaaacaaagaaaatataatattttcaaaaggaaaacaaatctgttgaacgcacatcggttcaaaacgcgactgcccgattataccgactcacgaatattttatccacaacccgtgcaaaaatttatccacagaaaggcggcggaaatccgcaggcaatcgggcaatcttcctgcaaagtttctatattgattgacaaaagcggcaaattggagtgtaattcacggtttaattatctacccattctattttaggaaacatcatgaaacgcacttatcaaccttccgttaccaaacgcaaacgcacccacggcttccctggtgcgctccaaaacgcgcggcggccgcgcagtattggccgcacgccgtgccaaaggccgcaaacgcctggcggtataattttggactaccgcttcggaaggcagtaccgcttgttgaaaacggatgatttttcatccgtttttgcattcagaaaccgccgcagccgcgacctgctgcaagtttcgcgctcaaacggcaacgggctgggccatccccgcatcggtctggtggtcggcaaaaaaaccgccaaacgcgccaacgaacgaaattatatgaagcgcgttatccgcgactggtttagattgaacaaaaaccggctgccgccgcaggatttcgtcgtgcgcgtccaccgtaaattcgacagggctaccgcaaaacaggcaagggcggaactggcacaactcatgttcggcaaccccgcaaccggatgcaggaaacaggcatgatcagaacggtactctgcaggcaaggttcagacggcaacgggtttcccatacaaggaacatcccgatgaacttcctattgtccaaactcctgctgggactgatacggttctaccaatattgcatcagcccgctgattccgccgcgctgccgttatacgccgacctgttcgcaatacgcggtcgaagcggtcaaaaaatacggcgcattcaaaggcggccggctcgccatcaagcgcattgcacgctgccaccctttcggcggacacggacacgaccccgttccctgacccgacgcaatattcaaattgcacgctttccttttatttcccatcggtttctatataatgccgtctgaagcttcgggcaggcggcacgaccgccgggtatgaagcccgcccttattccccgtctatcggaacacgcaacctgcggcatttccgaccattcakgaaactcttatggattttaaaagactcacggcgtttttcgccatcgcgctggtgattatgatcggctgggaaaagatgttccccactccgaagcccgtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaaatgccgcagcatgaaaaatgccgtctgaaacctgttcagacggcatttttattgcccaccccctatcggggcggaaatcttcaacccgcatacatcacaaaaatcgtcgggcgttttttcagattgggcatttcttttctttttcgccactgcacgattgtttgactgatgatttcctgtgtcggcaaggtcaaatccgtagccgtgcataaacgcgtttcaggatgcaggttttccaccgcatcggcaagcagcgcatcattgcggtaaggcgtttcaataaaaatctgcgtctcgccgcactggcgcgaacgctgttccaaagcccgaaaagcctgaatccgctcgtttttttcagacggcagatagcctttaaacgcaaaactctgcccgttcgcacccgaagccatcaaagccagcagcaggctggaaggcccgaccagcggacgcacttcaaaaccgtgtttatgcgccaatgccaccaaattcgcacccggatcggccacagccgggcaacccgcctcactgacaatgcccatactgcgcccttcttgcaaaggtttcagcaattccggcaaagtcttcaaatccgtatgttcattcaacgtttgcagattcagctcgcggataggcgtagtcacgcccaaatgtttcaaatgcgcacgcgccgttttttccgcctccacgacaaaatccgtcagcccgacaatcgcctgttgttcatgcggcaacaggcacggcgtgtcaggcgtacccaaaggcgtaggaatcaaatacaaaacaggagacatcattccctcactcatcggttaaaaatgccgtctgagcctttcagacggcataaacgggcagttacagaacctccacgccctcatttttcaagaaatcgaccagacggaaaaccggcaaaccgattaaagcattcggatcggtactctcaatcctttcaatcagcaatgcacccaaatcctcactcttcagcgcacacgaacaataaaccgcatcaggctcgcgctccaaatagcggaggatatgcaactcgtccaactgcctcatcacgaccaccgtcttatcgatatgccgccgcatcctgcccgtaaccgtattcaacagcacgatcgcgctgtaaaactcaatctccctgccgctcaagtgcatcagcatcttttgcgcattggcaaggttcatcggcttgccccactgcctgccgtcgcaccacgccacctggtccgcaccgacaatcaacgcctctgggaaacgcccggtcaacgaccgcgccttaccctcggcaaggcgcaatgccgtctgaggggcggattcccccaacatcggcgtttcgtcaaaatcgggggacgccgcctgaaaggcaatgccgagcctttccatctgttcgcggcggaaaaccgaactcgtacccaaaatcaaaggcagttccaaacccatcccatcctccttaccgttgaaaacacgcccgaaggggcagtaaaatccagccatgcgccgaaacacggatacccgccttcggcgtaccgcaacatttttcttaaaaatattgacgttagaacatctaaattatatcatatcccgtttatgtcagaccctaatttgattgacttggaaatttttgccgccgaagggcagaacctgcaaggcagttttctgctggaagaattggatgaacgcgtcagttcgcacgattatcccgccgacaggcagaccaaaatatcgtttacactgaccggcggtcgcgaccggctgcaacgcctgttcctcgacctgaacgtcaaagccgatatgcccctgatttgccagagatgtatcaaacccatgccgttcatgcttgatgaaagcagccgtatcgtcctgttttccaacgaagagtccttggacgaatccatgcttgccgacgaagaactcgaaggcatactgattgaaaaagaactcgacgtgcgcacattggtagaagaccaaatcctgatgtccctgcccttttcgccgcgacacgaagactgcggcgacaatgggacactggaagaagtcaatcgggacaaacccaacccctttgctgttttggcaggtttgaaaagcaattgattaggacacagtttatttatctaggagcttgaaatggccgttcaacaaaacaaaaaatccccttccaaacgcggtatgcaccgttcgcacgacgcgctgaccgcgcctgcactgtctgtcgacagcacaaccggcgaagtacaccgcccgcaccacatctcccccaacggtatgtaccgcggccgcaaagtggtcaaagccaaaggcgaataatccctattcgactgactgaaaaagccagaacattgccatgcaattactggctttttttgcattggacgcaccatccgtccaaactttcgccatacgtcaacacacaggggcaaagcgttccgtataataccccgtgaaaatattccaaaagccccaaccaccaaggaaattccgatgaaacagaaaatctggtacacctacgatgacatccaccgcgtcatcaaagcattggcagaaaaaatccggaacgccgacatcaaatacgatgccatgattgccatcggcggcggcggctttattccggcacgtatgctgcgctgttttctggaaattccgatttatgccgtaaccaccgcctattacgacagcgacaacgaaggacaggttaccgaagaagtcaaaaaagtccaatggctcgaccccgttcccgaagccctgcggggcaaaaacgtactcgtcgtcgatgaagtggacgacagccgcgtaaccatggagttctgcctgaaagaactgctcaaggaagacttcggtacgatcggagtcgccgtactgcacgaaaaaatcaaagccaaagcaggcaaaatccccgaaggcattccctatttcagcggcatcaccgtagaagactggtggatcaactatccgtgggacgcactcgacatcgacgaacacaaccgccttgccgaggccggccgaggctgaccctttcagacggcatattttccgaaccgatgccgtctgaagcccgcacgacccctgccgcagaccgaaaacctaccggagaaaccctatgattacattggccgtagatgccatgggcggcgaccaaggacttgccgttaccgtacccggcgcaaccgcattcctccaagcacaccccgatgtccgcctgattatgaccggcgacgaaacgcaactgcgccaagccctgaccgcggcaggcgcaccgatggaacgcatcgacatctgccataccacccaagtcgtcggcatggacgaagccccgcaatccgccctgaaaaacaaaaaagactcctccatgcgcgtcgccatcaaccaggttaaagaaggcaaagcccaagccgccgtatccgcaggcaacacgggtgcgctcatggcaaccgcacgtttcgtcctcaaaaccattcccggcatcgaacgccccgccatcgccaaattccttccttccgacaccgaccacgttacccttgcactcgaccttggcgcgaacgtcgactgcacgtccgaacagctcgcccaatttgccgttatcggcagcgaactcgtccacgcactccatcctcaaaaaggacagccgcgcgtcgggctggtcaacgtcggcacggaagacatcaaaggtacggacaccgtcaaacaaacctacaaactgctgcaaaacagcaaactcaactttatcggcaacatcgaaagcaacggcatcctctacggcgaagcagatgtcgtcgtcgccgacggctttgtcggcaacgtcatgctcaaaaccatcgaaggcgcggtcaaattcatgagcggagccatccgccgcgaattccaaagcaacctgttcaacaaacttgccgccgttgccgccctacccgccctcaaagggctgaaaaacaaactcgacccgcgcaaattcaacggggccatcctgctcgggctgcgcggcatcgtgattaaaagccacggcggcacagacgaaaccggtttccgctatgccctcgaagaagcctaccacgaagccaagtccgccggcctttccaaaatcgaacagggcgtagccgaacaactcgccgcactcgaaactgccaaagccgtccaaaacgaaaatgtcggcggtctgtaacacacacgatgccgtctgaacgcccccgcccctttcagacggcatccgcccgcaccaaacctgcgggcgcggacggcgatgcgcctgtccggcacttcccaaatatcgccttgtaaaataaggagtatttgaaaaatgaagacattagaaaaacggatgaaagctctagacaaacggattatgaagttcggaaaatcccttgaaggcaggcttgatgcccgtctgattgaatccgcattggattatattcattattcggaacgttttttggcttttgaaatcctgtgtacttatatcgaagatttcgatgtccggctgacggaacaagaatcccgggaaatttcttttatcaacaaggaatttgagatagaaagcacgtccgattaaccaataaagccaatgggttgataaacatgaaaacatcgacggtcgtttttggcggattttttatggcagacaacggagagcgaatccaaatccccgttttggaaaatcctgacattagggaaatcaatcactttttttccgtatcaaattttgagaaaaaaaccggcgtccttgttttcagaatcatccccgagccggaatttggcaataccgaattaactgtctattttaaaaaaggatattatagtggattaacaaaaaccagtacggcgttgcctcgccttgccgtactggtttttgttaatccactatatcagacgaaaacaaacacccgcgccaatagcctgacggcaacccggcaatcaaaatgccgtctgaagcagcttgggctttcagacggcatttccttcgcttaaaacagcgtatcggcaaccccgccctgcctgtccacggcaatctgcatctgaaaaccatctgtatcccaaaccacacccccatccctgtttccatcatgtgcaccctgtccgtattgggcaatcatctgtttttcgcttacaatagccgaatctgaaccaactctctaaaaaggccgttcccatgcagtatgcaaaaatttccggcacaggcagctatcttcccgccaaccgcgtcagcaatgacgaccttgcccaaaaggtagatacctctgacgagtggattaccgcgcgcacgggcatcaaattccgccatattgcagccgaaaacgaaaaaaccagcgatcttgccgccgaagcggcgcaccgcgcgctggatgcagccggattagacagcggcgaaatcgatttgattatcgtggcaacggcaacgccggatatgcagtttccgtctactgcgaccatcgtgcaacaaaaattgggcatcaccaacggctgccccgcgtttgacgtacaggcggtgtgcgccggctttatgtacgcgctgaccacggcaaacgcctacattaaaagcggtatggcgaaaaacgcgctggtcatcggcgcggaaaccttcagccgcattgtagactggaacgaccgcacaacctgcgtattgttcggcgacggcgcgggcgcggtggttttaagcgcgtcggacacgccgggcatcatccacagcaaactcaaggccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgctcaaatcgactggattgttccccatcaggcaaaccgccgcattatcgaatcgaccgcgaaacatttaggtttgagtatggacaaagtcgtcctgaccgtccaagaccacggcaacacatccgccgcatcgattccgctggctttggatacgggcatccgcagcggacaaatcaaacgcggtcaaaacctgctgctcgaaggcatcggcggcggtttcgcgtggggcgcggtgctgttgcaatattgaacccgatgccgtctgaaacaggctttcagacggcatttcccatatcatgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctgattatccaaccaaacaaaggaatactatgtcttttgccttcttttttcccggacaaggttcccaaagcctcggtatgatgaacggctttgccgaacacgccatcgtcaaaaacacctttgccgaagcctccgccatattggggcaggacttgtgggcgatgataaacggcagcgatgccgaaatcatcggtcaaaccgtcaacacccagcccattatgctcgccgccggcgttgccgtttaccgcgcctatttagaagcgggcggcaaaacgcctgccgccgttgccggacacagcctcggcgaatacaccgcactcgttgccgccggcgcattgaattttgccgacgcggtcaaactcgtgcgcctgcgcgccgaactgatgcagtccgccgtaccgcaaggcgtgggcgcaatggcggcgattctcggcttggaagatgagcaggttaaagccatttgtgccgaagccgcccaaagcgaagtggtcgaagccgtcaacttcaactcacccggacaaatcgtgattgcaggcaacgccgccgccgtcggacgcgccatggctgccgccaaagaagccggtgccaaacgcgccctgccgctgcccgtgtccgtaccttcccattgcagcctgatgaaacccgccgccgacaaacttgccgaagccctgaaaaccgttgaaatcaagcagccgcaaatccgcgttatccacaacgccgacgttgccgcctacgatgatgccgacaaaatcaaagacgcgctcgtccgccagctttacagccccgtacgctggacggaaaccgtcaacgccctcgtttcagacggcattgccgaatccgccgaatgcggcccgggcaaagtgttggcgggcttggcaaaacgcatcaacaaagccgccgcgtgcagcgcactgaccgatgccggacaggttgccgcctttatcgaagcgcactgacttcgttctgcaaaaagcagcctgccctcttcaggctgcttttcatgtccgaacgacggcagccccatatttacgctataatccatcccgaccaaaccaccgacagcggctgccgttgcagttcccgccctaccgatatgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctaccttgccgccttcatcgcccccctgattaaccacggcttttccgcacctgccgcgccgcccgagctgtctgccgccgccggcatcatttccaccctgcaaaactggcgcgaacagtttacctatatggtttgggggacggaaaacaaaatctggaccgtcccgctcttcctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgatcgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggtgtatgtgcatttctcgacaccccgcccgaacaggacaagggcacgctcgcaccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaacctgctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgttcgccctccaaaccgccaacctgcaaagcctgattgacagctccccgctcggactgcaccagcccatcggatcgaacggcagcaacttatccggcggacagcggcaacgcgtcgccattgcccgcgccattttgaaagacgcgccgatattattattggacgaagccaccagcgcattagacaacgaatccgaacgcctcgtccaacaggcgctcgaacgcctgatggaaaaccgcaccggcatcatcgtcgcccaccgcctgaccaccatcgaaggggccgaccgcatcatcgtgatggacgacggcaaaatcatcgaacaaggcacacacgaacaactgatgtcccaaaacggttactacacgatgttacgcaatatctcaaacaaagatgccgccgtccggacggcataaacaaaatgccgtccgaaatggtacaatcgccccgaccctttcagacggcatcatatccgccgacccatccgattatcttcaatcactgtaaaacccattatgacccaagacaaaatcctcatccttgacttcggttcgcaagttacccagctcatcgcccgccgcgtgcgcgaagcccacgtttactgcgagctgcattctttcgatatgcctttggacgaaatcaaagccttcaaccccaaaggcatcatcctctccggcggccccaattccgtttacgaatccgactatcaagccgataccggtatttttgatttgggcattccggttttgggcatctgttacggcatgcagtttatggcgcaccacttgggcggcgaagtgcagcccggcaaccagcgcgaattcggttatgcgcaagttaaaaccatagacagcgagctgacacgcggcattcaagatggtgagccaaacacactcgacgtatggatgagccacggcgacaaagtgtccaaactgcccgacggtttcgccgtcatcggcaacaccccgtcctgcccgattgccatgatggaaaacgccgaaaaacaattctacggcatccagttccaccccgaagttacccacaccaaacaaggccgcgccctgttgaaccgctttgtcttggatatttgcggcgcacaaccgggctggacgatgccgaactacatcgaagaagccgttgccaaaatccgcgaacaggtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaagcaaaatggtgatggatatgttcgcccgcaacttgggtgtgaaagtgatacacgtcgatgccgaagggcagtttatggcgaaactcgccggcgtaaccgaccccgagaaaaaacgcaaaatcatcggtgcggaatttatcgaagtatttgatgccgaagaaaaaaaacttaccaacgccaaatggttggcacaaggcacgatttaccctgacgtaatcgaatccgcaggtgcaaaaaccaaaaaagcccacgccatcaaatcgcaccacaacgtcggcggcctgcctgaaaacatgaagctcaaattgcttgagcctttgcgcgatttgttcaaagacgaagtacgcgaattgggtgtggctttgggcctgccgcgcgaaatggtgtaccgtcatccgttcccgggtccgggtttgggcgtgcgtattttgggcgaagtgaaaaaagaatatgccgacctgcttcgtcaggcagacgatattttcattcaagaattgcgcaatactaccgatgaaaacggtacatcttggtacgacctgaccagccaggcattcgccgtgttcctgcccgtcaaatctgtcggcgtaatgggcgacggccgcacatacgattacgtcattgccttgcgtgccgtgattaccagcgactttatgaccgcgcattgggcggaactgccgtattccttgttgggcaaagtgtccaaccgcatcatcaacgaagtcaaaggcatcaaccgcgtggtttatgatgtgagcggcaaaccgcctgccaccatcgagtgggaataaacagcaaacatggctgccccgtccggcgcagtccttcgattatcggaaaaaaggaaaaaatatgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaacagacaactttttcaaccatgccgtctgaagccctttcagacggcatttgcattctcaggcaaaatgaacacacaccacaccccgccctgcccatgcggctcaggcacaagctgagacctttgcaaaattcctttccctcccgacagccgaaaccccaacacaggttttcagctgttttcagctgttttcgccccaaataccgcctaattctacccaaatacccccttaatcctccccggacacctgataatcaggcatccgggtcaccttttaggcggcagcgggcgcacttagcctgttggcggctttcaaaaggttcaaacacatcgccttcagatggctttgcgcactcactttaatcagtccgaaataggctgcccgggcgtagcggaatttatggtgcagcgtaccgaagctctgttcgaccacatatagtggattaacaaaaaccagtacggcgttgcctcgccttagctcaaagagaacgattctctaaggtgctgaagcaccgagtgaatcggttccgtactatttgtactgtcttcggcttcgtcgccttgtcctgatttttgttaatccactatacatcatcgctactaccgttccggcgcaacaggcattcctcgatgccgccgaactgatgcaatggagtatagaaaccgaagggctgggcttgaacgtcatctcgcacaagatactcggcaaagaccacgcccaagtcgaatttgaagcctacttccgagacggacaacaccgatccgcgcatcacgaactgtccggcttcgtcaacatcggcggacaatggtattttatcgatcccaccgttccgcatcctgcgatgaaacaaccctgcatttgcggatcaggcaaaaaattcaaagcctgctgcggcaaatatctgaaacctgtcgcataaaaatgccgtctgaacgttcagacggcattttcaacgtgcaaaaaaaaccattcataccaagggtaagtatgaatggtcaatacattgcgggaaaacgtcttacttgctgcactgccgaaaagggagaaacggcagcggtaatcagcggaaaggattgtacccgaattaatattaagaaacgttaatcgcgaaaatatattaacaaacctgttgaaacctattggttttcccgtatccacccgacccagcgttcaaacagcttcggttcgagcgcggcaacgaccgagcgtttgaacacgtgttcaccactccaaaacccgtcgccttccaaagtcgtcagcctgccgcccgcctcctcgaaaatcaacgcgccggcggcataatcccacagcttctgcccgccgtgaacataaacatcataacgcccgcacgccagataacaccaatccaacgtactgctgcccatactccgtatcgttccaaaaggcgcgagcgtactcatacggctggaaagtttgcccgaacgcagatatttgatttccacgcccgcaatcgcctcattgagttttttatccacgaggcgcaggggcagacgcgtcccgtttaaaaacgccccctgcccgcgttcggcataaaaacattcgccgctgactgggttgtagattacgcccaactcggcgcgcccgttgcggacaaacgccaccgataccgcaaaatgcggcagcccgttgacaaaattgttcgtcccgtctatcggatcgacaatccacagccccttttcccccgaatattgttcccacaaagccgactgttcctgccgcgacatttcctcacccaacatcggactgtcgattaaaagcggcaacgcggcggcaaaagccgtctgcgcggcaatgtccgcctcgctcaacatcgaaccgtcttccttgcggtgagacggcgtattcaaaaaacgcggcataatttcggtttgcgcgatatggcgcacgactttctgcaaacggtgtaacacttcctactgtcctcatattttgaacttgcggcgcgcgaacgtataatgtccgcttccatcacgccgctgcgacggattataaccgtccgaaccgccaaaaactatgccccgattccacctgcccgaaaacctttccgtcggacaaaccgtcgccctgcccgacaacatcgtccgccacctcaacgtcctgcgcgtccgccccaacgaaaacatcaccctcttcgacggcaaaggcaaggcacacgccgcacggctgaccgttttggaaaaacgccgcgccgaagccgaaatcctgcacgaagacacaaccgacaacgagtccccgctcaacatcacactgatacaatccatctcctccggcgatcgcatggatttcaccctgcaaaaaagcgtcgaactcggcgtaaccgccatacagcccgtcatcagcgaacgctgcatcgtccgcctcgatggggaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaagcaccaagctgattatgagcatcaaccgcgcccgcaaactcggcgacatacgccaaccgtccggcgcaatcgtctttatggtcgggcccgaaggcggctggacagaacaggaagaacaacaggcatttgaagctggctttcaggcggttacactcggcaaacggattttacgcacagaaaccgccccactcgccgccctcgccgccatgcagacgctttggggcgatttcgcataaacagaaatgccgtctgaaacccgttcagacggcattttgcagccgattaagatagtaggttcaaataagatttcccgtgtcgtcattcccgcgaaagcgggaatctagaaacgaaaaactacagagatttatccgaaacaacaaccctctccgccgtcattcccgcaaaagcgggaatctagaaacgaaaaactacagggatttatccgaaacaacaaaccctctccgccgtcattcccgcgcaggcgggaatctagaaacgaaaaactacagggatttatccgaaacaacaaaccctctccgccgtcattcccgcgcaggcgggaatctagaaatttaacgttgcggtgatttatcggaaatgactgaaactcaacggactggattcccgcctgcgcgggaatgacgagattttaggtttctgtttttggttttctgttctcgcgggaataacggaattttaagttttaggaatttgtcggaaaaacagaaatccccccgccgtcattcccgcaaaagcgggaatctagaaacgaaaaactacagggatttatccgaaacaacaaaccctctccgccgtcattcccgcgaaagcgggaatctagaaatttaacgttgcggtgatttatcggaaatgactgaaactcaacggactggattcccgcctgcgcgggaatgacgaattttaggtttctgtttttggttttctgttctcgcgggaataacggaattttaagttttaggaatttatcggaaaaacagaaatccccccgccgtcattcccgcgaaagcgggaatctagaaatttaacgttgcggtgatttatcggaaatgactgaaactcaacggactggattcccgcctgcgcgggaatgacgaattttaggttgctgttttttggttttctgtttttgcgggaatgacgaattttaggtttctgtttttggttttctgttctcgcgggaataacggaattttaagttttaggaatttgtcggaaaaacagaaatccccccaccgtcattcccgcaaaagcgggaatctagaaatttaacgttgcggtgatttatcggaaatgactgaaactcaacggactggattcccgcctgcgcgggaatgacgaagtggaagttacccgaaacttaaaacaagcgaaaccgaacggactagattcccgcctgcgcgggaatgacagtgtatccatttctaattttaatccgctatattttacacaaactatttgaacgatatgacccgcctgccgtaagctttctcaagctccgcctgcctttgacgctccattcttttcttcttttccctaccgaatttacccaaagcacgcttcaagtcaaacatcaccttcaacgaacggcggtgtcttctttcttgttccctatctttttccaaatcgctacccaacatactgtttttactgaggaacttggcataatgcaattcttgggtacataaggcgggattaacctgataaacaggcatcccctccttatcaaagaaataagtaaacatcatccaatctaccgctttaatccactctgccggcaaaacggcaaacctttccaagaaaaaccgcatcgcctcacgcgaaatgatatagccagccgtcccccaatgttcgctctccagcaaaggaaatgaccgattctcataattcaggactttatccggtctgacaataactttcgcaaacatcgtttccaaacgaacgataaaggcagaatccttatcaaaacgctcttccaaccaagtatcttcggcaaggaacttttctgcgtctttgccaagcaggacatcatcctcaaatacggcaacatagggcagaccttcatccaatgcctgtttccacaatacggcgtggctcataaagcaggctttttccacttcgctcaacaggtgctgttttgccaatcccggcaccaattccgccatcatccgattcagttcttcagacggcatcagtgcgtcgaaaaactgaaacgggatgccgcgcacgccgaaggttgcggcaatgtgcgccctgcgttctgcggcggaagctaagctgataacatggttttgcataatttatcctgttttttgtctgttggataaagcggcgtttttcaacggtttttcagcaatcggcgcaaaatgccgaagtattgcctcaaggtaaacagccgccgcatcctgccgtctgctgcaaatacgatgtccatctctcctccttttattggaaaggcacaatgaactgttcgcgcctttgccggcgtttttccctttccctgctgattttggtcaaggcgcggatcaggcggtgtttgaatgtgttggcgggggaatcgcgcctttgctgtttgcggttcaggaggcggtcgtgttcgatcaggctgcccaatgcgctgttttggtcgtgaaacttggcataatgcagctcttgggcgcacaaggcgggattgagctggcaaaccggcattccttccctgtcgaaaaaatcgctgaacatcatcagatcgacggggtgcagcccttcgggcggcagggcggcaaacctgtccaggaaaaaccgcatcgcttttcgggaaatgatatagcccgccgtcccccagtgttcgctttccaacagcggaaaggcgcgcccgcagtaatccgccacgccggagggcgaggtcaggacgtgcataaacatcgtttccaagcggacgataaaggcggtatccgggtcaaagcgttcttgcagccaagcgtcttcggcaaggaatttttccgcaccttcgccgagtaaaacgtcgtcctcaaatacggtgatatacggcagaccttcgtccaatgcctgcttccacaatacggcgtggctcataaagcaggctttttccactccgctcaaataggggtgcgccgacaagccggggacgagttccgccattgcctgttccagcctttcagacggcatcagtgcgtcgaaaaactgaaacgggatgccgtgcctgccgaaggtatcggcaatgtgcgccctgcgttctgcggcggaagctaagctgataacgtggttttgcataatttatcctgttttttgtctgttggataaagcggcgtttttcaacggtttttcagcaatcggtgcaaaatgccgaagtattgcctcaaggtaaacagccgccgcatcctgccgtctgccgcaaaatccagccacgcgccggcgggcagcgtgtccgtccgtttgaagcattggtacaaaaaccggcgggcgcgttcaaaatcttcttccggcaaatgtttctccagcaattcatacgctactgcttttatttggcggtattcaaggctgtcgaaccgggttttaaaacccatagactgcaaaaaatcgtttctggcggttttttggatgccttgcgcgatttcgtgttggcggatgctgtatttggatgaaacctgattggcgtgaaggcggtatttgaccaaggcttcgggataataagccagcctgcccaatttgctgacatcgtaccaaaattggtaatcttccgcccaatcccgctcggtgttgtaacgcaaaccgccgtcaatgacgctgcgcctcataatcatcgtgttgttgtgtatggggttgccgaaagggaaaaagtcggcaatgtcttcgtgtcgggtcggttttttccaaattttgccgtgttcgtggtgccgcgccagccggttgccgtccttttcttccgacaaaacttccagccacgcacccatcgcgatgatgctgcggtctttttccatctcacccacgattttctcaatccagtcgggggcggcaatatcgtctgcatcggtgcgcgcaatatattccccccccccccccgactttgccaattcatccagcccgatgtttaaagagggaatcagaccggaattgcgcggctgcgcgaggatgcggatgcggccgtcctgttcttggaaacgctgggcaatggcaagcgtaccgtccgtcgagccgtcatcgacaatcaaaatatccaagttgcgccaagtttgattcacgacggcggctaatgattgggcgaaatatttttctacgttgtaggcgcaaatcaatacgctgactaaaggctgcaatttattctcccgataggcacgatgccgtctgaaggcttcagacggcatttggactgtacaacggttactcgcccaaaagcgcgatatccgctaccgcgttcatttgttctgccaagcggttcagcaggttcaggcggttttgtttcacggcggcatcttccgccatcaccatcacgccgtcgaagaaggcatcgacttgcggtttgacggaagccagttcggacaaggcggtctggaaattgccttcggcaacggcggcggcaattttcggctgcaagccttgtgcggcggcaaagagggctttttcttcgtcctgttgcagcaagctttcgttaaccgcgcccaactcggcatcggcttttttcagcaggttttgcacgcgtttgttggcagcggcgagcgcggcggcttcgggcagttgtttgaacgcggcgacagcctgcagtttggcggtcaaatcgtccaaacggcgcggctgcttggcaagtacggcggcaacgatgtcttgcggataatcgttttgcagcaatacggcaaggcgcgcctgcatgaagtcggcggtttcagacggcgttttttcgttgagcaaaccttgcgggaagctgttgaaggccgtctgaatcagttcgtttacgtccaaaccgtactgcatcagcatacgcaaaatacccaatgcggcgcggcgcagggcgtatgggtctttgtcgccggtcggaatcaggccgataccccaaatgccgaccaaggtttccagtttgtcggcaagcgcaacggcggcggcaattttgccctcaggcaggttgtcgccggcaaaacgcggttggtagtgttgctcgacggcttcggtaatttcttcggtttcgccgtccaagcgggcgtagtatttgcccatcgtgccttgcagttcggggaactcgccgaccatttcggttactaagtcggcttttgccaaacgcgcggcgcgttcggctgcggcggcatccgcgcccaaagccttggcgatatgggcggcgatgctttgcaggcgttcgatgcgttcggcttgcgaaccgattttgttgtgataaaccacgttcgtcagtttgggcaggcggctttccaaagtcgctttttggtcttgtttgtagaagaactcggcatcagacaggcgcgcgcgcaagacacgttcattgccttggatgatgtgtgacggatcttcggtttgcagattggacaccagcaggaagcggttcatcagcttgccgttttggtcgagcagcgggaagtatttttggttttgctgcatcgtcagaatcaggcattcttgcggtacggcgaggaagtgttcttcaaaaccggcttccaataccacaggccattcgaccagcgcggttacttcgtccaacaaggcttcatcggcggcggcggtcgcgttcagacggcgtgcctgcccttccaataccgtctgaatcgcggctttgcgctcggcaaacgaagcgacgactttgccttgctcgcgcatttgtgcggcgtagctgtcggcgttttcaatggtaatttcgccgtcggagaggaagcggtgtcccaaggttttgttgccgctttgcagacccaaaacgctgacgttcacaatgtcgccgccgtgcagtacaactagcccgtgaacggggcgcacaaaggtaaacgtgctgctgccccaacgcattactttgggaatcggcagcttcttaaccgcttgattgataatgtcttccaaaagtccgcccaacggtttgccgatttggacgtattcgtaggcgtacacgtcctgcttgccgtcgtggacgatggtcaagtcttcgattttcgcgcccgcaccgcgtgcgaaaccttccaaagccttggttggcgcaccgtctttcatggcattcgctacggcagggccttttttcacaattttttgatcagcctgaacggctttgacgtttttgacttgaaccgccaaacggcgcggcgaggcataagccgtaaattcggctgcgccgtcaaccagttgcgctttttccaagccttcggcaacggaagcggcgaaatggttgcccagattattcagggctttgggcgggagttcttcggtaaggagttcgattaaaagggtttgggtcatcattcggctttctttgaatttggttaatctgcctgtttataggtttcgctgtaattttcccagccgtcatccccataaaaaccgtcaaccagcggggtggcgtacaaagtggcaacatcttcgcggtctgccagccaagagataatggcttttttctcggtttctcccaagcttcgggcaccggatttttgaaacaggcacgaaaaatcgccgcaatcgcccccccgccatttcaaagccgtttgccgcaagatacgcaatcagctcgtccataaagcggtcgaacgcttcggcatcgtcctcagcttggtgcaaactgccttgaacgccgaaaatcaatgtttgaaactcgcccaaatgcagctttttatgctggcggcggttcattttgtgcaggcgtttcctgcttggggtgcggaaatagacaggcatgattttcctaaaaaatataatggcttccggacggctgccttatcgtgccgcccgaacgtaaaaaatcgtcgcccccttaggcggcgtttgccttcattaaagggaagcccagtttttcgcggctttcaacatatttttgcgccacggcgcggctcaatgcacgaatacgtccaatataagttgcccgctcagttacggaaatcgcgccgcgtgcgtctaaaaggttgaacgtatgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatgattcgataaaataaagggtttattttactgtttccattgctgtttggataggtttatctcaaagacagactgatttgaaaacacggcatacatgatatagtggattaaatttaaaccagtacagcgttgcctcgccttagctcaaagagaacgattctctaaggtgctcaagcaccaagtgaatcggttccgtactatttgtactgtctgcggcttcgtcgccttgtcctgatttttgttaatccgctatatgtttcggttaggcggcaggctgccctattgaataccttaaagcaggctatgcctgccaacgccatatccaaacacagtctttaatttaaatccggaaaataaaaagcacgaccaaacggtcgtgcttttccaaaccaaacaagtttatttcttgtgcgaacggatatagtccaaagttttgagctgtgcaatcgcagcagccaatactttatgcgcttccgccaaagccttatcgtctttagcttgggaaatgcccgcttctgcggcttttttcgcctcttccgcacgtgcccgatccatctccgcactgcggacggcaacatccgccaagacagttactttatcaggctgtacttccaaaacaccgccggaaacagcaaccaaaacctctttatcctcgcccggaacggtcaaacgcaaagcccccggccgcaccaaactcataatcggctcgtgtcgcggataaataccgagttcgccctgtacagtcggaacaacgataaatgttgcctcgcctgaatagattttctgctcgctacttaccacctcaacttgcatgatgctcatgccgacctccttagtttaaggttttcgctttctctactgcttcttcaatgctgccgaccatatagaatgcctgctcgggcagatgatcgtattcgccgttcaagatggctttgaagccggcaatggtatcgcgcagggcgacatatttacccggagaacctgtaaacacttcggcaacgtggaacggttgggacaggaagcgttggattttacgcgcacgcattacggtcagtttgtcttcatcagacaattcgtccatacccaagatggcgatgatgtcgcgcaattctttgtatttttgcagggtggactgcacaccgcgcgccacgtcgtagtgctcttgacccaataccatcggatccagttggcgcgaagtagaatcaagcggatcgactgccgggtaaatacccaaagaggcaatatcgcggctcaatacgacggttgcgtccaagtgggcgaacgttgttgccggagacgggtcggtcaagtcgtccgcaggtacatatacggcttggatggaagtaatagaaccggtttgggtagaggtaatacgctcctgcaaacgacccatttcttctgccaatgtcggttggtagcccactgcagacggcatacgacccaacaatgcggatacttcggtaccagccagggtgtaacggtagatgttgtccacgaagaacaatacgtcgcggcctttgccgttttcgtctttttcgtcacggaagtattccgccatggtcaaaccggtcaatgcgacgcgcaaacggttgcccggaggttcgttcatctgaccgtaaaccattgccactttatccaatacgttggaatctttcatctcgtggtagaagtcgttaccttcgcgggtacgctcacccacgcctgcgaacacggacaagccgctgtgcgctttggcgatgttgttgatcaattccatcatgttcacggttttacccacaccggcaccgccgaacagacctactttaccgcctttggcaaacggacacagcaagtcaatcactttaatgcccgtttcgagcaattcggttgtggaagacagttcgtcaaacttaggggcagcttggtggatggcacggctcttgtcggtatcgatcggacctgcttcgtcaacaggcgttcccaatacatcgacaatgcgtcccaacgtacctttacctaccggcacagtaatgggcgcaccggtattgctcacagtcatgccgcgtttcaaaccgtccgagctgcccatcgcaatggcacggactacgccgtcgcccaaaagctgttggacttccaaagtcagaccgttttcgtctaatttcaaagcgtcgtaaacgcgcggaatcatgtcgcgtggaaattccacgtcaacaaccgcaccgataatttgtacgattttgccttggctcattatcgtatcctaatttccgtacaggattcagacggcatcagacagccgccgcacctgctacaatttctgacaattccgtggtaatcgcagcttgacgcgatttgttatataccaaacgcaactctttgatggcattgcctgcattgtctgttgcagctttcatggcaaccatgcgggctgcctgttcggatgccatattgtcgctcaacgcctgataaaccacagactctaaatagcggcgaaccagatattccaacactgcaagtgcagtcggttcgtagcggtattcccagctgaacggtgatttgggagctgaatcgccaatcacgttctcaccgataggcagcaatacttccattctcggttcttgacgcatggtattgacaaaacccgaatacaccagatggattctgtcaatttcatgtttctcataccgttggaagagttctgtcaaaggtccgagcagcatttccatttttggggtatcgcccaaatttacggcactggcaaccacattcagaccaatgctctgacacgccatcagacctttactgccaaagcatacgatttcctcttcaataccttgattccgatactcttgaacttgtgccaaaaactttttcagcacgttggcgttcaaaccgccacacaaacccttatcagacgtaatcaaaataaaaccgacacgtctgatttcccgatgagattccagtaacggaataccatgatcggtattggtttgcgcaagatggctcatcaccatacgcactttttcggcatacggacgcgccaaacgcatccgttcctgagtcttccgcattttagaggttgacaccatctgcatcgctttagtgatcttttgggtattctgaacactgcggattttggtgagaatctcttttcctactgccatttcagactcctttcacttcaagccttatgcctgataggcgtaagaagatttgaaggatttcatggctgcttcaagcgttttctcgctctcgtcggacattgcacctgaagcattgacggcttccaaaacttccggatgttgggtacggacaaagctcaaaaattcagattcaaaagccagagctttggcaaccggaacatcagaatacgaaccgttgttgattgcccaaagggtcaaagccatttcagccgtattcaacgtactgaactgtttctgtttcatcagttcggttacgacttcgccatgctccaattgtttgcgcgtagcttcatccaaatcggatgcaaattgcgagaacgccgccaattcacgatattgtgccaacgccaaacggataccgccacccagctttttaatcactttggtttgtgcagcaccgcctacgcgggatacggaaataccggcattgattgcaggacggataccggcgttgaagaggtcggtttccaagaaaatctgaccgtcggtaatcgaaatgacgttagtcggaacgaaagcagatacgtcgcccgcttgggtttcgataatcggcaacgcggtcagagaaccggttttgccttttacttcgccgttggtcaatttctccacttcgtgttcattgacacgtgccgcacgttccaacagacgggagtgcaggtagaacacatcgccgggataggcttcgcggccgggcggacggcgcaaaagcagggaaatttgacggtaagccacagcctgtttggacaaatcgtcataaacaatcaaggcatcttcgccacgatcgcggaagaattcacccatcgtacaaccggagtaaggtgcgatatattgcaatgccgccgcttcagatgcagttgcagcaaccacgatggtatgctccatcgcgccatgctcttccaatttgcggaccacgttggcaatagaagatgctttttgaccgatagcgacatagatacagataacacccgtacctttttggttgacgatggcatccaatgctacggccgttttacctgtctgacggtcgccaataatcaactcacgctgaccgcgaccgacaggaaccatagagtcaatcgccttcagaccggtttgcatcggctggtcaaccgatttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatgataaggtcaagtcttgatattgagcatatacttccggcaatatcgacaaacgtttctgcccggccaagacgataacaaagtttttcaactccttgtctttcaaaccgaccaaatcgatgaggatatctgctttttctgaagcattcgtttcaggacggtcaatcaatgaagccaccttcccttcctgaacaaccgccgcaagtttttccagtccgcccaaccaagactcaatttggtttttttcctgagccagaccgaacaatgcctttgcataaggtctggcaatcgttgcgaactctgccataagattacagctcctgtttcagggtatcgagcagttttgcgtgtttggaagcatcgacttcgctgcgcaaaatagattcggcacctttgacagccaacacggcaacctgctcgcgcagggattcgcgtgcgcggaacaattcctgctccacatcggcctttgcctgagctgcaatgcgcgccgcctcggaagaagcctgttctttggcttcttcgacaattttggcggcacgtttttcggcgttggcaaccatttcggaaacctgattacgcccttctgccaagagttctgcaacctttttttcagcctgctcaaaatcgcttttaccacgctcggcggcagccaagccttcggcgacttttgcggcacgctcatccaaagcttttgcaatcggcggccacacgaatttcatggtaaaccataccaaaccgaaaaagacgatgatttgagcgaataatgttgcattgatattcacgttacttaaccttcgtactggggttaatcaaacaggctgcgcctgtacggaacggacgaatccgtcctgattatgcacctgcaaacgggttaacgaaggcgaacagcagtgcaatggcgacaccaatcaagaatgcggcatcaatcaaaccggcaatcaggaacagtttggtttgcagcggaccgatcagttcgggctgacgggcagaagactccaaatatttagaaccgaccattgcgataccgatagaggcacccaatgcacccaatgcaacgatcaaaccacatgcgatagcaatcaaacccattttaaactccttaaagaaacaaaggttaaactacaaaaacaaactacttaggaaaatcagtgcgcatcatgtgcctgtccgatatagacgaacgccaacgccatgaaaataaacgcctgcagggtaatcaccaaaatatggaaaatcgcccatgccaaaccggcaataatgtggaatacaaacagaatcggatccatgacttcgacgctgccggaagccgcccaagcaccgccaagcaaggctatcaacaagaataccaattcgcccgcatacatattgccgaacaaccgcataccgtgggatacggttttagaaagaaactcgaccaaattcaacagaaagttcgcaggtgcgagttttgcaccgaacggcgcgctgaacaactcgtgaaaccagccacccaatcctttgattttgatgttgtaatagatacaaatcagcaacacgccgacagcgagtgccaaagtggtgttcaaatcggcagtcggtacgacgcgcagcagggcgtgatggttgccggtaatgccctgccataccatcggcagcaaatcgaccggcagcatatccatcgcgttcatcagaaaaatccagacaaacagcgtcagacccaacggcgcgacggcttttctagacttttcgttgtgaatgatgctcttacacatatcgtccacaaactcaaacaagatttccactgcggcctggaaacgtccgggaacgcctgccgtcgctttttttgcaccgcgccacaacagaaagctgccgattacgcccaacaggacggcaaaaaagacggcatcaaggttaataaacgaaaaatcagcaatgtttttcagtccctgaccctgagtaacatccgacaaactggtcaagctctgcaagtggtgcttgatgtagtcggcagcggtaatggtttcacctgccataatctttcactctcaacaatactaaaaaaaccaaatggctgacaccgagcagccccatcagaaacggggcgaacaccagcgattgatgccatattgcaaatacggcaagcatggacaacagcgacagcactacttttaaaatctctccgaagacgaacatcctgctttgcaggaaggggtttcccctgaaaagttttaaaagtaaaactgcaacaaacgtgggaagcaggtaggacaaaccgccaccgaccgccgaaaggaatccggcaaaaccccatacagcaaaggcaactgcggcgcatatggacaatacggcggattgtaggatgataatctgcttcataaagggaatgtttccgcctcggatttggggcgcggctaatataatttagaagccttattacgtcaagcgacagttaatctttgtgaaacaacgtatcccaatccgccgcgctcgccgcctgaataacggcgacaggtgtcattctaacacacattacatataattacaggatattaaggagtttgtccgcaatttctttacatttttaatgttcttacgtgatttgtttgctttacgtggaaataataaaaaatcaacgcgaaattgtagcagtttatcggtcggattgtcggcagtttggggaatttgctcaataaataaaaggtcgtctgaaaatattttcagacgaccttttccgaataaaggattagcaactgcctgccgctttaagcaaagcattgcattgacttttgcctttgtgcgttccgcctcccaaacaaattgcatcggaagtggtaacgccgattgtgctgattacactggtaacatagcattggctcacgcgcttacccacagttgcggtaaagttgatgcgtatgccttcattgttgcggttgctgatttttacggcatttgggctgacgcccaaggcaaacgcggcacgttcctgaagtttctagtcggaaacggttacattattgattgagccgcaacctgctaatgccaacgcaacgaacgcagccgaaacgatgatgcgtgtgttcataatttcctcgaaaattaaaaatgaaaacaggaaaacgattcttacgtgaagcagaaaaaatgtcaatagaattatatttcccacttaaaatctggaaagctattctctatatttcagacggtatatcccgcaaaattaaggccggtaatctatgcccaactgctccagcaggtggccgaacgtttcaggcgtatcgaaatacaggacaatcctgccttttttgtggttggcggttttgacttcagcgttgacacccagtttttcagtcagcaaatcattcaggcggccgatgtcggcggcggcagtctttttgggctcgggacgtttgttttgaagggcggcctggctgcggcgttcgacttcgcgcaccgaccagccgtttttgacggccttttgcgccaattcgagctgttcgacgagttttcggagaggaccatgcgcgggcgtgccccatttc

SEQ ID NO: 37770 - DNA, 49646 bp, Neisseria meningitidis
cagacattaccgtgtacaacggccaacacaaacgaagcagcacaagccgttgcagatgcctttacccgggctaccggcatcaaagtcacactcaacagcgccacacgcgaccagcttgccggtcaaatcaaagaagaaggcagccgaagccccgccgacgtattctattccgaacaaatcccggcactcgccaccctttccgccgccaacctcctagagcccctgcccgcctccaccatcaacgaaacacgcggcaagggcgtgccggttgccgccaaaaaagactgggtggcactgagcggacgttcgcgcgtcgtcgtttacgacacccgcaaactgtctgaaaaagatttggaaaaatccgtcctgaattacgccacgccgaaatggaaaaaccgcatcggttacgcccccacttccggcgcgttcttggaacaggttgtcgccatcgtcaaactgaaaggcgaagcggccgcattgaaatggctcaaaggtctgaaagaatacggcaagccttacgctaaaaactccgtcgcccttcaagcggttgaaaacggcgaaatcgatgccgccctcatcaacaactactactggcacgcttttgcgcgtgaaaaaggcgtacaaaatgtccacacccgcctgaatttcgtccgccacagagatcccggcgcactcgttacctattccggcgcagccgtgttaaaatcctcccaaaacaaggatgaggcgaaaaaattcgtcgccttcctcgccagcaaggaaggacagcgcgccctgaccgccgtccgtgccgaatatcctttgaatccgcacgtggtatccactttcaatttggaacccatcgccaagttggaagcaccccaagtgtccgccaccactgtttccgaaaaaraacacgccacccggctgcttgagcaagccggtatgaaataagccgttttcggattgtcaaacgggtggacatttatactgtccgcccgttttgccgataaaaaacactatgtctcctaaaaaaatacccatttggcttaccggcctcatcctactgattgccctaccgcttaccctgccttttttatatgtcgctatgcgttcgtggcaggtcggcatcaaccgcgccgtcgaactgttgttccgcccgcgtatgtgggatttgctctccaacaccttgacgatgatggcgggcgttaccctgatttccattgttttgggcattgcctgcgcccttttgttccaacgttaccgcttcttcggcaaaaccttttttcagacggcaatcaccctgcctttgtgcatccccgcatttgtcagctgtttcacctggatcagcctgaccttccgtgtcgaaggcttttgggggacagtgatgattatgagcctgtcctcgttcccgctcgcctacctgcccgtcgaggcggcactcaaacgcatcagcctgtcttacgaagaagtcagcctgtccttgggcaaaagccgcctgcaaacctttttttccgccatcctcccccagctcaaacccgccatcggcagcagcgtgttactgattgccctgcatatgctggtcgaatttggcgcggtatccattttgaactaccccacttttaccaccgccattttccaagaatacgaaatgtcctacaacaacaataccgccgccctgctttccgctgttttaatggcggtgtgcggcatcgtcgtatttggagaaagcatatttcgcggcaaagccaagatttaccacagcggcaaaggcgttgcccgtccttatcccgtcaaaaccctcaaactgcccggtcagattggcgcgattgtttttttaagcagcttgttgactttgggcattattatcccctttggcgtattgatacattggatgatggtcggcacttccggcacattcgcgctcgtatccgtatttgatgcctttatccgttccttaagcgtatcggctttaggtgcgattttgactatattatgtgccttgccccttgtttgggcatcggttcgctatcgcaattttttaaccgtttggatagacaggctgccgtttttactgcacgccgtccccggtttggttatcgccctatccttggtttatttcagcatcaactacacccctgccgtttaccaaacctttatcgtcgtcatccttgcctatttcatgctttacctgccgatggcgcaaaccaccctgaggacttccttggaacaactcccaaaagggatggaacaggtcggcgcaacattggggcgcggacacttctttattttcaggacgttggtactgccgtccatcctgcccggcattaccgccgcattcgcactcgtcttcctcaaactgatgaaagagctgaccgccaccctgctgctgaccaccgacgatgtccacacactctccaccgccgtttgggaatacacatcggacgcacaatacgccgccgccaccccttacgcgctgatgctggtattattttccggcatccccgtattcctgctgaagaaatacgccttcaaataacagcttgaggaagtaccgccatgaccgccgccctgcacatcggacacctgtccaaaagttttcaaaacaccccagttttaaacgacatttcgctcagcctcgacccgggcgaaatcctctttatcgtcggcgcgtccggctgcggcaaaaccacccttttacgctgccttgccggttttgaacaacccgattttggcgaaatttcgctttccggcagaaccatcttctcgaaaaataccaacctccccgtccgcgaacgccgtttgggttatgtcgtacaggaaggtgtgctgttcccccacctgaccgtttaccgcaacaccgcctacgggctgggcaacggcaaaggcaagacggcgcaagagcggcagcgcatcgaagctatgttggaattgaccggcatttccgaacttgccggacgctatccgcacgaactttcgggcggacagcaacagcgcgtcgccctcgcccgcgccctcgcacccgatcccgaactgattttgttggacgaacccttcagcgcgctggacgaacagttgcgccgccagattcgcgaagacatgattgccgccctgcgcgccaacggcaaatctgccgttttcgtcagccacgaccgcgaagaagccctgcaatacgccgaccggattgccgtgatgaaacaggggcgcatcctccaaactgcaagccctcacgaattgtaccgacaacctgccgaccttgatgccgccctgtttatcggcgaaggcatcgtgttccccgccgcgctcaacgccgacggcaccgccgattgcggattgggccgcctgcccgttcaaagcggcgcacccgcaggcacacgcggcacactgctcatccgtccggaacagttcagccttcacccccattccgcacccaccgcctccattcacgccgtggttctcaaaaccacgcccaaagcgcggcataccgaaatcagcctccgggtcggacaaaccgtcctcacgctcaacctcccttccgcccccaccctgtcagacggcatttccgccgtcctccatttggacggtcccgccctgttcttccccggaaataccctctgaaaggcggcagcatccacaagcctgcggatatttatcttgttggaaacagaatttgtttgctatattcaacctgcgcgcctcaagccaaacacggcacgcacggcacgcaggcagccgtttctgcctatatgccgccccttccaaccacatatgccgcacaccgcagcatacgaaaggatatatcatggcaaaagtactcatcgtacccgtatctgccggactggacgcctccgccgccgcacaagcctttgcaaaagcactggacgcacaaattttccaagccgttgacgcaaccgccgaaaccctgctcgcgcaaggcaaaagcgacgactggttcgacgcactggtcggcaaagttgccgcactcgatgccgccaacctcgtcatcgaaggcatcgcgcccgatgccgacaaaatctacctcgcaggcaaaaacgtcgaactggcattgtcccttgacgcggcagccgtcttcgccgtccgttccgacaacgccgatgccgacgaactggcaaatcgggtgaaccttgccaaacagttcttcgccgccgcgccgggcgtattggaaggttttgtcgtggacggcgcggcagcctccgttgccgaagcggcagccgaaaaaaccggcctgaccttcttcggttcgagcgacgcgctgaaagacgtatccgtattggcaggccgcgaagcaaaacgcctgtcgccggcgcaattccgctacaacctgatcgacttcgcccgccaagccgacaaacgcatcgtcctgcctgagggcgcagaaccccgcaccgtccaagccgccgccatctgccacgaaaaaggcattgcccgctgcgtcctgcttgccaaacgcgaagaagtcgaagccgttgccaaagaacgcggcatcagcctgcccgactctttggaaatcatcgatcccgcctcattggtcgaacaatacgtcgagccgatgtgcgaactgcgcaaatccaaaggcctgacacccgaagacgcgcgcaagcaactgcaagacaccgtggtactcggtacgatgatgatggcgcaaaatgatgtggacggtttggtatccggtgcggttcacaccaccgccaacaccatccgccccgctttgcaactgattaaaaccgcaccgggcgcaagcctcgtgtccagcgtattctttatgctgctgcccaaccaagtcctcgtcttcggcgactgcgcggttaatccgaacccgaccgcgcaacagcttgccgacatcgccatccagtctgccgattccgcaaaagccttcggcatcgacccgaaagtggcgatgatttcctactccaccgtcaactccggcagcggccccgatgtcgataccgtcatcgaagcaaccaaacttgcccgggaaaaacgccccgacctcgccatcgacggcccgctgcaatatgatgcggcaaccgtgccgggtgtgggcaaatccaaagctccgggcagcccggtggcaggacaggcaaccgttttggtcttccccgacctgaacaccggcaactgcacctataaagccgtccaacgcaacgccaacgtcttaagcgtcggcccgctgctgcaaggcctgcgtaaaccggtcaacgacctctcccgcggcgcactggtagaagatatcgtgtttaccatcgccctgactgccgttcaggcaaaacaaatggaaggctgacaaacggctttccgggtttaaaccctatgccgtctgaagacagactcccgttttcagacggcatttttatcagcacggcacatttgtttgttaaaatcgcagccatattgcaaaaaaagaggaggaagccatgcaaaccgccattatcgattacggtatgggcaacctgcattccgtattgaaatccgtccggacggcggggcagcttgccggaaaaaataccgaaatctttttaagcggcgaccccgaccgcgtgtcccgcgccgacaaagtcatttttcccggtcagggcgcgatgcccgactgtatggcggcattaaaacgagacggtttggacgaggcagtcaaagatgccttaaaaaacaaaccgtttttcggaatctgcgtcggcgcgcaacttttattcgaccacagtgaagaaggaaacaccgacggcttgggctggttcggcggcaaagtcagacgctttgagcgcgacctccgcgacccgcagggatgccgtctgaaagtcccgcatatgggctggaacaccgtgcgccaaacccaaaaccacccgctgtttaaagatattccccaagacacgcgtttttacttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactggtaagccggacacggccccgcacaaggagaaaaattatgctgctgatacccgccatcgatttgaaagaaggacgctgcgtccgcctgaaacaagggctgatggaagaggcgaccgtcttttccgattcgcccgccgaaaccgcgctgcactggttcaaacaaggcgcgcgccgcctgcatctggtagatttgaacggcgcgtttgccggcgttccgcaaaacctgcccgccatcaaagacatccttgccgctgtcgccaaagacatccccgtacagctcggcggcggcatacgcgatttgaaaaccatcggacaatatttggatttgggcttaaacgacgtgattatcggcacggcggcggtcaaaaaccccgacttcgtgcgcgaggcgtgcaaagccttccccggcaggattattgtcgggctggatgccaaagacggtatggccgccatcgacggctgggcaaccgtaaccgggcatcatgtaattgatttggcaaaacgctttgaagacgacggcgtcaacagcatcatctacaccgacatcgggcgcgacggtatgatgagcggcgtgaacatcgacgcgacggtcaaactcgcccaaaccgtccgcattcccgtcatctcctccggcggactgaccggcttggacgacatccgcgccctgtgtgccgccgaaaaacatggcgtagcaggcgcgattaccggccgcgcgatttacgagggtagcatcgattttgcccaagcgcagcaactggcagattccctcgactaaaggcatccgattatggcactggcaaaacgcatcatcccctgtctcgacgtaaaagacgggcgcgtcgtcaaaggcgtgaacttcatcggtttgcgcgacgcgggcgaccccgtcgaagccgccaaacgctacaacggcgaaggcgcggacgaattgaccttcctcgacatcaccgcctcatccgacaaccgcgacaccatcctgcacatcatcgaagaggttgccggacaagtcttcatccccctgaccgtcggcggcggcgtacgcaccgttgccgacatccgccgcctgctcaatgccggcgcggacaaagtcagcatcaacaccgccgccgttacccgtcccgatttaattgacgaagccgccggatttttcggttcgcaagccatcgtcgccgccgtcgatgccaaagccgccaaccccgaaaacacacgctgggaaatctttacccacggcgggcgaaatccgaccggtttggatgcggtggaatgggcggtcgaaatgcaaaaacgcggcgcgggcgaaatcctgctcaccggtatggacagggacggtacgaaacagggtttcaacctgccgctgacccgcgccgttgccgaagccgtcgacatccccgtcatcgcctccggcggggtcggcaatgtccggcacctgattgaaggcataaccgaaggcaaagccgatgccgtacttgccgccggcattttccatttcggggaaatcgccatccgcgaagccaaacgcgctatgcgcgaagccggcatcgaagtgcgcctctgaccgcctcgactatgccgtctgaaaggaaatatggataaaaacctgcttgaagccgtcaaatttgacgaaaaaggtttggtttgcgccatcgcccaagatgccgaaaccaaacgtattttaatggtggcgtggatgaacgccgaagccctgcaaaaaaccgtcgaaaccggctttgcccactattacagccgttcgcgccaaaaacaatggatgaagggcgaagagtcgggacacacgcaaaaagtccgcgcactgcgcctcgactgcgacggcgacgccattgtgatgctcatcgcccaaaacggcggcatcgcctgccacaccgggcgagaaagctgcttttacaaagtctggcgtggcagcgcgtgggaaaccgccgatgccgtcctgaaagacgaaaaagagatttacggcagcacgcactgaccgcctccaacattgaattatcaggcatttttttgtacaatttcgccgtctcaaacactgtccgggccgtctgaaaagcggcctgaacctttttgcaaagaaaaccatgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaaaaagcaatcggcgataaaatgccgtctgaacccgaaaaaaggctttcagacggcatttttgcctgcaactcaaatgcaccgatcaaaatcaagacgcatcggataccgttatcgggcatcccgtcctcatgaatttagggctgacgcaagaacgctggccggacatcgtgttccacgaaacgcgcgaacattcggtcaaactttaaaaaacaatcggcaataaaatgccgtctgaacccgaaaaaaggctttcagacggcatttttgcctgcaattcaaacgcagacggtcaaaatcaaggcgcatcggataccgttatcggatgcgtcccatccgcatgaatttggggctgacgcaagaacgccgatgtgatttcacatcccgtactgtttcgacagcttcacataatgcgcggcggaatatttcaaaaaggctttttcctcatcggtcagcacgcgcacctgtctgaccggcgaaccgacataaagatagccgcccgccaagcgtttgcgcggcggaacgaggctgcccgcgccgatcatcacttcgtcctcaatcacggcatcgtccagaaccgtcgtccccatgccgaccaggacgcggttgccgatacggcagccgtgcagcatcactttgtgccccacggtaacgtcttcgccgataaccagcggcgatccttcgggtttggcggcggttttgtgggaaacgtgcaagacgctgccgtcctgtatattgctgcgcgcgccgacggtgatgctgttcacatcgccgcgcaacacggcgcacggccacacggaaacatcttcggcaagcgacacttcgccaatgacgacgcaggcttcgtctatcatacaggtttcgtggatttcgggcgtgcggttttggaaagttcggattgcgttcatttttcctccttcggtaaggtatatattgttaaaggatttattaaatattccccctgattgcttttaaaatcctgcctgtaatatcgaccccgagtaatgtgattatcgggaatatcagcttatatatcaatttattggactttaacagcataaaccttaaatgatacgcccttctttttatatcagcatcacactctatatttttactcgtcattataaaaagcaaaacgagatattcgtaggaaagaaaagaataaagataactcgatatatccctattaaattccatttccgcatttttctccaaaatatataataatgactttatacttttttccgaaacagttcccgtaatagaatcttttcttccctgccgataatagtaataacaaccgtccaaataagaaaaagttgttgccgcattaaataacctcattgaccattcgatatcttcagaataaattcccctttcaaaaaacagtttttctctaataatcaattctctttttataatcttattccacgccgaacccggaaattttctaaatcggcataatcctttcaaaacttcgactttggattgattgagtattttttcaggctgataatcttcgccaaaatatgaaacacttcccttatcatatttaaccgcatttaaaaacaccacatccggcatatcagtatcatctttactaagaaaatccagcaaaatctgacagttaataaaatcatccgaatcaataaagactatatattttccgtttgaattttttattccggtatttctcgcctccgacaacccttggttatcctgatatatatatttgatatttggtgtccggtgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgttgtttgctgtttgatattttatctatatatttgtaacatatatcttcacttccgtcttttgacccgtcattcacaaggataagttcgacattttcattacttaatatagattctatggaacttaaacacgcttccaaataactttcgacattataaataggaactacgatacttaaatccatatctttctcattttactaaatcattttaatcttaacccaatcataaccggcaggaggggaaacgcccccctgtttgataacggacgcgccgtttcctgccgcccgaaaggtttcagacggcagggattccggttatttgcccgctttgagcccttgccacagcttcacgcccagtttgacggattctgcggatttgggcgatacgatgaaacttttttccatcagttctttgttcgggaaaatcgatgcgtcggaggtgtatttttcatccatcagctcgcgcgcgggacggctggcgggcgcgtaggtaacgaagctgccgtttttcgccgccacctcgggccggagcgtgtagtcgatatagcggtgggcattggcaacgttttgcgcgtcgcgcggaatcataaaggaatccacccacacgcccacgccggttttcggggtcaatactttgatttccacgccgtttgcggcttcttcggcacgggttttggcaatgttcaaatcgccgccgtaaccgatggcggcacacaggttgcccgccgccatatcgtcgatatagccggaagagctgaagcgtttcacgtcgccccggacggctttcatcatatcgacggcggctttgatgtcttcgggattctcactgttggggtctttgcccaaatagtgcaacgccaagggaatctgttcgattgcgctgtcgaaatagctgatgccgcaggatttgagtttggcggtgtattcgggtttgaacaccaaatcccattcgttttcgggcagcttgtccgtacccaatgcttttttcacctgctgggtattgattgccaaggtattgatgccccagaaataggggacggcgtattcgttgcccggatcgacggcttccatcattttcagcaaatctttatcgatgttgccgtaatgggggatttgcgccttgtcgattttctgatacgcgcccgctttgatttgccggccgacgttggcgatggacggcgcggtcaggtcgtagccggatttgccggtcaggacttttgcctccagtgtttcgttgctgtcgtaataatcggaacgcgtcttgatgccggtttctttttcaaaggcggcaacggtttcgggatcgacataatccgaccagttgtagatgttgagtttgcccgattgttcggcttcgggcttggcggagggggtttgggcggcggtatcgcttccgccgccgcacgcagtcaaggcgaggctcaggattgccgccgccaccagtgtttttttcatggttttcgacctttcgttcaaaaataaaaaacattgcagggacggacgggccgcctgcatcggaagctgtgggggcggccggtcggctttcttggcccttggtgcagcaaggtttgcattaaacggcaaaaacagccggggcgcaaccgttaattttcaccggtttgccgttccggtgcccgatcgggcggtaatgcgggacattgttccgcctgcgtaaaaatgccgtctgaagcctcggcggctttcagacggcatcggggcggacggcatcagttgctcaacacgtccacgcctttgggcggggtaaacttgaacgcgccgcgcgagagttggggattggtattcaaaccgccgaaactgatggaggtttggttgccgaagctgtctttaagctgcatggcggcgaggttgccgcctttgaagccgatgcggatgtattggtagccggcgttgttgcgtttgggcgttgccagcacataatcgatgccgttggacgaaccgtcctctttcagcgtgtagctgctttcgagggcggttttgttcgacaggatggcggcggggctgccgcctatggcctggtcttgggacgacttggtcacttgtgccagatcaacatcgtagagccaaacggtttgaccgtcgccgacgatggtttgcctgtaaggtttggtgtattcccatttgaaaaggcccggtcgcaggattttgaacgtgccgtgcgcggtttgggttttctttttgctttggacggtttgggtgaagctgccgctgataccgtcggcatcgttgttgaattgcttaagcgcgtctaccgcgcccgcctgtgcggaagcgacggcgacggtcagggagcaaacggcgaggaattggaacaggttgtgcggtttcatcattatttttccttgtcgggatgagtgtggcgtaaagtatcggcgcagcaaaacaatcatacgggcggcgttacgggcggtttgcattttgcaaaccgcgttttccgagggctgattttttgcccaccggaaaaggcggcgcgccacgctgccctttaatgtgtgccgcgttatagtggattaacaaaaatcaggacaaggcgacgaagccgcagacagtacaaatagtacggagccgattcacttggtgcttcagcaccttagagaatcgttctctttgagctaaggcgaggcaacaccgtactggtttttgttaatccactatatttgacggtttgggcgcggaatgccgaatcgcggagattatatgcctcatcttgttttttttaaacgctataatatttgttttccgaacacggcggacttgagatgaaacccgatatttatgctttgctggaacgcgccctgctttcgggcgacccagatgaaaaaggacggctgacggatgaggcgtttgccgccgttcaaaatgcggacggggcggaaacaaacgcaccgccggcggacttcccccgcgcgggacgaccggacaagcctgttttggtcgcgccgtcgcagctgacgccacgcaaaatgaacacaaccgaaggctatgcggcgatgctgcacgcgattgcgcatatcgaattcaacgccatcaatctggctttggacgcggcataccgtttccgcacgctgccgtttcagtttgtccgcgactgggtgaaagtggcgaaggaagaggtgtaccatttccgcctgatgcgcgaaaggctgcgcgctttcggcttcgattacggcgattttgaagcacacaatcatttatgggatatggcatacaaaaccgcctacgatcctttgttgcgtatggctttagtgccgcgcgttttggaagcgcgcgggctggacgttacgcccggcatacgcgcgaaggtggcgcagcgcggtgattcggaaacctgcggcgtgttggacatcatttaccgcgacgaagtgggacacgtcgccatcggcaaccggtggtatcaacacctttgccgcgaacgcggtttggagcctgtcgccctgttccgcagcctgattgcccgttacgatatgtttatcttccggggctatgtgaacatcgaagcgcgcgaaaaagcaggcttcagccgctttgaattggatatgttggaagatttcgagcagggtttgaaacaaaataaacatgccgtctgaaacccttcgtcccgcactttataaaaaaggaacacacatgatacaagccgtattgttcgacctcgatggcacgctcgccgacaccgccctagacctcggcggcgcactcaacaccctgctcgcccgccacggactacctgcaaaaagcatggacgaaatccgcacccaagccagccacggcgcggcaggactgatcaagctcggcgcaggcatcacccccgaccatcccgactatgcccgatggcgcaccgaataccttgacgaatacgacagccgctacgcccaagacaccaccctcttcgacggcgtaaacgaactcatcgccgaactcggaaaacgcggcatcaaatggggcatcatcaccaacaaacccatgcgcttcaccgacaaactcgtccccaaactcggcttcatcatcccacccgccgtcgtcgtcagcggcgacacctgcggcgagcccaagcccagcgtcaaacccatgctgtatgcgtgcggacaaatccacgccgacccgcaacacacactctacgtcggcgacgcggaacgcgatatacaggcggggcgcaacgccggtatgacgaccgtcctcgccgaatggggctacatcgctcccgaagacgataccggctcatggcaggcggatttccacatccgcacgccactcgatctgctcgaatgtctggacaaaatacagccctgaaaaatatccgccccacaaacatatagtggattaacaaaaaccagtacggcgttgcctcgccttagctcaaagagaacgattctctaaggtgctgaagcaccaagtgaatcggctccgtactatttgtactgtctgcggcttcgtcgccttgtcctgatttttgttaatccactataaaactgccgtctgaaacctgatttcagacggcagttccgccttcaaaccgaatcaaagcccgtcaaaacctgcgtttgagcttgcacgcctgaaggatgtgtaccgccaattcctcaaccgacttatccgtcgtattcgcaaacggaatcccatgccgtctgaacatactctgcgcgtccgccacctcgctgcggcatgtatcgattttggcataagttgaattcgggcggcgctcttggcggatggcctgcaaacgttccggctggatggtcaacccgaacagcttatccctataaggcttgaccatacgcggcagatcggccgattccaaatcgtcgggaatcagcggatagtttgccgcacggatgccgtattgcagggcgaggtaaaggcaggtcggcgttttgcccgaacgcgatacacccatcaagattacatccgcttcctgaaggttcttatcgctgaccccgtcgtcgtggttcaaagaaaaattgaccgcttccatacgcgcatcataacgcttcgtattaccgatactgtgatgcccctgcccggatgccgtggcttcggtattgagttccttctccaacagtcccaaaaaagtctcaaagaaattaatctgaaaagcatccgcccctttgataatccgacggatttcgtcatcaaccacactgacaaacgcaatcggacgctgaccgttttcctgccggctccgattgaccttctccaccaccgcgcgcgccttttccggcgtatcgacaaacggatgcgtatggcgtttgaacgacagattgccaaactggttcagcaacgcctcgccgatattctcagcagtcagaccggtacggtcggaaatgtaaaacacatggcgcggactgctcatcttccatccttaaaacacaggtttaaaatcccatcataacagcagcagcagacacaaggaaagcacccgcagcacacctacctcggattacacccaaacagacacaatataattttgaaataaaattatttatataaagtattttttggcagaaaattttaaaaaataaacaaaaaaatcaaacagaaaaaacattaacctattcaaaccacctgttttacaaagaaaatacccaaaaaaagaagtataccggctgtaagtttcaaaccgctacacacgccgaaaccgcaatttttcagacggcatcatgattttaaaacggataaaacacatgacagcagaggaacgaatcgcttaaaataagcacgcggatttgtttcttttttaacatattttggattggacacacaaatggccgacaactacgtaatctggtttgaaaacctgcgtatgacagatgttgaacgcgtgggcggtaaaaacgcctcgctgggcgaaatgatcagtcagctgaccgaaaaaggcgttcgcgtccccggcggctttgccaccacggccgaagcctaccgcgcattcctcgcacacaacggtctgagcgaacgcatttccgccgcactggcaaaattggatgtcgaagacgttgccgaactggcacgcgtcggcaaagaaatccgccaatggattttggatacgcctttccccgaacagctcgatgccgaaatcgaagcggcatggaacaaaatggttgccgatgccggcggtgcggacatttccgttgccgtacgttcttccgcaactgccgaagacctgccggacgcatcattcgctggacaacaggaaaccttcttgaacatcaacggcttggataacgttaaagaagcgatgcaccatgtattcgcttccctgtataacgaccgtgccatttcttaccgtgtccacaaaggcttcgaacacgacatcgtcgccctttccgccggcgttcaacgcatggtgcgttccgacagcggcgcatcaggtgtgatgttcaccctcgacaccgaatccggctacgatcaagtcgtctttgttacctcctcttacggtctgggcgaaaacgtcgtacaaggtgcggtcaacccggacgaattttatgtgttcaaacccacgctcaaagcgggcaagcccgccatcctgcgtaaaaccatgggttcaaaacacatcaaaatgatttttaccgacaaagcagaagccggtaaatccgtaaccaacgtcgatgtccccgaggaagaccgcaaccgcttctccattaccgacgaagaaattactgagttggcgcattacgcactgaccatcgaaaaacactacggccgcccgatggatatcgaatggggacgcgacggcttggacggcaaactctacatcctgcaagcccgtcccgaaaccgtaaaatcccaagaagagggcaaccgcaacctgcgccgcttcgccatcaacggcgacaaaaccgtattatgcgaaggccgcgccatcggtcagaaagtcggtcagggcaaggtgcgcctgattaaagatgcttccgagatggattccgtcgaagccggcgacgtactcgttaccgacatgaccgatccggattgggaacccgtgatgaaacgtgcttctgccatcgttaccaaccgcggcggccgtacctgccacgccgccatcatcgcgcgtgaattgggcattcctgccgttgtcggctgcggcaatgcaaccgaattgctgaaaaacggtcaagaagttaccgtatcctgtgccgaaggcgataccggctttatctatgccggtctgttggacgtacagattaccgatgtcgccttagacaatatgcctaaagcacctgtaaaagtcatgatgaacgtcggcaatcccgaactcgcattcagcttcgccaacctgcccagcgaaggcatcggcttggcgcgtatggaatttatcatcaaccgccaaatcggtatccaccccaaagccttgttggaatttgacaaacaagacgacgaattaaaagcggaaattacccgccgtatcgccggttacgcgtcccctgtcgacttctacgtcgataaaatcgccgaaggcgtggcgacattggccgcatcggtttatccgcgtaaaaccatcgtccgtatgtccgacttcaaatccaacgaatacgccaacctggtcggcggcaacgtatacgaaccgcatgaagaaaacccgatgttgggcttccgtggtgcggcgcgttatgtcgccgacaacttcaaagactgtttcgccttggaatgcaaagccttgaaacgcgtccgcgatgaaatggggttgaccaacgttgaaatcatgattccgttcgtccgcactttgggcgaagccgaagccgttgtcaaagccctgaaagaaaacggcttggaacgcggcaaaaacggcctgcgcctgattatgatgtgcgagctgccgagcaacgcggtattggcggaacaattcctgcaatacttcgacggcttctccatcggctcgaacgacatgacccaactgaccctcggtctcgaccgcgacagcggcttggtatccgaatcgtttgacgaacgcaaccctgccgtcaaagtgatgctgcaccttgccatctccgcctgccgcaagcagaacaaatatgtcggcatctgcggtcaaggcccgtccgaccatccggacttcgccaaatggctggttgaggaaggcattgaaagcgtttccctgaacccggataccgtcatcgaaacttggctatatttggcgaatgaattgaacaaataatcaatgcccatacccccgagcctgaaaagcgcgggggtatttttttccaagcagctccgctcagacggcatttcctgccgatgccccgtccgcgataatatttgacacccacgcgccgactgcctacaattcccccttccccgagcaaccggcaacggtcagcttcttctttcagacggcatctgcctgtctttttcctcttcaaaatacatcattattatgcacgtctccgaattacaaaccctgcacatttccaaactcttagaattggcggaagaacacggcatcgaaaacgccaaccgattccgcaaacaagacctcgtatttgccatcgtccgccagatgatgaaaaaaggcgagggtttcacctgctccggcacgcttgaaatcctgcccgacggcttcggcttcctccgcagcgcggacacgtcctatcttgccggccccgacgacatctatgtctcgcccacccaaatccgccgcttcaacctgcatacgggcgacaccatcgaaggaagcgtgcgcgtcccaaaagacaacgaacgctattttgccctggtcaggcttgataccatcaacggcgaccacccggaagtatgccgccataaaatcctgtttgaaaacctgaccccgctgtttccgaccgaacagttgaagctggaacgcgacttaaagtccgaagaaaacctgaccggacgtgccatcgacctgatttcccctatcggcaaaggtcagcgcgccctcttggttgccccgcccaaaagcggtaaaaccgtgatgctgcaaaacattgcccacgccgttaccgcaaactatcccgaagtcgaactcatcgtcctcttgattgacgaacgtcccgaagaagtaaccgaaatgagccgctccgtccgtggcgaagtagtctcctccacctttgacgagccggctcaacgccacgtccaagttgccgaaatggtgcttgaaaaagccaagcgtatggtggaacacaaaaaagacgtggtcatcctgctggattcgattacccgccttgcccgcgcctacaataccgtcgtgcctacctcgggcaaaatcctgaccggcggtgtcgatgccaacgcgctgcatcgtcccaaacgtttcttcggcgcggcgcgcaacgtggaagaaggcggttcgctgaccatcatcgccaccgcattggttgaaaccggcagccgtatggacgatgtgatttacgaagaattcaaaggcaccggcaatatggaattgcaccttgaccgccgtatggcggaaaaacgcctcttccccgccatcaacatcaacaaatccggcacgcgccgcgaagagctgcttgtcccaaacgaccagttacaacgtatgtggctcttacgcaagttcctgcacccgatggacgaaatcgaggcagccgaatttttaatcgggaaaatcaaagcctctaaaaacaacgacgatttctttgaactgatgcgcggcaaataaacgcgccgcccgcattaatgcgaaatgccgtctgaagcctgaaaatcgggtttcagacggcactttcattcacacggtcggcgcagctcctccctccccccgttaacggcgcaaccgtcggcagtgtccgtgtccgcttgccgaaagcgcggcctttgcaaagccggcttgaacgcatccgtaccggcaatgaaaaccgatgcgggaacttgattcaaggttgcgccgaaccgcactcatttttgtataaatttggggctgtcctagataactagggaaattcaaattaagttagagttgcccctatgagaaaaattcgtctaagccggtataaacaaaataaactcattgaactgtttgtcgcaggtgtaactgcaagaacagcagcagagttagtaggcgttaataaaagtacctcagcctattattttcatcgtttacgattacttatttatcaaaacagtccgcatttggaaatgtttgacggcgaagtagaagcagatgaaagttattttgctgaacgacaaaaccatatcaatggaattgggaacttttggaaccgggcaaaacgtcatttacgcaagtttgacggcattcccaaagcgcattttgagctgtatttaaaggggtacgaacgacgttttaacaacagcgagataaaagttcaaatttccattttaaaacaattagtaaaatcgagtttatcctagttatctaggacagccccataaatttttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttccaattaaaaatttttaatatattaatcaataaattaattttataaaataaaaatattgtcaacaatattttgccttatcgcccaaacctctgtatattttcctacagtaaattgttgacaatccatacgcccacatatgcgccgcctaaggataaatcctcccgccggacaacgggtgcaagggatcggatgcgatatttccatattcaaacaagggattggcggcacatcggcaaaatccccgcgccgccccggtccggcagggcttgcgtccctcccggacaagccccgaccccgcctttccgaaagacgggctcaaccattaaggaaactttagtcaaaatgaaaaaacacatatgggcggcatctttgctgccggcatccctatcggcagaacctttaaactggtggaagccttattccgccgtcaattcgggcgataccgcctgggtgatgactgcggctgccttggtactgttgatgacgcttcccgggctggctttattctacggcggtatggtgcggaaaaaaaacctgctctcgacgatgatgcacagcttttccatcgcgacattggtgggcatcctttgggtcgccgtcggctattctttagcgttcacgccgggaaatgcctttatcggcggtttggggcgcgtatttttaagcgggatgcagatagacgctaccgcacagatgctgaccgtgtcgcccaatgcgccgactgttcccgaaccggtatttatgttttttcagatgacgtttgccattatttcgaccgccattattaccggcgcgtttgccgaacggatgaaatattcggcaatgatgctgttttcgggcatatggtttttattggtttatgtgccgggcgcgcattgggtgtggggcggcggctttatgagcaagggcggcgtattggattatgccggcggtacggtggtgcacatcaatgccggtatcgcgggactcgtcgccgccttggttttgggcaggcgcataggctacgggcgcgaggcgatgcctccgcacaatatggcgatgacactgatcggcgcggcaatgttgtggttcggctggttcggctttaacgccggatcggcgcttgcggcagacgcggcggcgggtatggcgatggcggtaacgcaggtgtcggccgtattcggcgcggcaggctggcttgcctgcgaaaaaatagcgggacacaaaccttccgctttggggctggcttccggcgcggtttccggtctggtcggcatcacccctgccgccggctttaccggcccgtcgggcgcggccgccatcggtatattgactgccgccgcgtgctttgtgtccgtcaccgtcgtcaaacacaaattgcgttacgatgattctttggacgctttcggcatacacggattcggcgggctggtgggcggaatattgaccggcatctttttcgacaaccgcattttcggcggggatgcggcagtttggcagcagttgtggatacaggtaaaagacggggtcgttatggcggcatacagcgggctaatgagttgggcgattttgaaggtcgtggggaaaatctgcggcggcctgcgcgtcggcaaggatgtcgaacgcgaaggtttggatctgaatatccacggcgaacgcgtggaataagggcggctatgccgtctgaagcctgaaaatcgggtttcagacggcatttttcacgtttgccgccgatggataaacatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactatactgcctgcgacgcttaacggctgtctttccactgataatatttcgagccgaggaaagaaccgagtttgcgcaaaaacggttgcaggataatattcggctggcgcaaccgctcaaacggcttcagacggcattcgtcccctaaaattgcttcggcaaccgccagacctgcaatgcctgttatcgccatcccgtgtccggaataaccttgcgcataaaaaacattcggggctaaacgtccgaaatgcgggacaaggttggcggtaatgtcgcactccccgccccacgaatattcgattttgacatcggcaagctgcggaaaaactttaagcatatcttggcggacaagctcggtcatacgctcaggattgtcgataaactcgttatccttaccgccgaaaagcagtctgccgtccgcgctgaggcggtaataatccaaaatatggcggttgtcgcatactgccatattgttacggataagcccttttgcgcgcgcccccaagggttcggtcgcaataataaaggtgctgacagcaatcgccttgcgttccaaaggccggaatatcgggttcaaacctgcataagtattgacagcatagaccacatttttgcactcgacgctgccttcgggcgtgtaaaccagccaaccgttttgatgcggttcgatgcacgtcatcggggattgctcgaaaatctgcgcaccggcttcggcagcggcacgagcgatgcccaaagtgtaagtgagcggatgcaggtgtccggataaggggtcgaattgtgccccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcacaatcgacggcatgtttgcggacgcgttcgtccaccagttcgaccgcctgcaaagactgttgccaaaaccattgcgcctgctccaagccgacctgtttttcaatttcccccataccgcaggcgtaatcgctgataacctgcccgccactccgtcccgacgcgccgaaaccgatacgcgcggcttccaacacaaccgtttcatgtccctgctccgccaagggcaatgcagtgcacaaaccacccaatccgccgccgatgatacaggtatcggttttcagacggcattgaagtttcggataaacagtatgaggattaaccgaactgaaataataagaaggcagatattcttgaaaatcagggcgaatcattgtgtttgctttatcaggtgtattttcggacggaatgatacaggctgtcgggccatatcgtccaaacagaaaatcggttgaagaaaacaggctgacccagtcatgcggtcagcctgccttattaattaatttgctttctcggcagccaatttttcctggcggtaggcttctgccgcttctcggtcacgcttggttgcctgcctcatcatccaataattgacgatgatgaccaatgttccgatgatgccgattaggatggtcgccaagacattcatctgaggatcgagacccaacttgattttggagaaaatcacctgcggcaatgtggatgaaccggggccggagaggaatgaggtaatcaccaaatcatccaaagacagggtaatgccgagcagaaagcctgaagcgatggcaggggcaatcaaaggcaaagtgatgacaaaaaagattttcagcgggcgcgcgcccaaatccattgcggcttcttcgagcgactggtcaagctcaaccagacgcgaacggataacaacggtaatgtacgccatacacagcgtcgtatgtccgaggaagatggtgaaaaagccacgatcgaagtagagatgttgtaaccattcgctgccctgcaaaaatatctgtacctgaataatcagcagcagcatagacagaccggtaatcacgtcgggcatcaccataggtgcggaaatcatgccagcgaacaaggtactgccgcgaaaacgtttaatccgcgccatcgcatagcctgccagcgtgcccaaaacgacggcggcaagcgaagacacaacggcaatccgcagcgacagccaagcggcttccaagatggtgtcgttttccagcaatgcgccgtaccacttggtcgaaaagccgccccaaacggttaccagcttggattcgttaaacgaatagatgaccaaaacaaccagcgggatatacagaaacgccagcgacagtgccaacatcagtttcaagaaccaagataatttggatttctgcattatttggctccttcttccaattcgcggttttcataatgctgaaacagggcaatcggcacgaccagcagcgcgaccatcacgacggcgacggcggaagccagcggccagttgttttgatcgaagaacgcctgccacaagactttaccaatcatcaggttttccgaaccgccgaccagctcgggaatgacgaactcgccgacagcagggacgaaaaccagcatggagcctgcaataatgccggttttcgacaaaggcagggtaatcgtcaagaacgatttgaccggccccgcgcccaaatcggaagccgcttcaagcaggcggttgtcgagtttcaccagttgcgtgtatagcggcagaatcataaacggcagataggcgtaaaccatcaccaaattgagcgaaaaggcattgtagaacaaatccaaaggctcgctgataatacccattttaatcaacaggttgtttacaatgccgttatgcccgagcagacccatccacgcatagacgcgcaacaggaacgatgtccaaaagggcagcataatggcaagcagcaaaccattgcggacagaaggattggcacgagaaatcgcataggcggtcggataaccgaccaacagacaaattaccgtcgtagtcagcgcagtcttaattgaagaccaataagtcatcagatagatattgctgttttcaccgtcgccgaacggattgagcgtactccaaaaattttggaagatgtctgcataattttggtagctgacagcaatattcagacgacccaaatcctcatctatcgtcgttaaaggagtaaacggcgggatggcgatttcttgttcggcaaagctgattttcagcacgatggcgaacggaatcagaaacagcaccaaaagccaaatatacggtacggcaatcaccgcacgctgccccggacggcggaacagtttgtttttcagtttattaaggttcattgcattccccttaaatcaacggaacaacggagtcggttggttttccggccagctgatatagacggtttcgtcccaagtcggcggtgtaatgttgcgcacataccagtaaggggcggggacttggcttttgacgacgcgcccgttgccgagcttgatatggtaaatggcgaagctgcccaaataggcgatttcttttaccgtgcctttcgcccagttgtagtcgcccaaatattcgggtttttctttatataaatcaatatcctctggtcgaatactaacccaaaggtcctgctcgctcggaccacccaaaccgtgatcgatgcggacgtggttttccaaaccttcgcattcgataacggcatagtcggcatgatcttcaatcaccacaccgtcaaagatgttggtttcgccgataaactcggcagtgaagcggctgttgggatagtcgtacacgtcgctgggtgtgccgacttgctgcaactgaccgtcagacataatggcgatgcgggtcgccatcgtcatcgcctcttcttggtcgtgcgtaaccataatacaggttacgccgacttgttccagcgtattgaccaactcaagctgggtttgttggcgcagttttttgtccaatgcaccgaggggctcatccagcagtagaattttcggacgttttgccagactgcgtgccaaagcaatgcgctgctgctgaccgccggacaattggtgcggtttgcgtttagcaaatttggtcatctgaaccaggcggagcatttcttcgacgcgcgcggcgatttcgcctttaggcattttgtcctgtttcagaccgaaggcaatgttttgttctacggtcatatgcggaaaaagcgcgtaactttggaacatcatattgatggggcgatcatagggtgcaagtttggtaatatcctgaccatcaaggataatttttccctgattgggactttccatacccgccagcatacgcagcagtgtagattttccgctgccggaactgcccaaaagggcgaagatttcgtgttgataaatgtccaagtcgatgttatcgacagcgtaattgtcaccaaactttttcaccaaaccttggattttgagataaggtttggctgaagacgcagtggttgcggtcataatggcaatactccaataaaaagacgagtaccggcaaaacggattttcgaatgggtgataaaaagctgtttgattgctggcgggagttaaacgtttgatgccgtctgaaactcttgtaaagcgcacgggcagcatgaaatggaacaagattccaaagaactttatattatattagtttatgcggttttcgggcaatatagtggattaaatttaaaccagtacagcgttgcgttgccttgccgtactatttgtactgtctgcggcttcgtcgccttgtcctgatttaaatttaatccactataaatatggatttgagcttgtcggaaagcaacagaaaagaaaacaccgcccatttttctgggcggtgtcggaaagcgtaattatttacgcagacccaagcgggtaatcaacgcgcgatacgtatcgggctgggtacggcgcaagtaggccagcaggcggcggcgttggctgaccattttcaacaggccgcgacggctgtggtggtctttggggttggctttgaagtggggggtcaggtcgttgatgcggaaagtcaacagagcgacttgtacttcggaagagccggtgtcgccttctttgcgttggaaatctttaacgatttgtgctttttgttctacggtcagtgccataatgaaaactccaaaaatataagaatccccatagggattcagacaagtttgccaagcctgaagacaacggcaaactccctatgcccaagataggacaacgtggcattatgacacaattcccgcatttctgcacaatattttaagaccgtggaagtaaccgttaaaaatgccgtctgaagcattgtctgcttgagacggcaatgttcagacggcatatgcgcttcaaaccacgatttcttctttcttcttcggttctttaccgatattgtcgcggctcaaaccgaacattagcagaagcgggctggcaaccaatacggaagaataaatgccgaacacgatgccaatggtcaacgccatagaaaagccgtgcaaggccgcaccgccgaacaccagcatggatacgaccatcgcctcggtcgaaccgtgggtaatgatggtgcggctcatcgttgcggtaatcgcgttgtcgatgacttccggcacggcatgtccgcgcatcgccggcttgcggaagttttcacggatacggtcgaagacgacgacggattcgttcacagaatagcccaatacggcaaggatacccgccaagacggtcagcgaaaattcccattggaagaaggcaaagcagccgagaataatcacgatgtcgtgcatattggcgataatggcagatacggcaaaacgccattcaaaacgcatcgacaggtaaataatgatgccgataacgacaaaacctaaagccatcaatccattacttaccaattcctcaccgacttgcgggccgataaattcgacttggcgcaaggtaacgtcgggactgtcttttttcagcaaatccataacctgattggacaactgtgcggaagtaacaccttctttgttcggcaggcggatcatgatgtgtttgttcgtacccaatgcctgaacctgtacatcacctattttcagcgtatcgaggcgttcgcgcatcttattgacatccgcaccctgctgatattggacttccattaccgtaccgccggtaaattcgacagagaaattcagacctctggtaaccaaaaagaacacggcagcgataaacgtaaccaacgaaatgaaggtcgtcagtttgccgtagctcataaacggaatatcgcgtttgattttaaagagttccatagcttactccttgcctcctgccatttcggctttcggcttccacaccgaaccaatggaaatattctgcaatttgcgtctgcgtccgtaccacagattgaccaacgcacggaatacgacgacggatgaatacatcgaagtcagaatacccaaacagtgtacgaccgcaaaaccgcgtaccgggccggaaccgaataccaaaagcgcgataccggcaatcagcgaagtcaggttcgaatcgacaatggtcgcccatgcgtgttggaaaccgagattgattgcctgctgcggcggcacgccggcacgcaattcttcgcggatacgttcgttaatcaagacgttggagtcgattgccatacccaaagtcaacgccagcgcggccatacccggtaacgtcaacgttgcctgcatggcagacaaaataccgattaggaacagtatgttggcactcaatgcaatggtagaaaagaaacccatcagacgatagtaaaccaccatgaatgcagcaacgatggcaaaaccccataaagtcgaatggaagcctttttcgatgttctccttacccaaagacggaccgatggtacgttcttcgacaatctgcatcggtgcggcaagagaaccggcacgcaacagcaaagacgtatcattggcttcggctgtcgtcatgcttccggaaatttccacgcgtccgccggtaatggcagtacggataaccggcgcggttacaacctcggattttccttggtcgatcaaaaccatcgccatgcgtttgccgacatttgcggcagtcagttcgccgaaaatgctgccgcccgcgctgtccaagctcagactgacggcaggtgcgcccatttggtcgaaactcggttgcgcatcgttgatgttgtcgcccgtcagctcgacctgtttgctgatcagcagaatttcgggacgatctccgccgcttgaaagcagctcataaccgctcggcacgttgccttccaatgcctcgcgcaacttggcaggatcgtcctccaccatacgcaattccaaagtcgcggtacggccgatgatgtcttttgccttggcagtatcctgaacgcccggaagctgcacgacgatacggtctgcaccggactgctggatgacgggctcggccacgcccaactcgttcacacggttgtgcagggtagtgatgttctgtttgaccgcatcggaacacactttattgaccgcctcttccgaaagcgtcaagacgatattgctgccgtctgaattcagcgttgcttcagaaacagcttgcgcaactgcggcagagccttttgcacatcacctgcatcctgcaaagggacggtcaggctgtttccagcctgacgcaccgtgccgctgcggattttttcgcggcgcagttcgcggcggatgtcgcccgaataacgttcaaacgttttctgcatcgttgctttcatatcgacctgcatggtgaaatgcacgccgccgcgcaggtccaaacccaaaaacatcggattggctttgattttcgccatccattcggggctgtccgccaacaggttgagcgcggtaatatacccttcgcccaaagtgttttcgatgacgtcgcgcgctttaagctgcgtttctgtgtctttgaaacgcactttcagtgaattgtccacaacaaacatcccgtcggtctgaatacctgcgtttttcagcgcggcatccactttgaattgagtctgttcgttgatgatgatggcttgtcggttggtcgatacctgcacggcgggtgtttcgccgaataggttgggcagcgaatacactgcggcaaccgcaatcgtgaacacaatcagcagatatttccataaaggataacggttcatcattgttccttaatggttggaaccccaccctttcggtggtgtcggaatcgggctatttcagaagaggcaaaaacccttcccagccaggcaagaccggaaagcggcatcctgaatatgccgccctgcgtgtcggaacatggtcaagccttcggttggaattcaaaacaaagtgccgcattcgggctttccagatgcggcttgtcggcacaaatcaatcgacttttgcggcaatcgcattgcgttccacttcgacctcgatttttgtaccctgtccgatatccacggtaaaaaactgttcgccgactctggttaccttacccttgaaacctgccgccaagaccactttgtcgccgactttcaaggcggcaagcattgcctgatgcgctttgaatttcttttgctgcggacgcatgatcaggaagtagaacaccaccataatcaacactaaaggagcaaattgtgcaacagcttgattcataatttatccgttctttctaatatggttgaaaatcgagaggggtatataataacataagaccgtaaacaatatatcgggtttgccgtccgtaccgaccgtataccgcagcctgcccgtccacaaacccatgtccttgacccgcctaatcttgaaattctatgcactgttgcgcctttttttgggcaaaaacgcccgcaccgcatggatttcgcatcccgcctgtgccgggcacgaacccggcgcaaaccatcccgattcgcccgaccgcatcctctgcatcgagcaggcattgcgccgcgccggtatttggcagcacctccaaaccatagaggcggaagaaatcagcgatacgcgcctcgcacttgtccactcgagcaaatatctgaaccgtttggaatcttgcctgccccaaaaaggcaagatttcccgcctggataacgacactgcaatcagcacaggatcgctgtctgccgcacgctttgccgccggttcggcagttcaggcagtcgacatggtcatgaaccgtaaagcatggcatgccttttgcgccgcccgcccgcccggacaccatgcgggcagcggcaaagccggcggattctgcctgctgaacaacgttgccgccggcgtcatgcatgccattgccgaataccgcctgaaacgcattgccgtcatcgatttcgatgtccactacggcgacggtacggcagaaatattcaaagacgatccgcgcatcctgtttttcaacctgtttgaaaccgaccttttccccttccccgaaaacaacgatatgcccgacggcggcaatatggtgcacctgcccttgccgccaggaacgggcagccgcacattccgcgaagccgtccgcaggcagtggctaccccgacttgccgcattcaaacccgaactggtgctgctgtcggcaggattcgacgcacaccgtctagacgaatcgggcaggctcaacctgcacgaggcggattttgcctggctgacacacaaaatcattcagacggcatcgggctgccccggcaaaatcatatccgtactcgaaggcggctacacccttgaacctctggcacaatctgctgccgagcatatccgcgtgctggcagggctgggcaaatccgatgccgcaaccgcctatcagaaaacactggacccaacaaaaaaacggtttgccaaaccgaaaaccggacaggtgcgccaacctacccaatccgaccgttacgacatatagtggattaacaaaaatcaggacaaggcgacgaagccgcagacagtacagatagtacggaaccgattcacttggtgcttgagcaccttagagaatcgttctctttgagctaaggcgaggcaacaccgtactggtttttgttaatccactataaatgccgtctgaagccgattcggttttcagacgacatcattatttgacctgacgcaaacagaaagccttccgcgtgcttaaacacatctcttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcctcttgtagtaaaatatctaaacagattcaactggaaacggtcaagcttcttcacgccattcccatttcaaccgccgcctgccagattcagacggtattcctacttgaaaacaaggagcgttacaatgaaagcagcacgtttttacgacaaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtaacgatgggacacgagttctccggcgtggtctatgccgtcggcgaaggcgtggacgacatcaaagtcggccaacacgtcgtggtcgaaccctacatcatccgcgatgacgtaccgaccggagaaggcagcaactaccacctctccaaagatatgaactttatcggcttgggcggctgcggcggcggtctgtccgaaaaaatcgccgtcaaacgccgttgggtgcatccgatttccgacaaaatcccgttggatcaagccgctttgatcgaaccgctgtctgtcggacaccacgcctatgtacgcagcggcgcgaaagaaggcgacgtcgcattggtcggcggtgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgttgcagaagtgaaaaaactgaccaacggcgaaggcgtggacgtggcatttgagtgcaccagcgtcaacaaagtgttggatactttggtcgaagcctgcaaacctgccgccaatttggttatcgtatccatctggagccaccccgccaccatcaacgtccacagcgtcgtgatgaaagagttggacgtgcgcggcacgattgcctactgcaacgaccacgccgaaaccatcaaactggtcgaagaaggcaaaatcaaccttgagcctttcatcacccagcgcatcaagctggacgagctggtttccaaaggcttcgagcgtctgattcacaacaacgaatccgccgttaaaattattgtgagtccaaacctgtaagcaaattacatttgcaacagcacaaatgccgtctgaaacgctcagacggcattttccaacgaagcgcaacaggcgtattgcccgagagcagccgtttagcctatcattccgaacaaacagaaacaaacagaaggaaaatcatgggagattccgtactatccgccatccaacaaaccatcacccagcgaaaatctgccaatccgtccgaatcttacgtcgcacagctcttgcataagggcgaagacaaaatcctaaaaaaagtgattgaagaggcgggcgaagtgttgatggcatccaaagacaaaaacccgtcccacctggtttacgaagttgccgacttatggtttcacaccatgattcttctgacacaccacgacctgaaggcggaagacgtattggacgaacttgcgcgccgtcaggggctgtcggggctggtcgaaaaagccgctcgcacagaatcttgaatttatattaaaatccgcactttcccacattcaatccgtctgaccgcttttcagacggcatcggagccgttatggacaactgtattttctgcaaaatcgccgccaaagacattccggcgcaaaccgtctatgaagacggcgaaatggtttgtttcaaagacatcaaccccgctgctccggttcatctgctgctgattcccaaagtccatttcgattcgttggcacacgccgcgcccgaacatcagatgctgctgggcaaaatgatgttgaaagttcccgaaatcgccaaagcggcaggactggcagacggcttcaaaaccctgatcaataccggaaaaggcggcggacaagaggtcttccacctgcatatacacatcatgggtacacccgtataaaccgttatttcacaatcaacccctaatacttacttaaggatacatcatgggcagtttttctctgacgcactggattatcgtactgattatcgtcgttttgatattcggcaccaaaaaactgcgcaacgtcggcaaagacctcggcggtgcggttcatgacttcaaacaggggctgaacgaaggtacagacggcaaagaagcccaaaaagacgatgtaatcgaacacaaaaaagacgaagacaaagcgtaatttatgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtccgaacgttcctacgcttccgccgaaacccttggggacagcgggcaaaccggcagtacagccgaacccgcggaaaccgaccaagaccgcgcatggcgggaatacctgactgcttctgccgccgcacccgtcgtacagaccgtcgaagtcagctatatcgatactgctgttgaaacgcctgttccgcacaccacttccctgcgcaaacaggcaataagccgcaaacgcgattttcgtccgaaacaccgcgccaaacctaaattgcgcgtccgtaaatcataaagagagcaatccggtgtccgaaacacaaaacgaacaacccgtccaaccgcttgtcgagcatctcatcgagctgcgccgccgcctgatgtggacggttgtcggcatcttagtctgctttttcggcctaatgccgtttgcccaacaactctatacttttatcgccgacccgctgatggcaaacctgcccaaagacaccagcatgattgccaccgatgtcatcgcaccatttttcgtgccggtcaaagttaccctgatggcggcatttttaatttcgctgccgcatacgctctaccaaatctgggcatttgtcgcgcccgcactctaccaaaacgaaaaacgcctgattacgccgctcgtcctctccagcgtcagcctgtttttcatcggcatggcatttgcctactttttggttttccccgtcattttcaaattccttgccagcgttacccctgtcggtgtcaatatggcgacagacatcgacaaatacctctccttcatcttggggatgtttgttgcgttcggcacaacgtttgaagtccccattgtcgttatcctgttaaccaaaattggtgtggtaacaaccggacagctcaaacgcgcccgcccctatgtgattgtcggcgcgtttgtcattgccgccatcatcacgccgcccgatgtgatttcacaaaccctgcttgccattccgctgattctcttatacgaagcaggtatttggttcggacgctttttcacgccacgttcagaacaggatggcgacatacggccgcctgcaacaacctgacactatgccgtccgaacctccgcctcataccgcaacagattaaggaatacctttgaataccctctatttaggttcaaacagcccgcgccgaatggaaatcctgacacagttgggctaccgcgtcatccaactgcctgccggcatcgacgaatccgttaaagccggcgaaacacctttcgcttacgttcaaaggatggcagaagaaaaaaaccgaaccgccctgaccctcttttgcgaaaccaacggcacaatgcccgatttccccctgattaccgccgacacctgcgtcgtttcagacggcatcatattgggcaaaccccgctcccaagccgaagcaatcgaatttttaaaccgattgtccggcaaacaacataccgtcctgactgctgtctgcattcattatcgcggcaaaacgtcaagccgcgtccaaaccaaccgcgtcgttttcaagcccctgagttcggaagaaatttccgcctatgtgcaaagcggcgagccgatggacaaagccggtgcctacgccgtacaaggcataggcggcatctttatccaatctatcgaaggcagcttcagcggcattatgggactgcccgtttatgaaaccgtttcgatgttgcaggatttgggataccgctcccccttgtccgcccttaaaccgtaaagaccgccgtgaacagacaaaccgcttacctccttgcctctttcagcctgatcgcactgataatcctgtccctttcctgggaactgtggattgcaccgttgcgcccgggcggctcgtggctcgcgctcaaagccctccccctctgtctgccgctttcaggcatcttgaaaaagaaaatctatacttaccaatacagctccatgctggttctgatttactttgccgaagccgtcatgcgcctgttcgacgcctatcccgcagaacagatttgcgccgcgctttccgcagtattcagcatcatcttcttcatatcctgcctgtcgttcgtcaaacaatacaaggaaacaaacaatgcccgctgaaacgaccgtatccggcgcgcaccccgccgccaaactgccgatttacatcctgccctgcttcctttggataggcatcgtcccctttaccttcgcgctcaaactgaaaccgtcgcccgacttttaccacgatgccgccgccgcagccggcctgattgtcctgttgttcctcacggcaggaaaaaaactgtttgatgtcaaaatccccgccatcagcttccttctgtttgcaatggcggcgttttggtatcttcaggcacgcctgatgaacctgatttaccccggtatgaacgacatcgtctcttggattttcatcttgctcgccgtcagcgcgtgggcctgccggagcttggtcgcacacttcggacaagaacgcatcgtgaccctgtttgcctggtcgctgcttatcggctccctgcttcaatcctgcatcgtcgtcatccagtttgccggctgggaagacacccctctgtttcaaaacatcatcgtttacagcgggcaaggcgtaatcggacacatcgggcagcgcaacaacctcggacactacctcatgtggggcatactcgccgccgcctacctcaacggacaacgaaaaatccccgccgccctcggcgtaatctgcctgattatgcagaccgccgttttaggtttggtcaactcgcgcaccatcttgacctacatagccgccatcgccctcatccttcccttctggtatttccgttcggacaaatccaacaggcggacgatgctcggcatagccgcagccgtattccttaccgcgctgttccaattttccatgaacaccattctggaaacctttactggcatccgctacgaaactgccgtcgaacgcgtcgccaacggcggtttcacagacttgccgcgccaaatcgaatggaataaagcccttgccgccttccagtccgccccgatattcgggcacggctggaacagttttgcccaacaaaccttcctcatcaatgccgaacagcacaacatatacgacaacctcctcagcaacttgttcacccattcccacaacatcgtcctccaactccttgcagagatgggaatcagcggcacgcttctggttgccgcaaccctgctgacgggcattgccgggctgcttaaacgccccctgacccccgcatcgcttttcctaatctgcacgcttgccgtcagtatgtgccacagtatgctcgaatatcctttgtggtatgtctatttcctcatccctttcggactgatgctcttcctgtcccccgcagaggcttcagacggcatcgccttcaaaaaagccgccaatctcggcatactgaccgcctccgccgccatattcgcaggattgctgcacttggactggacatacacccggctggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccgtacctgatgccccgatacgccgacgaaatccgcaaactgcccgtatgggcgccgctgctacccgaactgctcaaagactgcaaagccttcgccgccgcgcccggtcatccggaagcaaaaccctgcaaatgacccgcgccggcggatgcggataccgcccgaaatgtaaagctccatgcaagacattgcaaaaaacagcaaaccggtagggaaatacgctatcaaaaaacattgcagccgtgttaagataaaccgtcaaacaatcttttcacagccccgcccgaaacagggtcggggcatacccttacgaaaaggaaacaccatgagccgcgtattactcgtagatgacgatgccctgctaaccgaactgctgaccgaatacctgagcgccgaaggtctgaacgtccgcagcgttcccgacggggaagcaggcgtacaggaaatcctgagcgggcagtacgatgtagtcgtattggattccatgatgcccaaaatgaacggcttggatgtcttgaaaaacgtacgcgcccgaagcaccgtccccatcatcatgctgaccgccaaaggcgacgacatcgaccgaatcatcggcttggaaatgggcgcggacgactatgtccccaaaccctgcacaccacgcgaactcttggcacgcatcaatgccatcctgcgccgcgcacaacacagcggcgaacagaacaacgcacccaacagcatctccgtcagcgatgtcgtcctgtaccccgccaaacgccaggcatccgtcaaagacatgccgctcgaactgaccagcaccgaattcaacctgctcgaagtcctgatgcgccatgccggacaggtagtcagcaaagaaaccctgtccgtcgaagcactcgaccgcaagctggcaaaattcgaccgcagtatcgacgtacacatctccagcatccgccacaagttgggcgatgcctctctgattcaaaccgtacgcggcttgggctacctgtttgtcaaaaactgaaataaacagataaatgaaactgttccaacgcattttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgaaccggtatatcgacagctataccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcatatatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactgaccataataccgtctgaaccggcttcagacggcattgcacaaacagttaccccaaaacaaacacacagcgggtgtctctccaaaaatcacgcacataccgtccgcaaaggaatatatcatgtcggcacaaaccgatccgggctacttcttcatgcccaaccacatcatcctgataggcgcgagcgaacaaccgtacagcctgggcgaacgtgtactcagcaacctgctgagtacgccctttcaaggaaaaatcacccccgtaaacccgcgccaccacaccatagccggactgcccgcctacaccagcctcaacaaaatccccggcaatgcagacctgattattgccgttaccctacccgacagttacgacaccctcttcaaaacctgccgcaaaaagcagctccgacacatcatcctcatacaggactgggacaacctgtctgccgcagaactgcacaccgccgaaactgccatccgcaaacaccacggcaacggactcaacatcaccgcctgcaccaccgcaggcatccaactgccctcactcggactcaacatcagtacccaagacggatacgccgcaggccataccgccatactgaccggcaatgccgccgtcagccgccaaatcgacaacatcctgaacaaactccgtcaaggcacatcccgccacatcagcctgcatcccggcatcagccccatcacatccgccgattggctcaaccgcttcggacacagcctgcacaccaaaaccgccgtcctacaccacaaccctgaagaggatcagcgcaaactgttcagcgcaatccgccaatttacccgccatacgccgctgattctccacatcacctgccgcacgacagaaaccgaccgtgccgtactgcactgcctcgcccgacactgcaacttcctcgtcagtttcaacgccgacgacctcgaagccgcactgcgcgcccaactgtccgaccttccacccctgtcccgactcgacatcctgtccgacacgcctgccgaatggctgcacgcgcacgcgccaaaaaacctcaccctccactttcccaaccttccccaccacatccgcaacggacacctgaccggcacacccacaccctcaatctgccacgacatcgcctcacgtcagcttgcccaccccgacacccaagccgtcctaaccatcctcagtccctccggacacgaggattacaaaaaaacagcacgcgcccttatccgcctgtccgaacagaccgccaaacccctgctcgtcagcagccccttttcagacggcataacccatttcgacacccccactcaggcaatccgcaccctttcctaccgcaacaccgccgccgccctgaaacaggcacagctcgacattgcaccgccgcagccatgccgtctgaaaacaccgcaaccccaaaacatcaaaaaagcccttgcagcggcaaacccctccctgctcgccgaagccctgcacctccccccctaccggcacaccacccataacgccgtacaattccaattcgacagccaccccctctatggcgacatcctgaccgcacgctgcaacggacaaaccactgccgtactcccgccgtttaccacgctcgacagccgccaccttgcccgctttgccgaactcgacggcacacaaaccctcgaccagttcctgcacacactgaccgtcattcccgaataccgccaacacattctcggcatcaccctcaacctcaacggcggacaatacagcagcgatttcctcttaaagacacccgaaacacacgacacgcccaaacgcaagaacacaggcaaagccgcccaaaccctcgaacatgccgccgcaaaaatgcagagtgccgccgcatacctgaaacacaaaaacccgacagccgccgaatttctccgccacacaagcgaagccgccgcagaactgctcggcagcaaaaccgaaaccggagcagccgtacccaacgtacttgccccctatcccgcagcataccccaaaacactgtccctaagaaacaacacgaccgttaccattacccccattttgcccgaagacgcagaagccaaacagcagttcgtccgcagcctcggtcccgaagcacggtacacacgcttcatgacccacaccaacgaactgcccgcagccacgttggcacgcctgtgcaaccccgattaccactgtgaagccgcatggacggcaaaggatgccgacagcaacatcgtcgccgtcgtccgccacagccgcctgaatcgcaacgaatgcgaattcggcatcacactggcggaacatatgcgcggcagcggactggcacagaaaatgatggaactcatcatccaaaccgccgcacagcaaggctaccggactatgagtgccgacattctcaaaaccaatacccccatgatcaaacttgctgaaaaatcaggatttaccctcaaggaatcggacaccgaaaaaaacctgtaccgcgcatatctgaaccttgcggcagacaaaacaacagaaaaaacaaataaaaacttgcgcaccgaccacaaaataacctaaaatcggcagtttccatatatccgattttctcaaaaggactcaaaatggtagttatccgtttggcacgcggcggctcgaaacaccgccccttctacaacgtcatcgttactgactcacgcagccgccgcgacggccgcttcatcgaacgcgtaggcttctacaaccccgtagccaacgaaaaacaagagcgcgtccgcctcaatgcagaccgcctgaaccactggattgcacaaggcgcgcaagtcagcgactccgttgcaaaactgattaaagaacaaaaagccgcctaatccgcatttgccgccatgacagacactcaaaaccgggtagccatgggctacatcaaaggcgtattcggcataaaaggctggttgaaaattgccgccaacaccgaatattccgacagccttttggactaccccgagtggcatttggtcaaggacggcaaaaccatcagcgttacccttgaagccggaaaagtcgtcaacggcgaactccaagtcaaattcgaaggcataaacgaccgcgacttggcattctcattgcgcggttacaccatcgaaataccccgtgaagcattcgccccgacagaagaagacgaatactactggacagacttggtcggcatgaccgttgtcaacaaagaccataccgttttaggcaaggtaagcaacctgatggaaaccggcgcaaacgacgtattgatgattgacggagaacacgggcagattctgattccgttcgtttcccaatatatcgaaaccgtcgataccggcagcaagaccattactgccgactggggtttggactactgatgcttatccaggcagttaccattttccccgaaatgttcgacagcattacccgctacggcgtaacgggacgcgcgaacagacagggaatctggcagtttgaagcagtcaatccccgaaagtttgccgacaacagattgggctacatcgacgaccgcccgttcggcggcggcccgggaatgattatgatggctccgccgcttcatgcggcaatagaacacgccaaaacacaatcctcccaagctgcaaaagtcatctacctcagcccccaagggaaaccgcttgacacaccaaaaagcggtagaactggcagaacttccgcatctgattctgctgtgcggacggtatgagggcatagacgaaaggcttctgcaaagcagcgtcgatgaagaaatcagcatcggagacttcgttgtttccggcggagagcttcccgccatgatgctgatggatgcggtattgaggctcgtacccggcgtattgggcgatatgcagtctgccgaacaggattcgttctcaagcggcattttggactgcccccactacaccaaacccttagaatttcaaggtatggctgttccggaagtattgcgttccggcaatcatggcttgatagcggaatggcggttggaacaatcgctgcgccgcaccttggagcgcagacccgatcttttggaaaagcgcgttttaatcccaaaggaatcccgcctcttagaaaccatccggcaagagcaacgggaaatccaatcataatttaggaaaaaaacaatgaacctgattcaacagctcgagcaagaagaaattgcccgcctgaataaagaaatccccgaattcgcaccgggcgacaccgtagtcgtatccgtacgcgtcgtggaaggtacccgcagccgtctgcaagcctacgaaggcgtggttattgcccgtcgcaaccgtggtctgaacagcaacttcatcgtccgcaaaatctccagcggcgaaggtgttgaacgtactttccaactgtactctccgaccgtcgaaaaaatcgaagtcaaacgccgtggcgacgtacgccgtgccaaactgtactacctgcgcggcctgaccggtaaagctgcacgcatcaaagaaaaactgcctgcacgcaaaggttgattcaaaccgttttcccccaatgccgtctgaaccttcagacggcatttcttattgctgcgatgccggcaagtcaacgatatgcctgcccctcatccaccttgattaacaatcactcccgcctattcaagcataatttacagaccaaacgttatacagtatcatatcagccatataacgataaacgctttaccgccttccctttcaaaaccgcaaatcatcatgacaccttcccttttactatcaggattgaccttccgcctcatccttgccctgattgccgtatcccttttatggggcgtttacttttgggcagtatccgcatgagcatcattgtcgaaaacctgaccgtcagctaccgccgccgacctgccgtgcaccatgtggacattacttttgaagaacatagtatgtgggcggttttcggtcccaacggcgcagggaaatccacctttctcaaatccttgatgggattgcagcctatcgatacaggcagcatccggctggacggattgacccgtcagaacatcgcctaccttccccagcagtccgatatcgaccgctcccagcctatgaccgttttcgacttggcggcaatggggctatggtatgaaatcggctttttcaaagggataaataccgctcaaaaacaacgcgttcacgaagccttggagcgcgtcggaatgcaacggtttgccgaccgtcagattgcctatctctcaaacggacaatttcagcgtgtcctttttgcccgaatgctggttcaaaatgccaaattcctgctgctcgacgaacccttcaatgccgttgatgcacggacaacctacgagcttctcgacgtattgcagaaatgccattgcggcggacacgccatcatcgccgtactgcacgattacgaacaagtccgtgcctactttcccaataccctgctgctcgcccgcgaaaaaattgcggcaggcgcaaccgagaccattctgacagaaccctacctcgcccaagccaacgccaaaatgcagcaacaggaaagccccgactggtgcgcctcataaatgccgtctgaaaccgaaaaaccatgaatctctacgacctgctccttgccccctttgcagaattcgactttatgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttgagcctgcccgccatgggtttgggcggcgtagccgcaggcatgctgatggcactgcttgccggactcgtcagccgcttcaccaccctgaaagaagatgccaactttgccgccttttatctcagcagcctcgccatcggcgtagtcctcgtcagcaaaaacgggagcagcgtcgatttgctccacctccttttcggctctgtacttgccgtcgatattcctgccctgcagctcatcgccgccgtctccagcctcacgctcattacccttgccgtcatctaccgcccgctcgtactcgaaagcatcgaccccctgtttctcaaatccgtcggcggcaaaggcgggctttggcacgtcctctttctcgtcctggtcgtcatgaacctcgtatccggctttcaagccctcggcacactcatgtccgtcggactcatgatgctgccagccattaccgcccgcctgtgggcgaagcatatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgaccgg

SEQ ID NO: 37771 - DNA, 49767 bp, Neisseria meningitidis
gttatgatatgtttcgatatgtaaacatttataggtttggagcgataaacaatgaatgcagtcgtagttgccgtaatcgttatgctggtgctgtcgctgtcgcgcgtgcacgtggtattgagcctgacggtcggcgcgtttgtcggcggcgcggtggcgggtatgccgctgcaaaacattgccgatgcggcgggacaggtcagtcaggcggggattatccccgtgttcaacaaaggtttggaaggcggtgcgaagattgcgctttcttatgcgatgctcggcgcgtttgcaatggcgattacccattccggcctgccgcagcagcttgccggcgcggtcgtccgcaagctgaaccggggcggtatgcccgacagcgtgcgttcgggcgagggcgcggtcaaatggctgctgctttccatcatccttgtgatgggcatgatgagtcagaacatcatccccatccacattgcctttatcccgatgattgttccgccgctgcttttggtgttcaaccgcctgaaaatcgaccgccgcctgattgcgtgcgtcatcactttcgggctggttacgacttatatgttcctgccttacggcttcggcgcgatttttttgaacgaaatcctgttgggcaacatccattccgccgcgccgcagcttgatgtgaaaaacattaacgtgatggcggcaatggcgattcccgcgttgggaatgctggccggactcctgctggcgtttgtccattaccgcaaaccgcgcctgtaccaaagcaacaatgccgatacggcgggcaacgccgatgcggcaaaccgtccgcagccgtccgcctaccgcagcctggccgccgccgtcgccattgccgtatgctttgccatccagttgatgtatgaagactcgctggtgttgggcgcgatgctcggtttcgccgtatttatgatgttgggggtcattaaccgcgacaaggcaaacgacgtattcggcgaaggtatcaagatgatggcgatggtcggcttcattatgattgccgcgcagggttttgccgccgtgatgaatgcgaccgggcatattcagccgctggtggaaagcagtatggcgatattcggcaacagcaaaggtatggcggcattggcgatgctggtggtggggcttttggtaacgatgggcatcggttcgtccttttccactttgccgattattgccgcgatttatgtgcctttgtgtgtcggtttgggtttttcgccgcttgccaccgtcgccattgtcggcacggcgggggcgttgggcgatgccggttcgcctgcgtccgattccacgctgggcccgacgatggggctgaacgccgacgggcagcacgaccacatccgcgattccgttatcccgaccttcatccactacaacatcccgctgctgattgccggctggattgccgcgatggtgctgtaaatggacgcggttcaagagttggaacgccgtattgtcgaactggaaatccaatccgcgcttcaggaggacgtaatcgccggcctgaacgcgatggtggcggaattgcggcagacgctggatttgcagcaggctcagttgaggctgctgtatcaaaaaatgcaggacaggaatcccgacgcgcaagagccgtattccctgcgcgacgagattccgccgcattattgatgcgccgccgtatccggatttccttaaaaaaggctgtgtttgaatattccgccgatgcaaacctaagatatatagtggattaacaaaaatcaggacaaggcgacgaagccgcagacagtacaaatagtacggaaccgattcacttggtgcttcagcaccttagagaatcgttctctttgagctaaggcgagccaacgctgtactggtttttgttaatccactataactttaatcagtcggacaaaatgccttttatccgatggaaccgttttccgcccgaacggaaataagcggcttcccccgctgcaaacagataaaaccaaccgggtattcaaacacagccaaaaaaaagccgtccgaacccaaaggggacagacggccaaacacattacggggaaaacgttttactcaatgagtctgcgaaacagacattgctaaaacaattgcaattataaggtaagtttatttttttttttttttttttgcaaagaaatgtaaatttttaaatttttaaaaccgttccgccgcatccgtttggatgccgtctgaaacggcggcagggtttatcgcgctgtgccgcaaaccgggcattcagggttgcgcggcaggtcgaaatattgccagcccccttccaaggcacggtaaaccgccagcctgccgtgcgacggttcgcccgcatccagcaggattttcagagcctccgccgcttgggtactgccgatgatgccgaccagcggcgagaacacgccgaagagagaacagatgccgtctgaagccgatccgccgtcaaacaggcaggcgtaacacggcgagtcgggcaagtcgggacggtacacggcaagttgcccttcaaagcgtaccgccgcccctgaaaccagcggtgttttcgtttgcacgcaggcacggttgacggcttgccgcgtggcgtagttgtcgcaacagtctaaaacgatgtcggcggcttgaaccaaaccggtcaggcggcagccgtcgagtttttcgttgacggcgcggacgttgacggtatggttgatgcgtttcaggcggcctgccaaggcttcggttttgagtttgccgacatcgccctcgtcaaatgcgacttggcgttgcaggttgtgcagttcgaccgtgtcggaatcggctatggtcagcgtgccgacacccgaagcggcaaggtagggcagtgcggcggcacccaaaccgccgcagccgacgaccaaaatatgcgcggcggaaagtttctgctgcccttcgatgccgatttcgtccaagaggatgtggcggctgtaccgcagcaggaatgcatcgtcgttgtcgtgttcggtcgtggtcatgatgatgttcggaaaaaaacagttgcgggcgattgtaacgctgccgtcgggcggcgttcaacttcagacggcatttcgggacacgggcggttaaagtgtgaacggtttggcacggatgcggcatttggggtacatttacaatatttacggcagacgagagagaaaaatcatgcaactgcatattctgaacaatccaaaggacgcggctttggcggcggacgcggaatttctgaaacaatccctgttcaacctcctgcacgaagaagcctcgccgttggttgtcgaaacagtcaaactcttgtccacttccgacgacagcgcggcattgattgaaaaagtattgccgcaattggacgaacaacaaacccacgatttaaccttggcctgcggcctgttcgcccagattttgaacatcgccgaagacgtgcaccacgaacgccgccgccaaatccacgaagaagccggacgcggcggcgcggaaggcagcctgacggaaaccgtccgcaggctcaaagcggggaaagccgacggcaaatcggtgcagcggcagttggacaatacgtccgttaccgccgttttgaccgcgcacccgaccgaagtgcaacgccaaaccgtcttaagcttcaaccgccgcatccgcgcactgttgccgcaacgcgaacgctgcaccaatgccgacgcgctggcacggctgcgccgcgaaatcgacactatcctgctgggcttgtggcagaccagcgaaacgcgccgccacaaactcagcgtcaacgacgaaatcaacaacggcgtgtccatcttcccgatgagctttttcgaagccctgcccaagctctaccgcaagatggaacacgactttcagacggcctatcccggcgtccgcgttccggacatcctcaaaatcggcggctggatcggcggcgaccgcgacggcaatccgtttgtttctgccgaaaccctgcgctttgccttccgccgccacgccgatgccgtgttccgcttctatcgcggcgaactcgacaaactctaccgcgaactgccgctctccatccgccgcgtcaaagtcaacggcgatgtaacggcgttgtccgacaaatcgcccgacgaagaaatcgcccgcgccgaagaaccctaccgccgcgccatcgcctacattatggcgcgcgctatgggcaaagcgcgcgcgctcggtttgggtatgggctgcaaattcggctttctcgagccttatgcttcggcacaagagtttctggatgatttgaaaaaattgcaacgttcccttatcgacaacggcagccgtctgcttgccgaaggccgtttggcagacctcatccgttccgtatccgtgttcggctttcacatgatgccgctcgacttgcgccaacacgcaggcaaacacgccgatgtggttgccgagcttttccaacacgcaggcttggaagactacaaccgcctgaacgaagagcaaaaacaaaccgccctgttgcgcgaattgagccatcaacgtcctctgtacagcccgtttatcacatacagcgaccatacccgccacgaactggcaattttcaacgaagcgcgcaaaatcaaagacgaatttggcgaagatgccgtaacacaaagcattatttccaactgcgaacaacccagcgacctgctcgccttggcattgctgctgaaagaaaccggcctgttggcggtggaaaacggcaaaccgcacagccgcatcaatatcgtgccgctgtttgaaaccattgaagcgttggaaaacgcctgtccggtcatggaaaccatgttccgcctcgactggtacgatgcactgctcgaaagccgtggaaacatccaagaaatcatgctcggctattccgactccaacaaggacggcggctacgttaccagctcatggtgcctctatcaggcggaattgggcttggtcgaactcttcaaaaaatacgatgtccgtatgcgcctgttccacggacgcggcggcagcgtaggtcgcggcggcggcccttcttaccaagccattctcgcccaaccggcgggcagcgtggcgggacaaatccgcatcaccgaacaaggcgaagtcattaccgccaaatacgccgaccccggcaatgcccaacgcaacttggaaaccttggttgccgcgactttggaagccagcatcctgccggataaaaaagaccctgatgccaaactgatgcaggcattgtcggacgtatcgttcaaatactaccgcgaactgattacccatcccgacttcatcgactactttctgcaaaccagcccgattcaggaaatcgccaccctcaacctaggcagccgtcccgccagccgcaaaaccttggcgcggattcaggacttgcgcgcgattccgtgggtattttcctggatgcagaaccgcctcatgctgccggcttggtacggtttcggcagcgcggtggaaaccttgtgcgaagacaaacccgaaacgctcgccgccctgcgcgaacacgcccaaagcaacccgttcttccaagccatgctctccaatatggaacaagtgatggcgaaaaccgacatcaccctcgcggaaaactatgccggcttgagcgaatcgcccgataaggcaaaaatcatcttcgggatgattaaggaagaataccgccgcagccgcaaagcactgctcgacctactgcaaaccgaagagcttttgcgcgacaaccgcagcctcgcccgttcgctcgctttgaggattccctacctgaacgcgctcaacggtttgcaagtcgccatgctcaaacgcctgcgtaaagaacccgacaatccgcacgcccttctgatggtgcacctgaccatcaacggcgtggcgcaaggtttgcgcaatacaggctgatagtgccgcatcggggcaaaatgccgtctgaacgcctttcagacggcatttccctgaccgcacttgcagagaaacaccgattgttttaaagtgaacggcagtgatatgttgaaagacgaccaatgaaaattaccgttatcggcgcaggttcgtggggtacggcgctcgccctgcatttttcccaacacggcaaccgcgtatccctgtggacgcgcaacgcagaccaagtccgtcaaatgcaggaagcgcgtgaaaacaaacgcggactgcccggcttttcctttcccgaaaccttggaagtgtgtgcggatttggcagacgcgctcaaagacagcggacttgtccttatcgtaacctccgttgccggattgagaagcagcgcagagctgctcaaacagtacggcgcgggacacctccccgtcctcgccgcctgcaaaggattcgagcaggataccgggctgctgacctttcaagtcttgaaagaagtattgcccgacaataagaaaatcggcgtactttccggcccgagttttgcacaggaactcgccaaacaactgccctgcgccgtcgtccttgcctccgaaaaccaagagtggattgaagaactcgtaccgcagctcaacacgaccgtcatgaggctttacggcagtaccgatgttatcggcgtggcggttggcggcgcggtaaaaaatgttatggcgattgccaccggattgtccgacggcctagagtacgggcttaacgcccgtgccgcactggttacgcgcggattagctgaaatcacccgccttgcctccgcaatgggcgcacagcccaaaaccatgatggggctggcaggcatcggcgacctcatcctcacctgcaccggcgcactttcgcgcaaccgccgcgtcggcttgggtttggcagaaggcaaggaactgcatcaggtgctggtcgaaatcggacacgtttccgaaggggtcagcacgatagaagaagtcttcaatactgcctgtaagtaccaaatcgacatgccgattacccaaactctgctgcaactcatccgcaaagaaatgaccccgcaacaggttgtcgaaagactgatggaacgcagcgcgcgttttgaataaacaacagacagatgccgtctgaagccttcagacggcatacggacaggtaaggttatgaaacaaaatatcgaaaaactcgaaagcagcgtttatacgttggtacaaaaattcgaaaccctcgtcagcgaaaaccgccgcctcaaagaaaccgtcgccgaactcaaacgggcgcacgagcggcaaaaactcgaacacgaaaccgccgtcgacgaactcagcgaagccctgctcgtccaagtcggcaaactcaaagaagacctgcaaaacaaaattgacagcctgacagaagaaaatacacgataccgcagcctgctcgaacagagcagggaaaaaatcagcgcactggcagcgcgcctcccccaatggcaggaaacgcagcaataaggattaaaggatgaacatcgaacaagtccacatcgaagtcatgcacgcccggctgaccgtcaacacgccggcagaagaaaaagacacactgttgcaggcagtcggaatgctcaacggcaaagccgaagccatccgcgaaggcggacgcgtcgcggacagcgaaaaaatcgtcattatggccgcgctcaacgtcgtccacgacctgttgaaaacctccctgaacggcggcgatttggcaatcggcgattttgcgcgtaaaatagccgatatggacaacgcctgccaaaaagcactatcccgcttggcgcaggaataacccctttttccctgcggtgtccgcgaaggcatatattcctttgaaccaataagttcgcttaaggttgccgggagcagtagtgggcgcgagcgtccttttgcggacgcacccgaaactacccgaggcagccgccttgtcagcaaggttcaagcggattcggccgaaacggctctcgcggggattcccattcaaaaccgcatcgcaacgatgcggtttttcacattggccgccgccccgcccgaaaaagcagtatgcagtctgccgaaatccggaaaatccttccgtaacgcggtaatgcgattgacaaaatcgaatcctgtctttaaaatttacaactttctatatctatctggatttccactatgaaaaccttttcagcgaaaccccacgaggtgaagcgcgaatggttcgtcatcgatgcccaagacaaagtcttgggtcgcgttgcggccgaagtcgccagccgtctgcgtggcaaacacaaacctgaatacaccccccacgtcgataccggcgattacatcattgttatcaatgcggacaaactgcgtgtaaccggtgccaaattcgaagataaaaaatacttccgccattccggtttcccaggcggtatctacgaacgcaccttccgcgaaatgcaagagcaattcccgggccgcgctttggaacaagctgtaaaaggtatgctgcccaaaggtcctctgggttacgccatgattaaaaaactgaaagtgtatgcgggtgcggaacacgcccatgctgcgcaacaacccaaagttttggaactgaaataaggacgcgacatgaacggtaaatactactacggcacaggccgccgcaaaagttcagtggctcgtgtattcctgattaaaggtacaggtcaaatcatcgtaaacggtcgtcccgttgacgaattcttcgcacgggaaaccagccgaatggttgttcgccaacccttggttctgactgaaaacgccgaatctttcgacatcaaagtcaatgttgttggcggcggcgaaaccggccagtccggcgcaatccgccacggcattacccgtgccctgatcgacttcgatgccgcgttgaaacccgccttgtctcaagctggttttgttacccgcgatgcccgcgaagtcgaacgtaaaaaaccgggtctgcgcaaagcacgccgtgcaaaacaattctccaaacgttaatgttggaaattcaaaaaaccctgcttatcgcagggttttttatttgtagtagacggtttcccattggcaatctaaagattacagattgggcaaaaatcaaaaacagtatagtggattaacaaaaatcaggacaaggcgacgaagccgcagacagtacaaatagtatggcaaggcgaggcaacgccgtactggtttttgttaatccactatacatgaaaaaatagaaaaactgccgggtatggttgaataaggggtcagaccggttccagttcgctcagtccgggcaaatctgcaaaaccgcgttcgcgtatgatttggcaaaaattgttcagatagctcttgtccgtatcttcggtacggatggcggcatacagtttgctttgcagtccgtcggcagtaatttggcggtggacgacatagcctttttcaaggtagggcatgactgtccaatagggaagggcggcaatgccacgtctgctggcaaccagttggataatggcgatggtcagctcgctgtgtcggcgcggcgggttgatgtttttcggaatcaggatttttttgggcaaatccagcatctcgtcgggaacgggataagtaatcagggtttccccgataaagtcttccgccgtccaaacgtttttggcggcaagcggatggtctggtgcgcaaatgccgaccatttcgtaggcaaacagcggttggaaagaaataccgttttgtttttccgcttcggaaacaatggcaaggtcggcacggtgttgcagcagcagtccgacgggatccgcttggaatcccgatacgatatccaattcgacttggggccacatcgggcggaattcgcccatggcgggcatcagccagtcgaaacaggtatggcattcgacggcaatccgcagctctcccgcctctccttccgtgattcgcgccaaatcccattctgcaacagcaacttgaggtataagttcgtgggcgaggcgcagcagcctttcgcccaccggggtaaagcgcaagggcgtggatttgcgttcgaacagcggcgtgccgtagtggttttcgagcatacggatctggtgggaaagggcggattgggtaaggaaaacccgtttggcggcaagggagacgctgccggtttcttcaagtgccagcagggttttgaggtggcgcaattcgataatggaatccatggggcttcagacggcatattgaaccggcgcatattaaaataattcatatgcgggtgcaaatcggaaaaatgtgaattccggacattttgcgattagaatgcccgcttgtttaaagcgattaggaaaaaagatggtattgtgcagggattttctgacttggtgtaatgaaacattgcagacagcgttgtttaaagattacgcccctaacggtttgcaggttgaagggagggaatatatcgggaaaatcgttacgtcggtaacggcaagcagggcagcgattgattttgctgtggagcagaaggcagatttgcttttggtacatcacggtatgttctggaaaaacgagttgccgaccgttactggttggaaaaaagaacggattgccgcactgttacggcacgacatcaatatggcaggctaccatctgcccctggatgcacatcccacactgggcaacaatgcccaactcgccgacagattgggttttgcgacagaaaaacggttcggcgaacaaaacctgctcaactcgggcagcctgaaacaagccaagacactcggcgcattggcggcgcatattgaaacagttttgcaacgtaagcctgtcgttatcggcaatcccgaacgcgaaatccgacgggttgcatggtgcagcggcggggcgcaggggttttttcagacggcaatagacgaaggtgtcgatctgtatttgacgggggaaatctctgaagcccaataccaccttgccaatgaaacgggtacggctttcatttcggcagggcatcacgcgacggaacgttacggcgtacgcgcgctggcagaatcggcggcagaggttttcgggttggaagtgtgccattttgacgaaaacaatccggcttgagtcttgagaaatatcataaaactttaccttattttaaataatgctttgagtatcactgcaaactgggtaaaattgcaacgtttaatggctcggtattcccaaaatattaggacgactgaataatggataatcaagaaatcaacaacggccgccgccgtttcctgacactcgcgacctgcggcgcgggcggagtggcagcattgggtgtggcaacgccgtttgtggccagttttttcccttcggaaaaagccaaggccgccggtgctgccgtcgaggtggatgtcagtaaaatcgaagcgggtcagctgctgaccgccgagtggcaaggcaaaccgatttgggtgctcaaccgtacagatcagcagcttaaagacctgaaaggcctgaacggcgaacttaccgatcccaattccgatgcggaacagcagccggagtatgctaaaaacgagacccgttcgattaagccgaacatccttgtcgccatcggtatctgcacccatttgggctgctcgcccaccttccgtcccgacattgcccccgccgatttgggtgcagactggaaaggcggcttcttctgcccctgccacggttcgaaattcgacttggccggccgcgtatataaaggtgttcctgccccgaccaacctggttgtcccgccatataaatacttgagcgacacaactatcttggtgggcgaagactaagaataaggaacgataattatggcaaaccaaaccaatagcaaagcaaaagcattgttaggctgggtagatgcccgttttccattaagtaaaatgtggaaagagcatctgtctgaatactatgcgcctaaaaacttcaacttctggtatttcttcggctcattgtctatgctggtgctggtgattcaaatcgtcagcggtattttcctgaccatgaactacaaaccggacggcaaccttaacgcctaccatctgcctgctgcctttaccgcagtagagtacatcatgcgcgacgtgtccggcggctggattatccgctatatgcactctaccggcgcatctttcttcttcatcgtcgtttatctgcacatgttccgtggtctgatttacggttcgtacaaaaaaccgcgcgaattggtgtggattttcggttccctgattttcttggcattgatggcagaagcctttatgggctacctgctgccttggggtcaaatgtccttctggggtgcgcaggtaattattaacctgttctccgccatccctgttatcggtcctgatttgtccacttggatccgcggtgacttcaacgtttccgatgttactttgaaccgattcttcgccctgcacgttatcgctgtacctttggtattgctcggcttggttgtggctcatatcattgccttgcatgaagtgggttccaacaaccctgacggtgtagaaatcaaaaagctgaaagatgaaaacggtgtccctctagatggcatacctttttttccgtattatgttgtgcatgatatattggcagtaacgatattcttgattgtcttctgtgccgtgatgttctttgcacctgaaggcggcggctacttcttggaagcgccaaacttcgatgcagcgaatgcgctgaaaacacctccgcacattgcgccggtatggtacttcactccgttctacgcaattctgcgtgcgattccttcctttgccggtactcaggtatggggtgtaatcggtatgggtgcagcagttgtactgatcgccttgctgccttggttggataaaggcgaggttaaatctgtccgctatcgcggcccaatcttcaaaaccgcattggttctgttcatcattgccttcatcggtttgggtattttgggtgcaatggtagcaactgatacgcgtactttggttgcacgtatcctgtctttcgtctactttgcattcttcctgggtatgccgttctataccaaactggataccaacaaaccagttcctgaacgcgtaaccatgagcactactaaacaaaaaattatgttctttgtttacgtcggtattaccgttgttggtgcttacttgtttgcaaccaatatctgatgagggcagcgaaaatgaaacaaactctgaaaaactggtttgctgccttattgctggcagtgcctatgagtgcagccgtcgccagcggcggcggacactacgaaaaagtcgatatcgacctgcgtgaccaagtcagcctgcagcacggtgcgcaaatctttacaaactactgtttgtcttgccactctgcaagcggtatgcgcttcaaccgtctgaaagacatcggtttgactgacgaagaaatcaagaaaaacctgatgtttaccaccgataatgtcggcgatgtcatgcattcggcgatgaacccgaaagatgcggcaaaatggtttggtgctgctccgcccgatttgacgttgattgcgcgttccaaaggtgcagactacctttacgcctatatgcgcggcttctataaagatccgacccgtccgagcggctggaacaatactgtattcgataaagtcggtatgccccacccgttgtgggagcaacaaggtgttcaagccgttgagttggatgccaaaggtcagccggttatggtaaaagacgaacacggcgagatgaagcctaagctgtattgggaatctaccggtttgcacagccgccgcctgcctaacggcaaagtgatccaaaaagagtacgacgcatatgtacgcgatttggtcaattaccttgtgtacatgggcgaacctgcacaactgcaacgcaaacgtataggctatgtcgtgatgattttcctatttgcggttatgctgcctttggcttacttcctaaataaagaatattggaaagacgtacactaagcgtttggaacaaaagggcaaatcctttagggtttgcccttttttcattttgcctgccgtttgaaaagcctgaatccgtatgccgtctgaacatagctgcaacatttcagacggcatcattctaaaaatgtcagacatcgggaacttaatcagggtttgtggcagattgatattgaattaggaaaaggtctgaaaccgcaagcagcatggtaaggcgatgtcgaacaggtttaaagccaatccgctatattttttggagctatgtcgaacaaacaggtagaatcggaataagcggcggttttgtccggtgtgaaaatgtttgaatattaggataattgatggaactgatgactgttttgctgcctttggcggcgttggtgtcgggcgtgttgtttacatggttgctgatgaagggccggtttcagggcgagtttgccggtttgaacgcgcacctggcggaaaaggcggcaagatgtgattttgtcgaacaggcacacggcaaaaccgtgtcggaattggcggtgttggacgggaaataccggcatttgcaggacgaaaattatgctttgggcaaccgtttttccgcagccgaaaagcagattgcccatttgcaggaaaaagaggcggagtcggcgcggctgaagcagtcgtatatcgagttgcaggaaaaggcacagggtttggcggttgaaaacgaacgtttggcaacgcagctcggacaggaacggaaggcgtttgccgaccaatatgccttggaacgccaaatccgccaaagaatcgaaaccgatttggaagaaagccgccaaactgtccgcgacgtgcaaaacgacctttccgatgtcggcaaccgttttgccgcagccgaaaaacagattgcccatttgcaggaaaaagaggcggaagcggagcggttgaggcagtcgcataccgagttgcaggaaaaggcacagggtttggcggttgaaaacgaacgtttggcaacgcaaatcgaacaggaacgccttgcttctgaagagaagctgtccttgctgggcgaggcgcgcaaaagtttgagcgatcagtttcaaaatcttgccaacacgattttggaagaaaaaagccgccgttttaccgagcagaaccgcgagcagctccatcaggttttgaacccgctaaacgaacgcatccacggtttcggcgagttggtcaagcaaacctatgataaagaatcgcgcgagcggctgacgttggaaaacgaattgaaacggcttcaggggttgaacgcgcagctgcacagcgaggcaaaggccctgaccaacgcgctgaccggtacgcagaataaggttcagggcaattggggcgagatgattctggaaacggttttggaaaattccggccttcagaaagggcgggaatatgtggttcaggcggcatccgtccgaaaagaggaagacggcggcacgcgccgcctccagcccgacgttttggtcaacctgcccgacaacaagcagattgtgattgattccaaggtctcgctgacagcttatgtgcgctacacgcaggcggcggatgcggatacggcggcacgcgaactggcggcacacgttgccagcatccgtgcacacatgaaaggcttgtcgctgaaggattacaccgatttggaaggtgtgaacacattggatttcgtctttatgtttatccctgtcgaaccggcctacctgttggcgttgcagaatgacgcgggcttgttccaagagtgtttcgacaaacggattatgctggtcggccccagtacgctgctggcgactttgaggacggtggcgaatatttggcgcaacgaacagcaaaatcagaacgcactggcgattgcggacgaaggcggcaagctgtacgacaagtttgtcggcttcgtacagacgctcgaaagcgtcggcaaaggcatcgatcaggcgcaaagcagttttcagacggcattcaagcaacttgccgaagggcgcgcgggaatctggtcggacgcgccgagaaactgcgtctgttgggcgtgaaggcaggcaaacaacttcaacgggatttggtcgagcgttccaatgaaacaacggcgttgtcggaatctttggaatacgcggcagaagatgaagcagtctgacttgtgcggaaaaatattgtttcagccggggcgggaatgccgaaagcgcggcgtaactgtactggttctgattttgggttttttgtttgaagtacttaccaaagccttgtccggcgaggtacaccggcaaggcggcggttgtctgagccttttgtgtttcagacggcatcagtgcagatgatgccgtctgaagaccgtagggaaggcggttagaaaaacggattgtgccgcttttcgtgtccgatggaagtcatacgcccgtgtccggcgacaacttgcacggtttcgggaagggtgaataatttgttgcggatattattgattaagtcggcgtggttgccgcgcggaaaatcggttctgcctatggtttcgtaaaacagcacgtcgcccgcaatcagcaattccgcctcggcacaataaaagacgatatgtcccggcgtatggcccggaatatgcagcacttgaaaggcatagcgtccgaccgtgagcgtttcgccttcttcgagccaacggttcggcgcaaaggcgggcgagacgggaaatccgtattgcgcggtggtttgcggcagcgattggagcaggaattcatcgtccggatgcggcccgaggacagggactttatgcgttttcaacatttcgaccacgccgcccgcgtgatcgagatggccgtgcgtcagccagattgccgtgagcgtaagtttgcggtttgccaacgcttgcagcaggaacggcacgtcgccgccgacatcggtcaggacggcttcgccgctttcgtcgtcccaaatcagggtgcagttttggcggaagggggtaacggggaagatttcgtaacgtagggtcatcggcgtgttcctaaacggtttttcagacggcatcgggtttgccgtttgttttatggcggtttgccgcccgttttgatattgggggaatcagatgattaagaagacaatcggcggcatcataccgatttttacggcggttttcatccctgcatcagcaggcgcggcggatttgatgctggcgcaggaatacaaagggcaggatattgccggctgggcgatgagcgagaaactcgacggcgtgcgcgcctattgggacggaaagcacctgatgagccgtcagggctacgcgtttgctccgcccaaaggttttaccgctcagtttccgccttatcctttggacggcgaattgtatagcggacgtggtcagttcgagcagatttccgctaccgtgcgttctgtttcttcagactggcgcggcatccgcctgcacgttttcgatgtacccaaggcgcagggcaacctctaccaacgtttggcagtcgcaacgcagtggctgaaaacgcatccgaacgcgccgattaccatcatcccgcaaatcaaagtgcgcgaccggcagcacgcgatggactttttaaaacaaatcgaagcgcagggcggcgaaggcgtgatgctgcgtcagcccgaatcccgttacagcggcggcaggagcagccaattattgaagctgaaaagccaatacgacgacgaatgcacggtaacgcggcactatgagggcaaagggcgaaacgccggacggctgggcgcggtcggctgcaaaaaccggcacggcgaattccgcatcggcagcggtttcaaagataaagaccgcgacaacccgcccaaaatcggcacactgattacctaccgttaccgtggctttacgcggaaaggcacgccgaaatttgccacatttgtgcgcgtgcgtaccgaccgctgagcaggacagttcagacggcatccgatactttggtttataattttccttttaccgaccgattccgacatatgaccgatttagaaaccaaacgccttgaaacacaggcgatgcttgaaaacgccgatcttttgttcgaccaaggccaatgccgtgccgcactgcaaaaagtggcggacgagattacgcgtgatttgggcggcaaatatccgctgctgctgcccgtgatgggcggcgcggtggtgtttacggggcagttgctgccgctgttgcgttttcccttagattttgattatgttcacgtttcccgttacggcgacaagctggagggcggcgcgttcaactggaagcgtatgcccgatgcggaacaaatccggggcaggcacgtcgtcgtgctggacgatattttggacgaagggcatacgatgtccgccattcaagccaaacttttggaaatgggtgcggcaagctgccgtgcggcggtgttcgccaacaagctgattgacaaacccaagcctatccgagccgattatgtcggactggatgtgccgaaccgttatgttttcggttacggcatggatgcggcgggctgctggcgcaatctgggcgagatttacgcattgggcggaaaataagggcgcgatgccgtctgaaggctgttcagacggcatcgcggccatacgccggcaggataatgaggaacaggacgcataatatgatagggcttttaatcatcacacacgaaaccataggcgaagcctaccgcaagctggcgcatcatttttttccgggcggactgcctgaaaacgtccgcatactcggcgtgcagccgacggaagaccaagacgacatcaacaacaacgccattgccgcgcttcaggaatttcccgacaacgacggcgtgctgattatgaccgatattttcggtgcgaccccctgcaatgccgcccgccgcctcgtgcgcgaaaacaaatcggcgattttgaccgggctgaacgcgccgatgatggttaaggccgtccaatattcgccggcggcggaagaccttgccgcctttaccgaatgcgtcagggaggcggcggtaaaaggcattttcgccatcacgtccgcgcccgaagatttggtgtgccggcgcagcggcgatgccgtctgaagaagcggcagggcaggaaaacattttaaacggcgtctgctgccgatatacataacacgggaatcgaaatgctcaaacaatccatcgaaatcatcaacaaactcggactccacgcccgcgcgtccaacaagttcacccaaaccgcgtcccaattcaaaagcgaagtctgggttacgaaaaacgacagccgcgtcaacggcaaaagcattatggggctgatgatgctcgccgccgccaagggtacggtcatcgaactggagacggacggcgcggacgaggcggaagcgatgcgcgccctgaccgacttaatcaacggctacttcggcgagggcgaataatgagtatcgtgctgcacggcgtggcggcgggcaaaggcattgccgtcggttgcgcccacctgattgcgcgcggtacggaggaagtgccgcagtatgatgttgcggaggcggacaccgatgccgaagccgaacgtttcgatgccgccgtcaaagccacgcgcaaagagttggaacagctccgcagcgcgattcccgaaaacgccccgaccgagttgggcgcgttcatctcgctacacctgatgctcttgaccgatgttaccttgtcgcgcgaacccgtcgatattttaagggaacaaaaaatcaacgccgagtgggcattgaagcagcagagcgacaaactcgccgcccaattcgacaatatggacgatgcctatttgcgcgaacgcaagcaggatatgctgcaagtcgtccgccgcatccacaacaacctgatcgggcagggcaacgagttggaagttgccgacaacctgtttgacgaaaccgttctgattgcaaacgacctttcgcccgccgacacggttttgtttaaagagcagcgcattgccgccttcgttaccgatgccggcggccccaccgggcatacggcgattttgggcaggagcttggacatcccgtccgtcgtcgggctgcacaacgcgcgcaaactgattaccgaaggcgaaacggtcattgtggacggtatcaacggcgtgttgattatcgcgccggatgagtcggtgttgaacgaataccgccgccgtgcccgcgaataccgcagccacaaacgcgatttgaacaagctcaaaaaaaccgccgccgccaccgccgacggggtctgcatcgagcttgtgggcaatatagaatccgccgaagacgtgaaaccgctgcacaacctcggcgcagacggcatcgggctgttccgcagcgagtttctttacctgaaccgcgatacgatgccgtctgaagacgagcagtacgaagtgtacagcgcgattgtcaaaaaaatgaaaggcaaaagcgtaacgatacggacagtcgatttaggtgtggacaaaaacccgcgctggttcgggaaaaacagcacgcccaacggcagcctcaaccccgcgctgggcatgaccggcatccgcctgtgccttgccgaaccggtcatgttccgcacccagatgcgcgccatcctccgtgcggcggtacacggccccgtgcggatgatgtggccgatgattacctccgtatccgaagtgcgccagtgcctcatccacctcgacaccgcgcaacgccagcttgccgaacgcggcgatgccttcggtaaagtcggcatcggctgtatgattgaaattccgtctgccgcgctgaccgtcggcagtattttgaaactggtcgatttcatctccgtcggtaccaacgacctgattcaatacatcttgtccgtcgatcgcggcgacgacagcgtcagccacctctaccagcccggccatcccgccgtgctgaaaatgctgcaacacgtcatccgtaccgccaaccgcatggacaaagacgtatccgtatgcggcgagatggcgggcgataccgcgtttacccgcgttttattgggtatggggctgcgccgtttttccatgaaccccaacaacatcctgcccgtcaaaaacatcattctgcacagcaatgtcggacagctcgaaagtgatattgtgaaagtcatccgctgcgaagacgaagagaagtcggaaaagctgatcaaacagatgaacagcgtgtctgtcgaggaagaagccgacttcaaggggcggaaataaatacggcaggtaaaaaatagaaatacttaacaatgcccgcaatctgaaattttgccattcttgcaaaatagaaaaccgaaacagaaacccaaaatcggccattccctcaaaaacagaaaaccaaaatcagaaacctaaaatccgtcattcccgcgcaggcgggaatctaggtttgtcggcacggaaacttatcgggaaaaacggtttctttagattttacgttctagattcccgcctgcgcgggaatgacgatgaaaagattgttgtcgcttcggataaatttttgccgtgttgggttctagattcccgctttcgcgggaatgacggcagagtggtttcagttgctctcgataaatgccgccatctcaagtctcgtcattcccttaaaacagaaaaccgaaatcagaaacctaaaatcccgtcattcccgcgcaggcgggaatctaggtctgtcggcacagaaacttgtcgggaaaaacggtttctttagattttacgttctagattcccgcctgcgcgggaatgacgatgaaaagattgttgtcgcttcggataaatttttgtcgcgttgggttctagattcccgctttcgcgggaatgacggcagagtggtttctgttgctcccgataaatgccgccatctcaagtctcgtcattcccttaaaacagaaaaccgaaatcagaaacctaaaatcccgtcattcccgcgcaggcgggaatctaggtttgtcggtgcggaaacttgttgaaaactttgcaaaatcccctaaattcccaccaagacatttaggagattttccatgagcaccttcttccagcaaaccgcacaagccatgattgccaaacacatcaaccgcttcccgctattgaagttggatcaagtgattgattggcagccgatcgaacaatacctgaaccgtcaaaaaacccgttaccttcgagaccaccgcggccgtcccgcctatccgctgctgtccatgttcaaagccgtcctgctcggacaatggcacagcctctccgatcccgaactcgaacacagcctcattacccgcatcgacttcaacctgttttgccgtttcgacgaactgagcatccccgattacagcaccttatgccgctaccgcaactggctggcgcaagacgacaccctgtccgaattgctcaaactgatcaaccgccaactgaccgaaaaaggtttaaaagtagagaaagcatccgccgccgtcattgacgccaccattattcagaccgccgacggcaaacagcgtcaggccatagaagtcgatgaagaaggacaagtcagcggccaaaccacacggagtaaggacagcgatgcgcgttggatcaagaaaaacggcctctacaaactcggttacaaacaacatacccgcaccgatgcggaaggctatatcgagaaactgcacattatagtagattaaatttaaatcaggacaaggcgacgaagccgcagacagtacagatagtacggcaaggcgaggcaacgccgtactggtttaaatttaatccactatattatgcgcaaagcctgccgcaaccgtccgctgacggaggcgcaaaccaaacgcaaccgatatttgtcgaagacccgttatgtggtcgaacagagcttcggtacgctgcaccgtaaattccgctacgcccgggcagcctatttcggactgattaaagtgagtgcgcaaagccatctgaaggcgatgtgtttgaacctgttgaaagccgccaacaggctaagtgcgcccgctgccgcctaaaaggcgaccggatgcctgattatcgggtatccggggaggattaagggggtatttgggtagaattaggaggtatttggggcgaaaatagacgaaaacctgtgtttgggtttcggctgttgtgagggaaaggaattttgcaaaggtctcagattgttgtcgcttcggataaatttttgccgcgttgggttctagattcccgcttttgcgggaatgacggcagggtggtttcagttgctcccgataaatgccgccatctcaagtctcgtcattccctcaaaaacagaaaaccaaaatcagaaacctaaaatcccgtcattcccgcgcaggcgggaatctaggtctgtcggcacagaaacttgtcgggaaaaacggtttctttagattttacgttctggattcccgcctgcgcgggaatgacgatgaaaagattgttgtcgcttcggataaatttttgccgtgttgggttctagattcccgcttttgcgggaatgacggcagggtggtttcagttgctcccgataaatgccgccatctcaagtctcgtcattccctcaaaaacagaaaaccaaaatcagaaacctaaaatccgtcattcccgcgcaggcgggaatctaggtctgtcggcacggaaacttatcgggaaaaacggtttctttagattttacgttctagattcccgcctgcgcgggaatgacgatgaaaagattgttgttgtttcggataaaattttgcagccctgataaaaaaatatggctgctttggtaaaaaaatgccgtctgaaaggttttcagacggcattttgtttttaagaagcatcagcggaagcggacgatttcccgttcttcgatatggatgcgtaccgtatccttgcccgataccgccccggcgtgccgcatatcgaggttcagccacaggatgccgtgttccggatggaggacggacaggctgaacgattcgggcaaacaggtacgggataatacgcggcactccatgccgtcttggtcgaaacgcaccgcatgttgcggaatatggcggttatcgtcggtattgggcaaacccatcagtcgggcgacctgcacgcaggatggtgttttgaccaatgtttcgggcgtaccgtattgtagaatcctccctttatgcatcacggcgatttcgtctgccgtcgtacaggcttcttcgggcgaatgcgttaccaaaacggcagggatgccgccgtttcggatacgttcggcagtcatacggcgcagcgtgccgcgcaaatgcgtgtccaaactggaaaacgattcgtccaacagcagcagggaagggcggacaaccaaagcgcgcgccaacgccagccgttgcttctcgcctccggaaagtttttcaggcttgcggtgcgcctcgttttccagtccgacttcggcaagtgccgccatggcgaggcgttcggcttcggctttcggcattttttgcattttcaaaccgaatgccgcattttccagcgcactcatatggggaaacagcgcgtaatcttgaaacatcagcgagatacggcgtttttcgggcggcatacgggtaatgttttctccgttcagccatatttccccgccgtccggccggacaatccccgcaattatattcagcagggtggattttccgcagcccgaccgccccaaaacggcgagtattttgccgcgcccgacagtcaggcagatgttgtcggcgacggttttattgccgaagcgtttgcagagtccgttcagttcaagcatggcgcatcctataaacgtatgccgtccagccactcggacagcggatgggcggcatcaatcagaccgtaacggcaaaacgcgtccagcgtaaccagttgcgcgtcgtgcatcatgtttcccgacaacatggcatccaacagaccgccgatgtccattttctcaaaacccgccacttcgccatcctgattttcaggcaggaaggtttcgggcaggacggcatcgaatacatacaggatttcattgtgtacaccccggctgacggagcgcaggctgtgcagctgcgataccgggcggatgagcggaagcagcgttttatccaaaccggcttcttcgctgctttcgcgacacacggcttcagacggcatttcgccgccggaaacaccgccggcggcagtattgtcgagtttgttgggatcgactgctttgtgcggactgcgcctgcctatccagaaatgccatcggccgtccgattcggtcagaccgttgagatggacggcgcggctgagcagtccgaaaggacggaaagcggcgcgttcgagcgtgaacaaggggttgccgccgccgtcggtcaggtcgaaacactcgttgcgccagccgtccaacagccccgcacagtgccaaccgagggcgaggtgctgtaagcgtccgcccatatcaggccagccgtccgcattcagaaaaatgccgtctgaagactccgagcagcctgcctcccagtcttttttgacgcgttccacccattccggcgacaggttgcccaaaggcagaccgttcagatacagcgttttccagcaactttctgcaccgtaacttgcttttgcccactcgaacagagcatcaaggtcttgtttgctgacggattcggtaaaacggacggtcggcatggttggctttcttgaagacaatgcggaagattgtagccaaactgcctgaatttgcaaccgcaaacagacggcggtctgccgttccgatattgcggccggaaggaaaatccggcaaaaaacggaggcggcaggaaacaggaaacaggaaacaggcaaaacaaaacccctcggcattgaaccgaggggtttgatatttggttgcgggagcaggattcgaacctacgaccttcgggttatgagcccgacgagctaccatgctgctccatcccgcgtcagaagatgaaactatacggcagattttttatgttgtcaaacattacttccgcgaaaaatcataaaattttgccgtccggcggtttatgcctgatttgaaatattattttctttacaaaagttcatgttcgtgatttaattttggttaacattgaaacaggggtgctgcctgatgtttaggcggctgagaaataccctttacacccgatcgggataatacctgcgtggggagttttcacggattctgcttttcagacggcattggttttcaaatgccgtctgaaaacgcaaaacgctcctgtttctttaattctaaacgagaaaacaggagcatttttttatgactacgccaaaaaaaaccgccaaaacttccggcaacgaagcgcgcgagcttgccgacttgagcgaagacatcggcatctgctttaaatatccgaactcggaacgcgtgtatctgcaaggcagccgcgacgacatccgcgtgcctttgcgcgaaatccgtcaggacgacacctacacggcgcaaggtacggaagccaatccgccgattcccgtctacgacaccagcggcgtgtacggcgacccggcggcgcatatcgacctgaaacaaggtctgccgcacatccgcaccgcgtggctggacgaacgcggcgataccgaaatcctgcccaagctctccagcgaatacggcatcgaacgcgcacacgatccgaaaaccgcccatctgcgtttcaaccaaatcacccgcccgcgccgcgcgaaaagcggcagcaacgtaacccagcttcactacgcgcgccaaggcattatcacgcccgaaatggagtttgtcgccatacgcgaacgtttaaaattagacgaattgtcccaaaaaccggaatacgccaaactcttggaacagcacgcggggcaaagtttcggtgcgaacatcccgacccatcccgaccaaatcacgcccgaattcgtgcgccaagaaatcgccgccggacgcgcgattattcccgccaacatcaaccaccccgaactcgaaccgatgattatcggccgcaactttcgtgtcaaaatcaacggcaacttgggcaactccgccgtcacctccagcctgaccgaagaagtcgaaaaaatggtgtggtcgctgcgttggggcgcggacacgattatggatttgtccaccggcgcgcacatccatgaaacgcgcgaatggattatccgcaacgcgcccgtccccatcggcaccgtgccgatttaccaagcgttggaaaaaaccggcggcatcgccgaagatttgacttgggatttgttccgcgacaccctcatcgaacaggcggagcaaggcgtggactatttcaccatacacgcgggcgtgttgctgcgttatgtgccgatgaccgccaaccgcctcaccggcatcgtctcgcgcggcggttcgattatggcgaaatggtgtttggcacatcatcgggaaaatttcctctacacgcatttcgacgaaatctgcgaaattatgaaagcgtatgacgtatcgttcagcctcggcgacggcctgcgccccggctgcattgccgatgccaacgacgaatcccaattcgccgaactgcacaccttgggcgaattgaccgataaagcgtggaaacatgacgtacaagtcatgatcgaaggccccggccatgtgccgctgcaacgcgtcaaagaaaacatgaccgaagagctgcaacactgctttgaagcacctttttacacgctcggcccgctcgttaccgacatcgcacccggctacgaccacatcacctcgggcataggcgcggccaatatcggctggtacggcacggcgatgctttgttacgttaccccgaaagagcatttggggctgcccgacaaagaagacgtgcgcaccggcatcatcacctacaaactcgccgcccacgccgccgatctcgccaaaggctggccgggcgcacaattacgtgacaacgccctgagcaaagcgcgtttcgagttccgctggcgcgaccaatttcgcttaagcctcgaccctgaacgtgccgagagcttccacgacgaaaccctgcctgccgaaggcgcgaaaatcgcccacttctgctcgatgtgcggccccaaattctgctcgatgaaaatcacgcaggaagtgcgcgactacgccgacaagcaaaaagcccaacggcagggcatggaggaaaaagcggtcgagttcgtcaaaaaaggcgcgaagatttacagttaaacgtcaagcaaaaaatgccgtctgaaaaccggaaaaaaggcttcagacggcattctttcgcttgtgaaaatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataatttttaaaatttttatattcacatagatggggatgatgggatttaggattctgattttgtttttgagagaatgaaggaatttgagattgtgggcgattatcgggaaaaatagaatctttccgccgtcattcccgcgcaggcgggaatctagacattcaatgctaaggcaatttatcgggaatgactgaaactcaaaaaactagattcccactttcgtgggaatgacgggattaaagtttcaaaatttattctaaatagctgaaactcaacgcactggattcccgcctgcgcgggaatgacgaagtggaagttacccgaaacttaaaacaagcgaaaccgaacgaactagattcccactttcgtgggaatgacggcagagcggattctgttgctcccgataaatgccgcaacctcaaatcccgtcattcccgcgcaggcgggaatctaggtctgtcggtgcggaaacttatcgggtaaaacggtttcttgagattttgcgtcctggattcccactttcgtgggaatgacgggattaaagtttcaaaatttattctaaatagctgaaactcaacgcactagattcccgcctgcgcgggaatgacggcatattttgacattgaataaaaaagactaaaaacaggaaaaagccaaacagaaaaaagccaaacagaaaaaagccaaacagaaaacagcgaaacagaaaacagcgaaacagaaaacagcgaaacagaaaacagcgaaacagaaaacagcgaaacagaaaacagcgaaacagaaaacaggaaaaagccaaacagaaaacaggaaaaagccaaacagaaaaaagcctgtctggcgacaggctttttgttgataccaatctttgcagattagaatttgtggcgcagaccgacaccgccggcagtcgctacgaatttgttttcgcctttgccttcttgcaaccaaccggcagaaaccaaggcagaagtgcgtttggagaagtcgtattccgcaccgacaaccacttggtcgtattcgttgcctatgtctgcatcatcaaccaaacctttgaagccgtgggcgtaagaaactcggggcgttacgttgccgaagcggtatgccaaggtagcggcaacttcggtttgagagttgtgcgaattggaagcatcagtcagtttcgcgtcttgttgctgtacggctacggaagcgtacagggcatcattgtcgtaaccgctgaccaaacggtgaatctggtatttctcaatattcaagccctcttgcacttgatgatgtcttttataggcaccgccatattgcacgaagaagccaccgtttttgtagttgaagccggcgtggtaagattcgctgttatgtctgcctgcattgtcgttaagcgcgtattgtacgctgccgctgaggccggcaaattcgggagaatcgtagcgtacggaaatgaggcgtgcctcgggttcggcaattttgtttacacccaaatagtcgcttttgctatcccaaggattgatgtcgccggtgtctttcaggacgctgttcaaacgaccgacgcgcaatttaccgaagccgcctttcaagccgatgaaggattggcggttgccccaaccggagtcagtaccggcgatagatgctttttgctcaacctgccaaatggctttcaggccgttaccgaggtcttcttggcctttgaagccgattttcgaacccaaatcaacgatgccggtagcggttgtaacttcagtaacttggccgttctggtgaaatacagagcgggaagtttctacgccggctttgatggtgccgtacagggtaacgtcagccattgctgcaacaggaagggctgccaaagtcagggcaatcagggattttttcattgctgtattccttttttggttaagaaatttaagccggccgggctttccaagccgcttagctttgcatttaccgccgacgttttcggcgattccatgtctgaaactatagatgttcctgtctgaaaaaacaaacttctgcctgtttttgtgtggaattcgatgtgtattttgaagggcggatagagatattatgggtattttttgttttataacatatggttatttaaattttttaagatttgcatttttacaacacttactcgggagggtattggagggcattgcaaaccgggggttataaagacggcaaaaaacgcgcacgtggtttctttcggaacgggcggatgcaaaacccgcccctgcggcaggagatagtggattaacaaaaatcaggacaaggcgacgaagccgcagacagtacaaatagtacggaaccgattcacttggtgcttcagcaccttagagaatcgttctctttgagctaaggcgaggcaacgctaaccgtcattcccgccacttttcgtcattcccgctcaggcgggaatctagaatctcggactttcagataatctttgaatattgccgctgccttaaggtctggattcccgcctgcgcgggaatgacggctgcagatgcccgacggtctttagagtggattaacaaaaatcaggacaaggcgacgaagccgcagacagtacaaatagtacggaaccgattcacttggtgcttcaacaccttagagaatcgttctctttgagctaaggcgaggcaacgctaaccgtcattcccgccacttttcgtcattcccgctcaggcgggaatctagaatctcggactttcagataatctttgaatattgctgttgttctaaggtctagattcccgcctgcgcgggaatgacgaatccatccgcacggaaacctatatcccgtcattcctacgaacctacatcccgtcattccctcaaaaacagaaaaccaaaattagaaacctaaaatcccgtcattcccgcgcaggcgggaatccaaacttgtccgcacggaaacttatcggataaaacggtttcttagattccacgttctagattcccgcctgcgcgggaatgacgaatccatccgcacggaaacctatatcccgtcattcttacgaacctacatcccgtcattccctcaaaaacagaaaaccaaaattagaaacctaaaatcccgtcattcccgcgcaggcgggaatctaggtctgtcggtgcggaaacttatcgggtaaaacggtttctttagattccacgttctagattcccgcctgcgcgggaatgacggctgcagatgcccgacggtctttatagtggattaacaaaaatcaggataaggcgacgaagccgcagacagtacaaatagtacggaaccgattcacttggtgcttcaacaccttagagaatcgttctctttgagctaaggcgaggcaacaccgtactggtttaaagttaatccactataatgaacacaatccattcagactattcaatcaggcaaacatctcctgcaatactgcaaacagtttttcagccgtactgttgtctaaattgccaagatgtttgaccaatccggctttatccacagccctaatctgttcgggcaaaagcaaaccgtctttatcctgaaagcggacattgacgcggaacggggcaggacggcttccgctcgtcatgggaacgatcagcacagtcttgagatagttgtgtatttcaggaggagagactacgacacaaggacgtgtctttttgatttcgcttcctacggtcgggtctaaggagaccagatagattccgccgcgtactaccatatccattctttatccgcttcgttttcaatttcggaaaaaaaatgctcctgctcggtttcgacaagcattgcggcagcttctgcccatcccctgcgaacggtaggacagcttaaaataatattgcccttttcaactgtaacagccaagctgtctactgcccctatttgacccaataatgatttgggcagaatcacgccttgcgagtttcccattttgcgtatgttgagaatcatatacgtaccatattcacctgtttatgtaataacaatgttagtaccttgatgaggtagtgtcaacatggaaaaagattgcctgacagtttgtccgatttcaaaatctccgcgacaagcatgttttaaagccattcggggatttgggggcggatgatgccgtatgcctcgggatagtcgacgccggtcaggtaaagtccgtcgggcatgaaggtcggcggggctttgaggcggctgcgttcttgaatcagtgcggcgaagccttcgacgctgagtctgccgctgccgacataaacgagcgcgcccatgatgttgcgtaccatgtggtgcaaamaggcgttgccgtgcaaatcgaggcggacgagtcctgagctttgggtaaggttcggcgcggtagatggttttgacgggggattttgcttggcattcggcggcgcggaagctggagaagtcttgttcgccgaccaataaggcggcagcctgccgcatctgcccgatgtcgagtttgaggtgtgtccagcctgccctgtttttgagcaggggggaacggacgggggcggattcgagcaggtagcggtagtgccgtccgtatgcgtcaaatcgtgcatgaaattcgggggcgacctgtcgggcgtgcaaaacggcaatgccttcgggcaggtgggcatttacgccgcgcacccatgcctgttggggacgggcggcagttgtgtcgaagtggacgacttgggcggtggcatgcacgccggtgtcggtcctgccggcaacggtggtggaaaccgcttcccctgctatttgggcgagcgcggtttccaatgccgcctgaacggtcggtacgccgtcagcctgtttctgccagccgtaaaagcggctgccgtcataggatagggttattgcccagcgttgtttttgtgcggtatccatcggatttgggattcggataaatgttcagactgcattgtatcgcagattttgcagggaaacggcaaacgcccagggcgagcggcgttgtttggggagttgttgggggggggggatgcagttgctacgaatcgctatcctgtgaatttaccctgtcaggagtgcccgaatcgtcattcccgcgcaggcgggaatctaggacgtaaaatctaaagaaaccattttatagtggattaacaaaaaccagtacagcgttgcctcgctttagctcaaagagaacgattctctcaggtgctgaagcaccaagtgaatcggttccgtactatttgtactgtctgcggcttcgtcgccttgtcctgatttttgttaatccactatatccgataagtttccgcaccgacaaaactagattcccactttcgtgggaatgacgggatgcaggttcgtgggaatgacgcgaacagaaacctcaaatcccgtcattcccgcgcaggcgggaatctagaccttagaacaacagcaatattcaaagattatctgaaagtctgggattctggattcccactttcgtgggaatgacggaatgtaggttcgtaggaatgacgggatgcaggtttccgtatggatggattcgtcattcccgcgcaggcgggaatctaggtctgtcagtgcggaaacttatcggataaaacggtttctggagatttttcgtcctggattcccactttcgtgggaatgacgcggtgcaggtttccgtatggatggattcgtcattcccgcgcagtcgggaatctagacattcaatgctaaggcaatttatcggaaatgactgaaactcaaaaaactggattcccactttcgtgggaatgacgggatgcaggttttcttaaccccgcgttctagattcccactttcgtaggaatgacggcggtagatttggcagatgcggcggattcggcaggtctcaacccatcctacaatccaccctgaccgccttttacgaatccgccgccatcctgggaaacgcaaaaaaaatgccgtccgaaaacctttcagacggcattttcgcgggcaaatcagtaaaagacttcgcgtcagcttaagcgtttcataccgcacgtcggaccgggcgggtttcgggtttcggaagagcggtgtgaaatgaaacgcggcagacggcgtgtgtgccgccatcctgccccgaaccggcggcaaagcgtcatcgcggtttgaatcgggcgggcgcgtgcctgttccggcacggatgccgtctgaaagcggcgggtcggtccggtccgcgtcagcctaaggcgaaaagttccctgccgtggattttgagccactgtttcgctttgggcgtgtagggggcgaagcggcgggtcagttcccaaaaggcggggctgtggtcgggatgggcgaggtggcagagttcgtgtatgcagacatagtcggcaacgtattccggtgcgccgaccagccgccagttgaagcgtatgcctgtggttttgcggcacacgccccagaaggttttggcagaggtcagcgaggaggaggcggggaacagttgtgtggtgcgggcgtggcgttcgaggcggggaatcaggtaactgtgcgcctgccgttccaaaaagtcccgcagcagcgcaagctgtttttcgggtgcgccttcgggaacacggatttcagacggcatcagcaggatttgcgtgtcttgatgggcggtgagggcaagctgtctgccgtggaagaggatggattcgggcagccggttttcggcagtttgcggcggcggtgttttcgccagtgtttgccgcaggacggcttcgttttcatacagccagcggtttagagcggagacggagaagcagggtgggacgctgatgcggacggtatgtgtgccggcggggcggataatcaggtttttcttggcacggcgcttgatttcgacggtcagttccatgccgtctgaaagggtgtggacaaaggcggtcatgcggtttcagacggcattttggcggcaaacgggcctgcgccggaaataagcggttgttgcgtttcgatgagatgttcgcatttttccatcaattcggcttcgctgccgcttgcgtgcgggatggtcggacagatgacgacggtgatttcccccggatatttcagaaaggagtttttcggccaaaattcgccgctgttgagggcgacggggacgatgtccatctcaaacattttcgccatgcgcgcgccgccgagtttgtatttgccgcgttttccgggcgcaaggcgcgtgccttcggggaaaatggtaatccaatagccttcgtttttgcgcaccaacccctgttttatgagctgctcgttggcttcgcggcggttgttgcggtctatgcctatggttttgaccagtttcaagccccagccgaaaaaggggattttgaacaactcgcgtttggcaacgtaaacctgcggcggaaaaatgtcctgaagggcgagcgtttcccagccgctttggtgtttggcgcagatgacggcggggcggtcggggatgttttccgcgccgatgatgcggtatttgagcccgacgatgtgtttgagcgaccagttgagaatgccgacccagacccgcgccatcttgtgcgccccgtcccggaaaggcgaggcgagcagcataaagggaaagaggaaaatcagggtggaacagagtatcagccagtaaatcaggttgcggatgatgagcatggttttgccttgtcggaatgcggtatgttcagtcggcttgcggtgcggtgttttcctgcatgatgtattgtgagaaatcgagcagggtatcgaaaacctgtgtgtgttcgggcaattcgtgtccgtgttgggagagcgtttttttgccttttccggtcagaaccagcgcgggtttgccgccgacggcatcgattgcctgcaaatcgcgcaggctgtcgccgaccagccaggtttccgaggcttgggcgttgaagcgtccgatgatgtcttcaatcatacccggtttgggcttgcggcagttgcagttgtcggcatcggtgtgcgggcagaaccagatgccgttgatttcgccgcctgcctgacggacgaggcggtgcattttggcgtgcatttcggtaaggttttgaacggtaaaatatttgcgcccgatgccggattggttggtggcaacggcgacggtgtagcctgcctgcgtcagaaatgccaccgcatccatgctgccttcgacaggtatccactcgtcaacggatttgacgaagtcgtcgcggtcctgattgatgacgccgtcgcggtcgagaatgatgagtttcatcgcgtttcctttggattggggcaggtcgggggtggcattatactgaaatatcggtggaaatgcgcctgtgccgcgcgataacgcgcctgttccggcaaccgcttgcaatgcgcgggtacggcgtttcgggggcggttgccgatgttttcctgcctgctcctgcaacggcggattttctgccggacgtattttccgctgcaaaagtctcggcgcggaagttgcggggcaatgccgtttggggacgcggtcaggcggcaagcatttcaagaatcagcccgatgtgtttgtctaaagccgggttgtagttcagtgcccgcatcgggtcggacaggcggtgtccgccctgttttttaaggctgacggcttgggcaacggcttgcgccagggtttccgggttttggcgtgagaaaaagaagccggcttcttcgttcatgacctctgtacatgccatgttttcggagaggacgacgcgtgtgccgcataggacggattcgacgccgaccagcccgaagggttcgtacagggaagccataatggtaaagtcggcggcgcggtagagttcgggcatatcggtgcagaagcccagtccgacgacgtttttcatagggcggggaagcggggagccgacaacggcgagcttgacgggcaggctggtatgttcgaaaaagtcggcaagcagttccagacctttgcgcgtgtggccggtcgatgggaacaggaaaacggtttcatggtcggcaaagccgtatttggcgcgcaggtcggcagtttctccgggttgtggaaagaagcgttccgtatctgcggggggggggggcgacttggattctttcagggggaacgccgtacagtccgaccagttcgcgccgcatcatatgggaatgcgccataatcagtttggcggtggcgtagttgctgcggttgcggcgtatggcgaggcggtcgagcaggttcggtttttgcgccatatggtgcaggtagcccaagtgtgtgccgccgcagatgaggaggtcggcgtaatcggcgtggtggcaggcaatcagtttggcggcactgttttttctggtttgagcgagccggcttgaaaagaggaatgagcgtagttttttcagcgtccggtgttgatcgacaagatggggttcgattagggcgtattcaggaatgctgtgatcaaatttcgtcgcataaacggccggtgtgatgttttgtctgttcagaccctttaccaaatccaatgtgtagcgttccgtgccgccgccgtgtttgaagttgttggttgcaatgtctattttgagcttcatcattgttcctttatggttgcgtcccggtttgtcggggcgggatttgtgcgtgaggggcagggtaatgcgctgtgtgccggaatacggttgccgtttgttgcggcaatgccgtctgaagccgccggcgggcttcagacggcattttgcctttatcctttaaatacggggacgagttccatttggctcaatacctgtgcggcgatgttgacgatgccgaaaaggaagacccaaaccatcagccacaagccgccgtaaactttataggttttgcctgcgccgaattttttgcgcgaacggtagagcagcatggcggggatgatgcctgtccagacggttgccgccaggccgacgtagccgatggcggtaacgaagccggtggggaagagcaggcaggaaatcaggggcggcaggaaggtcagcgcggcggttttggtgcggccggagatgctgtcgttccatttgaagatgtcggcgatgtagtcgaagagtccgagcgttacgcctaaaaacgaggtggcgatcgccatataggaaaacagggacaatattttgtccatattgccggtttgggcgaatttggacagggtttcgatgaggacggagacttgcccttcggcggcgatgacgggggcgaactcgttgcgcggcaggttgccttggatggcggtttgccagaggacgtaaattaccagcgcaatcagtgtgcccgtccagatggatttagccactttgggcgcgtcgcctttaaagtatttgagcaggctggagacgttgccgtggaagccgaaggaagcgaggcagacgggcagggcggtggcggcgtaaatccagtagtttgtgccggcgggggcttgggtatcgaagaggacggacggcttggcatcggcaatcagcccgccggccgcccaaataaaggtcaataccatgccgccgataaggacgccggtgaagcggtcgaccaagcgtgcggatgcccatacgcaaaaggcgaggatgccgaagaagacgagttgtccgacggtgagtgaaacgtcgccgcctgccgcgctgcctaagcctttggcggtcaggtcgccgccgacgaagatataagcgtaagtaagcaggtataaaacgaaggcgacggcgatgccgttgatgatgttccagccgcgtccgagcaggtctttgaccatcgtgtcgaaacttgcgccgtgcggataatgggtgttgacttccaaaatcatcaggccgctggaaagcatagaaaaccaggtgtacagcaacacggccagcgagccggtaaaccatacgccggatgtggcggtcgggttggcgagcatgcctgcgccgatgaccgtgccggcgataatcatcgcgccgccgaacagtgaaggggttttgttgggcatattttgtctttctgccagaaaaagcgagccgccattatgccgtaaagtgtaaggatttgtaaggtatttgcgccgcgccgcccgaaaaggctttcagacggcattgtgttccatagtataatcttgggttttggagtgggcggttcgtcagatgggagggaaaatgtccgacaaaaaatataatgtcgatgagggggaaatcgccaaattcagccggattgccgacaaatggtgggacaagtcgggcgagttcaaaaccttgcacgacatcaatccgctgcggctggattatatcgacggacacgcggatttgtgcggcaaacgggttttggacgtgggctgcggcggcggcatcttggcggaaagtatggcgcggcgcggcgcggcgtttgtaaagggcatcgacatggcggagcagtcgttggaaaccgcccgcctgcacgcggctttgaacaatgtcgccgatatcgaatacgaatgtatccgcgtggaagaccttgccgaggcggaaccgcactcgttcgatgtggtaacgtgcatggaaatgatggaacacgtccccgatcccgccgccatcgtgcgtgcttgtgccaatctggtcaaaccggacggcatggtgtttttttccaccatcaataaaaacccgaaatcgtacctgcatctgattgtggcggcggaatatctgttgaagtttgtccccaaaggcacgcacgactggaaaaaattcatcgcacctgccgagctggcgcgaatgtgccgtcaggcaggcttggatgtggcggatacgaagggtatgacttaccatgtgttgtcgcaaacttatgccctgtgcgattcgaccgatgtgaattatatgtttgcctgccgtccggcgttctgacggcgggtttgcccgtttttgagcaagtgagttgatatgtctgtctataccagtgtttccgatgatgaaatgcgcggcttcctgagcggttacgatttgggggaatttgtttccctgcagggcatcgcgcaggggattaccaacagcaattattttctgacgacgacttcgggacgttatgtgctgaccgtgtttgaagtgttgaaacaggaagagctgccgttttttctggagcttaaccggcatttgagtatgaagggcgtggcggttgccgcgccggttgcgcgcaaagacggccggcttgattccgttttggcgggtaagcctgcctgcctggttgcctgcctgaaaggttcggataccgcgctgccgacggctgagcagtgttttcataccggtgcgatgttggcgaaaatgcaccttgccgccgccgatttccctttggaaatggaaaacccgcgttacaatgcgtggtggacggaggcgtgcgcccggctgctgcccgtcctgtcgcaagacgatgccgcactgctgtgttccgaaatcgatgcgttgaaggacaatctcggcaatcatctgccttcgggcatcatccatgccgatctgtttaaagacaatgtgttgcttgacggcggtcaggtatcgggcttcatcgatttctattacgcctgccggggcaattttatgtatgacttggcgattgcggtcaacgattgggcaaggacggcggacaataagttggatgaggcgttgaaaaaggcgtttatcggcggttatgagggcgtgcgccccttgagtgccgaagaaaaggcgtatttcccgaccgcccaacgtgccggctgcatccgtttttgggtgtcgcgcctgttggattttcattttccgcaggcgggcgagatgacgtttatcaaagacccgaacgcgttccgcaacctgctgttgagtttgggttgagtgcgtccggcgtttgacagaaatgccgtctgaaagggtttcagacggcatttttatggctgattaaaacgaaaatgagacgatagccgggtattttccattttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttttgttaatccactataaatcaatgtaatccattctgttcccgatgtttatgccgtctgaaacccatcctgtgtcgggcttcagacggcatattgcttcaaagcaggttttccgaggcaacccagttcagaatatcggcttcgaccgcttcgggcgtgccggggttggcgattttgaccccgtattcgccttcgcccagttcctcgaggatttccagttgcgaatcgagcatccctgctttcatgtaatgtcctttgcgcgacatcatgcgctcgaggttgatgtcttgcggcggactgaggtggatgaaggcagctttgccttcggctccgcgcagaatgtcgcggtagccgcgtttgagggcggaacaggttacgatggtgtggttcgcaccgttttgcgcctgttgcgtcatccagtcgcgcagattgcccaaccacggatagcggtcttcatcggtcagcggaatacccgcgcccatcttgtcgcggttggcttgggtgtggaactcgtcgccttcggcatagggacattgaccgaggtgtttctgcagggacagcgcggcggtggtcttgccgcagccgcatacgcccataacgacaaaatgcgtagtcatttactatcctttccgtctgtcagacgatggcgaacagcagtgcggacaaggcaaagccgatgagtgcgatgagggtttggttgaccgtccaggttttcagcgtggtcggtacgtccatgtccaagagacggccgaccagccagaagccggagtcgttgaagtggctgcaaccgaccgaacctgccgccgttgccaatacgatacaggcgagctgccagtcggtaaagccggcggcggcaacggcaggagccatcagcgcggcggcggtggtcagggcgacggttgccgaaccttgcgcgatacgcagtgccaaggcgacaaggaaacagcccaaaaggacgggaatgcccaaatccgccatgctgtcggcgagtgccttgccgatgccggaagcgcgcaaaacgccgccgaacataccgcccgcgccggtaatcagaatcacggaacagacgggggcgagtgcgccgtccacggttttttccaacgcgctgccgctttcgccgcgtttgcgtcccaagacaaacagtgcgaccaatacggaaatcagaagggcgatcggtgtcgaaccgattatttttgccgtctgaacccaggtttcgtccgcacttacgagtttttcgctgatgagggccgatacgccggtattcaggaaaatcagcagcatgggaatcagcatgatggcgacgaccgttcctgctttggcaggttctttcggcaggtcgttgtcttgcgtgccgccgctgagcagttcgggaacgggaacatggatggtgcgccccaacactttgccgagcatatagccgctgaaataccatgtgatgaaggcggtcggcagacccaaaatcaaaacttggccgatgttcgcgccgtaaaattcggaagcggcaatcgggcccggatggggcggcaggaagacgtgcatgacggaaaatgcgccgatggaggcaagcgcgaagggcagtacgtcctgtttcatgcgccgtgcggtggcgaacacgatgggcagcatgacgattagtccggcatcgaagaaaatcgggaagccgaaaatcagcgaggcaacgcccagcgcgaacggtgcgcgtttttcgccgaacatccggatcagcgcgtccgccagcgactgtgcgccgccggatgtttcgaccaaacgtccgagcatcgcgcccaggccgaccagaagcgccacgccgccgagcgtgccgccgaagtttttgaccagtatgtcgttgacaatgctgcctgtgggcaaaccggttgccaaagccgtcagcaggctgacgatgaccagtgtcagcagcgcgtggatgcggaatttgacgattaaaatcagaatgaggatgattgccgccgccgaaatgcccaacagggtttgcgcggacagcgtctgtgtccagccgtccatttgtaaagcctttctctgtaataaaagtacaaaattgtcaggtttttttaagttgtgcgaaaacgatagcacaaatcgggcggtaagttgtttgtctgaagttatattcctgtttatttgaacgatttatagtggattaacaaaaaccagtacggcgttgcctcgccttagctcaaagagaacgattctctaaggtgctgaagcaccgagtgaatcggttccgtactatttgtactgtctgcagcttcgtcgccttgtcctgatttttgttaatccactatatttcagacggcgggaggaaggcggatacggtatgtagtcggattgaaatatacggtatgtgggggcttttgggtacaatcgcaacatcagtgtttcaagtggggaaggcgatggatggacggcgttgggtggtatggggtgcttttgccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggccctgttcggggcggacgggctgttgtggcgcggcaggcaggatacgccgtatctgttgttgtacggcaatgtgtttttcaaccttcctgtgttggtcagggcggcgtatcaggggtttgtgcaagtgcctgcggcacggcttcagacggcacggacgttgggcgcgggggcgtggcggcggttttgggacattgaaatgcccgttttgcgcccgtggcttgccggcggcgtgtgccttgtctttctgtattgtttttccgggttcgggctggcgctgctgctgggcggcagccgttatgccacggtcgaagtggaaatttaccagttggtcatgttcgaactcgatatggcggttgcttcggtgctggtgtggctggtgttgggggtaacggcggcggcagggttgctgtatgcgtggttcggcaggcgcgcggtttcggataaggcggtttcccctgtgatgccgtcgccgccgcagtcggtcggggaatatgtgctgctggcgtttgcggcggcggtgttgtctgtgtgctgcctgtttcctttgttggcaattgttgtgaaagcgtggtcggccggcgaatcgtggcgtgtgttaatggaaagtgaaacgtggcaggcggtgtggaatactttgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctgacattgctgttggcggcgttcgcgctgggtattttcctgctgttggacggcggcgaaggcggaaaacagacggaaacgttataatgtgaaccctttttcagaggacggcaaaatgagcgagttggataacatccttgcccataaccggcagtttgtcgagtcgggcgaatatgaaaaatactttaccgacaaataccccgaacgcgggctggcagttttgtcctgtatggatgcgcggattatcgggctgctgcccgacgcgttgggtttgaaaaacggcgatgccaagctgattaaaaatgccggcgcgctggttacgcacccgtggggttcggtgatgcggagccttttggttgccgtgtttgaactgaaggtcagagagattatggtcatcgcccatcacgattgcggtatgcaggggctgaatgccgaagaattcctcgggcgcgtccgggaaagccggattcccgaagaccgtatcgaaaccctgcgttatgccggtatcgacctcgacggctggctgaccggtttcgacaacgtcgaagacagcgtgcgccacacggtggaccttatccgtaaccatccgctgatgccgcgccatatcgccgttcacggactggtcatccatcccgttaccggcaaactgacgctggttgtggacggcagtgtttcagacggcatggacttatcggaaggaatggaaacatcatgaagaaaatcggattgttcggcggtactttcgacccgatacacaacggacatcttcatatcgcccgtgcctttgccgacgaaatcggcttggacgcggttgttttcctgccgacaggcggcccgtatcacaaagacgcagcctccgcttccgccgccgaccgccttgccatggtcgaattggcgacggcagaagacgcgcgttttgccgtcagcgattgcgacatcgtccgagaaggtgcaacctatacttttgataccgtccaaatcttccgccagcagttcccatccgcgcaactctggtggctgatgggcagcgacagcctgatgaagctgcacacatggaaaaaatggcagatgctcgtgcgcgaaaccaatatcgccgtcgccatgaggcagggcgacagcctgcaccaaaccccgcgcgaactgcacgcgtggctgggcaagtcccttcaggacggcagcgtccgcatcttgtccgccccgatgcataatgtgtcgtcaacggaaatccgccgcaaccttgccggccaaggcgtttcagacggcatcccgcctgccgccgcacgctacatccgcgaacacggtttgtatgaaaaataaagtcaaatcagtaagaaacggctataatgccgtctgaaaacatcccgttaggaaaataatgaacgaacaagaactgcaagacctgcaaaaaatggtcggggtcgccgtcaacgccctcggagacatcaaagccaaagacatttccgttctcgaaacccaagacaaaacttcgctgtttgccagaatgattatcgccagcggcgacagtacgcgccaagtcaaagcactggccaacaacgttgccgtcgatttgaaagaagccggttttgaaatcctcagtaccgaaggcgacagcggcgaatggacgctggttgatgcaggagacctcgtcgtccacgtcatgctccctgccgtgcgcgacttctacgacatcgacaccctctggggcggcgagaaaccgagtttccacgccggaatgcagaagccgtggcacgcggcagactgattcccgatgccgtctgaaccttcagacggcattttcctgtaagggagaaagcattgaacatcaccgttttggcagtcggcaccaaaatgccgcgctgggttgatgaggccgtcgccgaatacgccaaacgcttcggacgcgacgtcgcctacgcactcaaagaaatcaaacccgaaaaacgcggcgcgggcgtgaatgccgcccaaggtatggcggcggaagaaaaacgcatccttgaagccattccgcaaggcgcgttcctcgtcgttcttgacgaacgcggcaaagcaccgacctccgtcgagctggcggaacacctcaaaagctggcggcaaaacggcgaacacgtctgcttcgtcatcggcggcgcggacggcatgaccgaccgcctcaaacagcaggcacgcatgatgatgcgcctgtccagcctgaccctgccgcacggcatggtgcgcgtctttctgaccgagcagctctaccgcgccgtttccatcctgcacaaccatccctatcatcgggaataagaaggcttttgtccgtatccctaatcggttaaaatcaccccgttatttctgaacacagcaaaggaatccgctatggcacgcatggtattctgcgtcaagctcaacaaagaagccgaaggcatgaaatttccgccgcttcccaacgaattgggcaagcgcatttttgaaaacgtatcgcaagaagcgtgggcggcgtggacgcgccaccaaacgatgctgattaacgaaaaccgtttaagcctcgccgatccgcgcgcgcgcgaatacctggctcagcagatggagcagtatttcttcggcgacggcgcggatgccgttcagggatacgttccgcaataacggttttccgttttgaacacaggctgtccgaaactgcttcagacggcctttaaaatacgccggacaactttatcttcacgcaaccggacaaattttgacattgggcaatgttaaaatcccccattattcccaaccgcgctttcaggagcagatgatatgcaacacgacgtttacgactacaccgcgcatacggtttctaaaaacaccgtcctgcagaaaacctaccgcctgctcggattttcatttattccggcttccgcaggcgcggcacttgccgccaatgccggtttcaatttttacgccgccttcggttcgcgctggatagggtttgccgtcgtgttggcgtttttctacggtatgatccacttcatcgagaaaaaccgttacagcaataccggcgttaccctgctgatggtattcacattcggtatgggcgtattgatcggccccgtgctgcaatacgcgctccatattgccgacggtgcgaaaatcgtcggcattgccgccgcgatgaccgccgccgtctttttaacgatgtccgccttggcgcgccgaacccggctcgatatgaacgcgctcggacgcttcctgaccgtaggtgcggtcattctgatggtcgccgtggttgccaatctgtttttgggtattcccgcactcgccctgaccatttccgccggttttgtcttgttcagttccttaatgattatgtggcaggtacgcaccgtcatcgacggcggcgaagacagccacatcagcgcggcactgacactgtttatctcgctttacaacatcttcagcagcctgctgaacatcctgttgtctttaaacggcgaggattgatgccggtaaaacgccgtccgactatgccgtctgaaaatgcttcagacggcattttactttgggcatacaatacggatgcacacgcaccaacacacagccgactatgaagccgggaggaatcaaatgttaccgaatacaccgcgccgcgccgtttatgccggcagtttcgatccgcccacattggggcatctgtggatgatacggcaggcgcaatctatgtttgacgaactcatcgtcgccatcggcattaaccccgacaaacgcagcacctataccgtcgctgaaaggcaggatatgttgtgcgatattactaaaatgtttcccaacgtcagaaccgatgtatttgaaaaccgatttctggtgcattacgcccgtgaggtagatgcaggattcatcgtgcgcggcatccgttctgcttcggattacgaatacgaacgttccatgcgccatatcaacagcgacctcgcccccgaaatatccaccgtattcctcatgccgccgcgcgaaatcgccgaagtgtcgtccactatggtcaaaggactggtcgggccggaaggctggacggaaacgatccaccgctacgtgccgcaagctgtgtacgaaaaaatccttgccgaacatcaacacgaaaattgaacccttctatttttgcaaggcatatatggatatgttggaaattttgttccgccatcaagacttcgtcgccatcaacaaaccgggcggcatatccgtccaccaagacagcggcgagaccggactggcccgaacactcgccatacagttgggcgtagagcgtgtgtggctgctgcaccgattggacaaacagaccagcggcattttactgtttgccctcaacaaagaaagcgcgtccgcccttagcggacagtttgccggcaaaagcatcaaaaaaacctatttggcactgtccgaccgcaagccgtccaaaaagcagggttggattaaaggcggaatggaaaaatccagatgtggaatgtggaagttgacgcgcaatacagaaaatatcgccgttacccgattccacagcatcagtatcgccgaaaaactgcggctgttcatcctagaaccgcatacgggcaaaacgcaccaattgagagtggcgatgaaaagtttgggcagtccgattctgggcgacagcttatacggcggaacagaatccgaaaccatgtttctgtatgcatggaaaatacaatttgactaccaaaaccgacaaatcgaaattgttgcacccttaaaaaacgaatggcagactgaaaatatccatcgggcactggaagaattctgtatggaaaataaaattgactgatataaattaaatttataaacaaatagataaatatttttaaaaaaatttctt

SEQ ID NO: 37772 - DNA, 56609 bp, Neisseria meningitidis
  misc_feature (23260)..(23260): N is any nucleotide
cttgtccgagaatgacgcttttgacccggtcgaacgctgtcaggcggaatgcgttgaacacatccgccgccggcggatagatgatttgtcccgacaaacgttcctgcctgactgcatttaaaatttcctgaaaatacggctgctgtttttcgccgccgagtgcatcgtgccaagtgtccatatctgccctatcctttcaaattcggctatactgctgatattgcgttattttgtcaaacgacgcgctttgtggggaaatgtatgactgtatggtttgttgccgctgttgccgtcttaatcatcgaattattgacgggaacggtttatcttttggttgtcagcgcggctttggcgggttcgggcattgcttacgggctgaccggcagtacgcctgccgccgtcttgaccgccgctctgctttccgcgctgggtatttggttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaacactcggaggaattatggaatttttcattatcttgttggtagccgtcgccgttttcggtttcaaatcctttgttgtcatcccacaacaggaagtccacgttgtcgaaaggctggggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggcatcatctatttccaagtaaccgaccccaaactcgcctcatacggttcgagcaactacattatggcgattacccagcttgcccaaacgacgctgcgttccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataagccgtgatgaaaatgccgtctgaagtccagttttcggggttcagacggcatttttatttaaacccgggcaaggttgtattccgcttcaaatatagtggattaacaaaaaccagtacggcgttgccctatttgtactgtctgcggcttcgtcgccttgtcctgatttttgttaatccactatatgtttcggaaccgcctacctgccccggtaaaaactgccggcaaaatatttctgcacgccctcgcgaagcaagaccaaggttacggcggccaaaggcaatcccgccaacattccgacaaagcccatcagctgcccgaacgccatcagcgaaaagataacccaaaacggcgacagcccgatacggtctcccacgattttcggcgtaatgaaaaaactttcgagaaactgtcctacggcaaaaaccgcccaaaccgataggatgccgttccacgaaccgaactggagcaaggcggcgacggtggcaagcagcaatcccgtaaacgccccgagataagggacaaacaccaaaataccggcaagcataccgatggcaaaccccgaatccagcccgaccagcaccaatcccaaaccgtaaaccaagcccataatcagcattaccagaagctgcccgcgcaaaaattcgcccaatacctcgttcaaattgcctgtaatgcgcgtataagcaccggcaaaacgcctcggaaccagtttggcaatgccgcacgaccaccgctgccaatccagcaggaaatagtaaagcagcaagggaagcagcagcaggttgccgatactgctgacaatattgccgccctgcctcatcaaaacgggaaaccacgccttaagcgcgttgctcaactctcccgtatgcgcctgaagccacgcaataatagatgcctgatcgatttccacatatccgccgattgtatttttcaaccacggcagcagcgtgttctgcataaaaccgattaattggggcaggcgcgatgccaaattgttgaactgcccgaccagcatagggacgataatcaacaataatgccaacaacaaaatcaaggaaaacaccatcacagacatcgaagcggatgcacggttcaaaccctttttctgcaaccattcgaccaaagggtccaatacatacgccagcaccgccgcaaccgcaaacggagtcaaagtatcgccgagcgcgaaaaccagccagaccaaggcggcaaacgccgcaccggcacccatccacggcttgatgccccgccctttcctccgatacataaaaaccacccttctaaaaataatattgtgcgccagtatagcagaaccgccgcgccgtcaaaaaagcctccgccttcccgatagcctgttatcgcggtttaggctaaaataacgcacatccgatgccgtctgaaaggcaaacccgccttcagacggcataccgtacacgacaaggcagcacatcatgaccgaacaaaaaaacaaaacatccctcatcgaatttccctgcaccttcccattgaaagtaatgggcgcggtgcatcccgagttcgagcaggcggttttagacaccgtccgcctccacgcccccgacacgcaggcgcaccacatcaccacgcgtccgagcagcaaaggcaactatactggcgccaccgtacaggtaaaggttgaaaaccaagaacaattggacaacatctaccgtgcgctgacttcgcacgaactggtcaaagtggtactttgagatgaaaatcatacacaaaggtttggtcgaatatctgccgacttttgaagcgatgaaaacctttaatgccggacggaatgccgacaccgaagacgaactgtgggtcgtcgaacacccgcccgtgttcacacaaggactggcgggaaaacccgaacacctgctgattcgcgacgacattcccgtcgtccaaatcgaccggggcgggcagattacctatcacgggcccgggcaattggtcgtttatacgatgattgatttcaaacggcgcaaaaccagtgttagaaacatcgtttccgcgcttgaaaacagcatcatcgccacattggcagaatacggcatcgaagcggcggcagaccccaaacgccccggcgtttatgtcggagaacgcaaaatcgcctcactggggctgcgtatcaaaaacggctccgtctatcacgggcttgcgctcaacgtcaatatggatttaagcccgtttacccacatcaacccctgcggctacgccggtatggaaatgacgcaaatcgcggattttgtccaaccctgccccacgccggacgaagtcgccgccaaactcaccgcacaccttgaaacacaattcacaccgaaagcagacaacaatgagtgaaatcaaaaccgacgaccccaaacgcggcatcaaactcagaggcgcggacaaaaccgcgcgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggtgacatctgcacccgccgctgcccgttctgcgacgtgggacacggtcggcccaatatgctcgaccccgacgaaccgagaaacctcgccgaatccgtcaaagccatgaacctgcgttacgtcgtcatcacctccgtcgaccgcgacgacctgcgcgacggcggcgcacagcatttcgccgactgcatcaaagccatccgcgaaaccagcccgaacaccaaaatcgaaatcctcgtccccgacttccgaggacgcttggacatcgcactcaaaatccttgccgaaaccccgcccgacgtgatgaaccacaacctagaaacccatccgagcctgtacagaaaagcccgtcccggtgccaattatcaacattctttagacttattaaaacgttataaagaaatgatgccgcacatcccgaccaaatccggcatcatggtcggcttgggcgaaacagacgaagacgtgcgtgaaattatgcgcgatatgcgggcgcacaatatcgaaatgattaccatcggacagtacctccagccttcagacggacacctgcccgtcctgcgctacgttacgcccgagcagttcaaaatctttgaaaaagaagcatacgaactgggcttcagcaatgccgccatcggcgcgatggtacgttccagctaccacgccgacgaacaggcggcggaagccttgagggaaagccacggcggttgcgggcatcattaaacccggaacaccgcgccaaagtaaaaagcgattccctgcgcctgccgcgccgtttggcgcaagccgcacccgtgttagccgcctatgccgtctgaaagcccttcagacggcataatttattcccaaaatccgataatcttgtaaattctgacgctatttgcgactttataacgctaaatgaccgagcagatatggatcaacagccgttattgaaattgccgaattcccacataataatttggcgaatggatgggttagggaagattttttcccaattgaaaaataacgataacctgtttattgaagcctatttacgcccggttaactttcatagtaactcttttgaataaaaagaaaacttcaaaataatcatcccgacatacttctcacaattagcgtacaacatctgattatcagggtacgctgtcagttttttattgacaatttaattcaaatttcctatattttgtccttaactattccttacatttcatttaagaaaacccatcatgaacaagcgatgctacaaggttatcttcaacaagaaacgcagttgtatgatggctgtagcagagaatgttcatcgtgacggcaagagtatgcaggatagtgaggcggcttcggttcgagtgaccggtgccgcttctgtttcttctgcccgggcagccttcggtttccgtatggctgccttttctgtcatgttggctttgggtgttgctgcgttttcccctgcccctgcttccggcatcattgccgacaaatccgcccctaaaaaccaacaagccgttattcttcagacagcaaacggtttgccgcaagtcaatattcaaactccgtcatcccaaggcgtttctgttaaccgattcaagcagttcgatgttgatgaaaaaggcgtaatactaaacaacagccgcagcaatacgcaaacgcaactcggtggatggattcaaggcaatccccatctggcacgcggcgaagcgcgggtaattgtgaaccagattgacagcagtaatccttcgttgttgaacggttatatcgaagtcggcggcaaacgcgccgaagtagtcgttgccaatccgtcgggcatccgtgtgaatggcggcggattgattaatgccgcttcggttacgctgacttcgggcgttcctgttttgaataacggcaatctgacgggctttgatgtttcttcgggtaaagtcgtgattgggggcaaaggtttggatacctctgatgccgattacacccgtatccttagtcgtgctgctgaaatcaatgcgggcgtttggggtaaagatgtcaaggtggtttcgggtaagaacaaattggattttgacggctctcttgccaaaacagcttctgcgccatcttcttcggattctgttactcctaccgttgccatcgacaccgccacactgggtgggatgtacgcagacaaaatcactttaatcagcaccgacaacggcgccgtaatccgcaacaagggtcggatttttgccgcaacaggcggcgttacgttaagcgcagacggcaaattgagcaacagcggttcgattgatgctgccgaaatcaccatttccgctcaaaccgttgataaccgccaaggctttatccgcagcggcaaaggcagtgtattgaaggtttcagacggcataaataatcaagcaggcttaatcggctcggccggtttgctggatattcgcgatacaggcaaaagcagcctgcatatcaataacacagacggcacgattattgcgggcaaagatgtttccttacaggcaaaatcactggacaacgacggcatattaaccgccgcacgcgatgtttccgtttctcttcatgatgattttgccggcaaacgcgatattgaagccggacgcacactcacgttctccacccaaggccgtctgaaaaacacccgcatcatacaggcaggcgataccgtatccctgaccgccgcccaaatcgacaacactgtctccggtaaaatccaatccggaaaccgcaccgggttaaacggcaaaaacggcatcaccaacaggggtttaatcaacagcaacggtataacgctgctgcaaaccgaagccaagtcggacaatgccggcacgggcagaatttacggcagccgtgtggcagttgaggcagataccttgttgaaccgggaagaaacggtcaacggcgaaaccaaagcggcggtaattgcagcgcgggagcggttggatattggagcgcgggaaattgagaaccgagaggcggcattattgtccagctccggcgatcttcatatcggttctgcattgaatggaagccgacaggtgcaaggagcaaatacatcactgcacaaccgcagtgcggcaatcgaatcatcaggcaatatccgtatcgctacaaaagatttgcagaataccaatgagcatctgcgtttccatacggaagaaacccatcgcgaacaccgtatcgaatatcaggcggaaggcagaacagaacgctatccggaaggttctcaaaaagagttgggctgggaaatatttgaagatgagtctttacatatgcggactccggacggcagcccccactctgtctggtacaaatacgattacgaacgaatcaccgccgagagcaaaattaccgaatccaagcccggtcaaatcatcagtggcggcaatttggttttagatgccgccaagctgaaaaatcataacagccggattattgccggcggcagattgatcgtcggtacgcccgaatccgcattggacaatgatgaaactttgggaacaaaaaccataaccgataaaggggacttgcaccgttaccaccgtcatcacaagaaagggcgggattctacgggatacagtcggtctccctacgaaccggcccccgaagtcagctccatccgtatgggtatttcagcctataaaggctatgcgccccaacaggcatctgatatacccggcactgttgtacccgttgttgctgaaaacggcatccatcctacatttactctgccgaacagcagcttgtttgccattgcgccaaacaacaaaggctatttgattgaaaccgaccctgcctttaccgactaccgcaaatggctgggcagcggctatatgcttgccgcactgcaacaagacccgaaccatatccacaagcgtttgggcgacggctattacgagcagaaactggtaaacgaacaaatcgccaagctgacaggctaccgccgcttggacggttataccaatgacgaagagcaattcaaggctttgatggataacggcattaccatagccaaagaattgcagcttactccgggtattgccctgtctgccgaacaggttgcccgtctgacttccgacattgtttggctggaaaacgagaccgttaccctgcccgacgggacaactcaaaccgtattgaaacccaaagtctatgtccgcgcacgccccaaagatatgaacggacaaggggcgttgctgtccggcagcgttgttgatatcggcagcggcgccattgaaaaccggggcggcttaattgccgggcgcgaagcactaattttaaacgcacagaatattaaaaatctgcaaggtgatttgcagggcaaaaacatcttcgccgcagcaggcagcgacattacgaataccggcagcatcggcgcagaaaacgccctgctgctcaaagcgagtaacaatatagaaagccgcagcgagacccgcagcaatcagaatgagcaaggctcggtacgcaatatcggccgggtggcaggcatttatctgaccggcaggcagaatggaagcgtcttgctggatgcaggcaacaatatcgtcctgacggcttccgaattgaccaatcaatctgaagacggtcaaaccgtactgaatgccggcggcgacatccgctcggatacgacgggcatttcccgcaatcagaacactatctttgattccgacaactatgtgattcgcaaagaacaaaacgaagtcggcagcaccatccgcacccggggcaatctcagtctgaatgcaaaaggagacatccgtatccgtgcagcagaggtcggcagcgaacaaggccgtctgaaactggcagccggacgggatatcaaagtcgaagccggcaaagcccataccgaaaccgaagatgccctgaaatacaccggtagaagcgggggcggcatcaaacagaagatgacccgccatctcaagaaccaaaacggacaagccgtatccggcacgctggacggcaaagaaatcattctggtttcaggacgcgatattaccgttactggcagcaatatcattgcagacaaccataccattctctcggcaaaaaacaatatcgtccttaaagcagccgaaacacgcagccgcagtgccgaaatgaacaaaaaagaaaaatccggactgatgggcagcggcggcatcggctttacggcgggcagcaaaaaagacacgcaaaccaaccgatccgagaccgtcagccacacagaaagcgtcgtcggcagcctgaacggcaataccctgatttcggcaggaaaacattacacccaaaccggttcgaccatatcctcgccccaaggcgatgtcggcatttcctccggaaaaatcagcatcgatgccgcacaaaaccgttacagccaagagagtaagcaggtttacgaacaaaaaggcgtaaccgtcgccattagcgttccggttgtgaataccgtaatgggcgcggttgacgccgtaaaagcagtccaaaccgtcggcaaaagcaaaaacagccgggtcaatgccatggctgctgccaacgccttgaataaaggagtagattccggcgtggcactctataatgccgcccgaaatcccaaaaaagcagccggtcagggcatcagtgtctccgttacctacggcgaacagaagaacacctccgaaagccgcatcaaaggcacgcaggtgcaagagggcaaaatcaccggcggcggcaaagtttccctgactgcttcaggcgcaggcaaagactcccgcatcacgattaccggctccgatgtgtacggcggcaaaggaacacgcctcaaagcagaaaatgccgttcagattgaagccgcccgccaaacgcatcaggaacgcagcgaaaacaaatccgcaggctttaatgccggagtcgccatcgccatcaacaaaggcatcagtttcggcttcacagccggagcaaactacggcaaaggttacggcaacggcgacgaaaccgcctaccgcaacagccatatcggcagcaaagacagccaaaccgctattgaaagcggtggcgataccgtcatcaaaggcgggcagcttaaaggcaaaggcgttggcgtaacggcagagagtctgcatatcgaaagtttgcaggataccgccgtgtttaaaggcaaacaggaaaatgtttccgcccaagttacggtaggctacggctttagtgtcggtggcagctataaccgctcgaaaagcagctcggattatgcatccgtcaacgagcaaagcggtatctttgcaggaggagacggctatcggattcgcgtaaacggcaaaaccggattggtcggcgccgctgttgtttcagatgccgacaaatcaaaaaacctgctgaaaacaagcgaaatctggcataaagatattcaaaaccatgcttcggcggctgcttccgccttgggcttgagcggcggtttttcatacagcccgaagcctaccagcggacagtattccaccaaaaaagaagcagaaatcggtaaaatcggcggcaaaccggtcagcctgatgcgttttgaccaggtttcggcgaaagacgacgagttgaacgaaaaatatcgaagtgagcgtattgaaaaaggggaaacctttaaagaggcaaatttaaatcaaaacaacgccggcggcttgaaattcggtttgaagcaaaacgatatacacagcaacgacaaatacgccttggcaaaaatgggtttgggcaatctgttgggcaatgccaaagaatcagaaagccgccaatccattacccgctccgtcatcagtgagggagattggcaaattgcttccgcgcagggcaggaaaaatattgccggtattgaaaaaggcacttcatccgcacataaggcattggcaaaagcagaccgcgaaggcttgctgaaagaagtcgaactcaatagggatgttgccaaagagtttatcaatgagacgctgatcggcggcattgcagacgaagcctaccgcagccagtttattgcagaacaccgcctgatgacctttaaaatggatgaaaacggcgagccgattgaagataagcagcttgaagaggatataaataaacagtttgacaactcagtaaagttgaaaaaagaatttgcctcatttaaagattattgggaagcctataaagccattgggggaaatatctacgaattgcgcgaagtatccgaccaggaacggaaaaatctgaaaactgcccgttacaccgacccggagaccggcaaaaccgttgaaaaaatcgttgtcggcgtcaacggcattttcaataatatacaagcagccgccaaatttgccgcccaacaatatgtggggcgtttcaatcccgagaaaaaccgatatgaacgcacctatgaaaatgtttatttcctgcacaatccggaaaccaatgggcggggcttttcaaaattgcccgaaatcgccgttgcggcctttcataaaatgctcgaaggggcaaaaataggcaataagaccgttatcggcttgagcaattcaggcttggctttaggcaatatcatggaagactacgggaaggataaaaacggcctgtttgtcggctcgcacagccgtggaaccctggtggtcgacaatgtactcaataccttgaatacccaagccaatcgggataagaaaattttatccaataccgaactgaaaatggtcggccctgccgccaacgttgtccgggcagataaaaggctgtttcaactgcagcagggggtaacgacacccagaacggcagatttcgcccgtcagtccatccaaatagaaaaccacgaattagaccttatcggcatgctgattggcagaaatccggcaacagtcggaaccaatacccggcaaaaaagccaatggcaggctataagggatattataggggattacacctcgccgcataattgctacggtatggctaataaacaatgtgtaacagatggttatcgagaccctgaaaataaacaaacccaaagtccgacaggtgtatttgaaagaggagtgtccaacgaaatcgaaattatgtaccgtcctgtacgcatttatgatctgcaacatccgaaaggaaaaacaaaatgaaatatatcgtatcaatctctctggctatgggattggctgcctgttcgtttgggggattcaaacctccgcccgatgactcggcattttggagattgacaaattacgccaaactttatccgggattaacctcagcgacacttgaccaatacccacctgaagagagacgaagacaactgcatgattcttttgctagagaaaaaaaagactggaaagagtgcggctatgacccaataggtgggggcggtgggagtgaagcagatgcctgcatgagaaaaagaggttggtatcgtgtaggtaacgacatttatcccgaaaacaaaaaatacgaatggcctcgagaagaaggaaaaacaaaatgaaatatatcgtatcaatctctctggctatgggattggctgcctgttcgtttgggggatttaaaccaaatccgtgggacgccgcgtcattttgggaattgaaaaattacgccaatccctatccgggatcagcctcggcggcacttgaccaatatccatcgaaagcaagacgaaggcaactgaaagacatgcaagagtgcggctatgacccaatagacggcggaaagtctgaagcagatgcctgcctgaggaaaaaaggctggtgtcgtaagggtttcgacccttatcccgaaaacaaaaaatacgaatggcctcgagaagaaggaaaaacaaaatgaaatatatcgtatcaatctctttggctatgggattggctgcctgttcgtttgggggattcaaacctccgcccgatgactcggtatactggaagtattcccgtatagaacaagaatatccggcaatgatgagtaaaaatatcaatttacgcatatattcttatgaagaatatagcaaacaaatagatgatctttttgctaaggaaaaaaagactggaaagagtgcggctatgacccaataggtgggggaggaggaagtaaagcagatgcctgcatgagaaaaagaggttggtatcgtgtaggtgacgacatttatcccgaaaacaaaaaatacgaatggcctcgagagaactgaaacaaggctgcctgaagggaaactttcaggcagccttgttttattgtttcgacaacgctggaaacctcataatccgttttcctttttcactcccccggtggtacagccaccttatttcacgtttcggaaacagatgcaccagaattcttttcatcatacggctgtcgccgaaaggtgcgaaccagttgataagccacattctgtttccactgcaccagttttccgagtggcgcagaacatcattggattggagatattgccattcggtttcttcatcgaaataagcccaagtgcagtaggcgacggggtgtccgttgctgctgaacaaggcaaattgcccgtttttcaataccggcaagatattgacggcggcttcttgtacgccggcatgctgataaataggcgaaactgcccacaaccataccaaagcgccgaatgcttcggtttcattgaatgtttcctgcgggaacagttccggcgaaataatatcgatattttctatcttcatgattttaaatttaagttttaataaggtttggaataaatagcggatattgaccccggcagccgcgcgcttcgtcctaaaataccgggcttcttcaaagcccctgccgcaaacacatcatacgacagattgcccttcgcattaaacacaccttcaaaccgacagccgctccaagcagcgtctgtccgggcaggcatgccgtctgaaagcccctcagacggcataatttattcccaaaatccgataatctcaaaagaatctgtcggttaatgagaacgattcattataaattttgataaaaaaccgtgctctatttgttttttgctatggttaataagtgtaaatgttctttatggatgagatggattcttagttttagcagcaaaaaaaccgataagaaacagcatactgatttggaaggcatcggggaatacgccctatttcttttgataattgtttgtattttaaatagaaaatttgtcatgccgacagcttttgcatacaatgcacgcatcccgaatagcgacacagatgctgttcagacataccgaaaaccaagttacagaaagagagatattatgcaaggcaatcaagctgttgttgattatatgaacgaattgctgtctggcgagctggcggcacgcgaccaatactttatccactcccgcctctactccgaatggggctacaccaaactttttgaacgtctcaaccacgagatggaagaagaaaccacacacgccgaagacttcatccgccgcatcctgatgctgggcggtacgccgaaaatggcacgcgccgaactgaatatcggcacggacgtggtttcctgcctcaaagccgacctgcaaaccgaatatgaagtacgtgatgcgttgaaaaaaggcatcaaactgtgcgaagaggctcaagactatgttacgcgcgacctgatggttgcccaactgaaagataccgaagaagaccacgcccactggctggaacagcagcttcgcctgatcgagttaattggcgaaggcaactactaccaaagccaactgtaatccgtattcggaataaaaggagtccgtatgaaaggcgaccgtttggttatccgcgagctgaacaaaaacttaggcttgctgctggtaaccatcaaccaatatttccttcacgcccgtattttgaaaaactggggctttgaagaactgggcgaacatttcttcaaacagtccatcgttgaaatgaaagctgccgacgatttgatcgagcgcattctgttcctcgaaggtctgccgaacctgcaagaactgggcaagcttctgattggcgagtccaccgaagaaatcatcgcctgcgatttgaccaaagaacaggaaaaacacgaagccctgcttgccgccatcgccacagcagaagcgcaacaggattacgtcagccgcgatttgttggaaaaacaaaaagacaccaacgaagaacatatagactggctggagacccagcaagagcttatcggcaaaatcggtctgccgaactacctgcaaacagcggcgcaagaggactaaaacacaaaccactgccaaatacagcagtcccccgcaccatcagacggcatatccgtataaacggatatgccgtttttctttttcggtttgcgaataaaatctaaattgatttgaatcaatacctgataagggtttttgtttgataataccgatatgaaattcagggtgcttgtttgctgtttcccaatctgtcttgattttatctctttcctcttgatgtgtgtgtgtttgggtgtggctgccgccaccccttttttttggcttttatgtgaagtaaaatccgtaacagcaaatgcttaactttaaccatttatctggaagcaaatgatgggcaacaaattgactctgcctgccgaactgcctgacgaacaggatttgcgggcggtattggcatacaatatgcggcttttccgcgtgaacaagggttggtcgcaagaagaattggcgcggcaatgcggtttggacaggacttatgtgtcggcagtcgagcgcaaacgctggaacatcgccctgtcgaatatcgaaaaaatggcggcggctttgggcgtggcggcgtatcagttgctgctgccgccgcaggaacggttgaagctgatgaccaattccgccgatacccgacaaatgccgtctgaaagcggtatttgaccgccgaaccatccgcctccctttttcccgccaatcgaaagaataaaaatgcctgcaaacctgtcttcagcactggaaaccttcaaacagcagcgcgatgccgccgaagcgcattatttgaaagccaaccgcgtgtcggtatttttcagagaatacacggcggcagtcgaaaccttactggcggcattgtgggcagagtattttcaaaacagcgcgttatgcctgatggcggtaggcggcttcggacgcggcgaactgtatccctgttcggatgtggatttggcggttgtctcccctgccccgctttcagacggcattcaggaacagattgcccggtttgttcaaaccctgtgggactgcaaactgatgccgtctgtaaaaagcggcagcgttgatgaactatgtgaaagcgtgcgcaatgatattacgggggacacagcgtttttagaggctaggtttttgtttggcaaccgccaaacggtggataaactggcggaaaaaatgaacgcgcagcgcaatgtggcggcgtttgtcgaggcaaaactggtggagatggaacaccgccacgccaaatcgcaaggttcgggggcagtattggagccgaatatcaaaagctgtccgggcggtctgcgcgatatccacaccctgctttggatagcgaaggcgcaaggcttggcgaccgacctgcccgacctgctcaaacagcggattttgacgcgtgccgaagccggtatgctttcgcacggctaccgccgcctcgcccacatccgcatccatctgcatttaaacgccaagcgcgccgaagaccgcctgctgttcgatttgcagccgcaagtcgccgaaagcatgggttatgaaggcttgaacctccgccgccaaagcgaagaactgatgcgcgtgttttaccgcgcgattaaaaccgtcaaacaactgggcggcatcctcacgcctatgctgcaaagccgcgtttcctccaccccgttgcgcgttaccctgcggattgacgacgactacatccaagtcaacaaccaaatcgccgcgcggcacaccgatatttttttcagacggcccgaacacattttcaaaatcgtcgaaatcatgcagcagcgcaacgacattaccgcgctcgaaccgcaaaccctgcgcgcctggtggggcgcgacgcgcaaaatcaaccgcagcttctaccaaaatcccgaaaaccgccgccgcttcgccggttttttccgcaacggcaacgggctgacccagaccctgcgctttctcaacctctacggcgtgttgggccgctacctgcccgcgtgggaaaaaatcatcggcctgctccaacacgacctgttccacatctatcccgtggacgaccacatcctcaccgtcgtccgcaacgtccgccgccttgccttggatatgcacagccacgagctgccctacgcctctgcactgatgcagtcctttgaaaaacaagacatcctctaccttgccgcctttttccatgacatcgccaaaggacgcggcggcgaccatgccatacaaggcatcgcagacgcgcgccaatttgccgctgaccacttcctgaccggagaagaaagcgacctgctcgcctggctggtcgaaaaccacctgctgatgtctgccgtcgcccaaaaagaagacatccaagaccccagcgtactcgatgccttctgcaaacgcgtgcaaacccacgaacgcctcagcgcgctctaccttctgaccatttccgacatacgcggcaccaatcccaagctgtggaacgcatggcgcgccagcctgctggaaagcctcttccatgccgccggacgctaccttacaggcaacggcggcaacccgcacaccctcttcggccgccgccggcaggaagccgccgacttactcacccgcgccgccgtccccgaaaaacagcagaaaaaactatggaacgcgctcggttccgcctacttcgcccgccaccagtcccgcgaaatcctgtggcacgccgccaacctagtccacgactttgaaacccccatcgtccgcagccgcatcctgcccaaaagcgacagctttcaagtcatggttttcatgcccaacggcccgcgcctgttcgcccgcctctgccgcatcttcagccgccacggcttcgacatcctcgccgcccgcgccttcatcaccgaacacgactacatcctcgacaccttcatcgtgcaaatcccctcgcagcacgcccccgaagactaccccgacatccaaagcgcgctcgaagccgaactcaacagctttatccacggacacaccgttgccgaaacccaaagccgcagccgccgcatcagccgccgcagccgctatatgccgatcgcaccgagcatcaccatcacccccgaagaagactatcccgactggtattccgtcgaaatcaccgccgtcaaccgccccttcctgctcgccgatatggcggaagtctttttcgcccacaacgtcagcctgcgctatgccaaaatctccacactggatgaacgcgccgaagacagttttaccgtttttagccccgacctgaaaaacccaaaaatccagtcctcattgaagcagacgctgctggaacaattatcataacgcccgccttcagacggcattccgccgccacgccgtatgccgtctgaaagcgggggatattgtaaataatttattaatataaggatttatatgaatattattatggactcaacaagaaaatttgggattttatgggaagaaaactctgaatgtaatggttttatttatggaaaaattcagataataataggagagaatatatatcctaagatatgcccatatggatattttacgctaaatgcagtttttaatagtttgaagtcatcctttgaagagaagtattatgcaggtggaaacaatggtttagattttggagagcaactatttgatatagataaatataattctctggaattatgcaatatattttctattgatactacatatatgagtggagggggtaattgtgaaatagattgtttagtattagaaatgggatattctggtgaggaagagagacttttttatagttttgacaatgggaaaaactttaaagaaatcaggtataagaaaggtacagttgaatctgttatttttcaattgaatctataatatatggggctgtaactagattagcagatatgttaccctcgaaatattaagataatatactgaaaattaaaggaaaaaataaataaagaactactccgtttttttgtgctggaagttaccgcccgatatagggcttcaataactgagccacttaccaaaaattagaaaaaagcttttcctgaaattgaaagaacgggagcaacagtggtcggcaaaggaaaaccgagctattcaaaggggaccaaaattaaacctgataaactgtcaagccgccggtaacgtgctataatgccgtgcatcttgcacaaactgaaagaccgagcattatgcgtatcgtagaaaaagcctatactttcgacgatgttttgttggttcccgcacattcgaccgtgctgccgcgagacgttaaacttcaaaccaagctcacccgcgaaatcacactcaacctccccctgctttccgccgcgatggacactgttaccgaggcgcgcctcgccatttcgatggcacaagaaggcggcatcggcatcatccataaaaacatgccgcccgaaatgcaggcgcgcgccgtttccaaagtgaaacgccacgaaagcggcgtggtcaaagaccccgtaaccgttgcaccgacaacgctcatccgcgaagtcttggaaatgcgtgcgcagcgcaaacgcaaaatgtccggcctgcccgtcgttgaaaacggcaaagtcgtcggcatcgtaaccaaccgcgacctgcgttttgaaaaccgcgtcgatttgcccgtttccgccattatgaccccgcgcgaacgtctggttaccgtccccgaaggcacaagcatagacgaagcgcgcgaactgatgcacacgcacaaagtcgagcgcgttttggttctgaacgaaaaagacgaactcaaaggtctgattaccgtcaaagatattttaaaaaccaccgagtttcccaatgccaacaaagactccgaaggccgtctgcgcgtcggtgcggcagtcggcaccggcggcgacaccgaagagcgcgtcaaagccttggttgaggccggcgtggacgtgattgtcgtcgataccgcccacgggcacagccaaggcgtgatcgaccgcgtgcgttgggtcaaagaaacctatccgcacatccaagtcatcggcggcaacatcgccactgccaaagccgctttggatttggtcgccgccggcgcggatgccgtcaaagtcggtatcggtccgggatcgatttgcaccacccgtatcgtggcaggtgtcggcgtgccgcaactgaccgccattcacaacgttgccgaagccctcaaaggcacgggcgttccgctgattgccgatggcggcatccgcttctccggcgacatcgccaaagccctcgccgcaggcgcgtacagcgtcatgctcggcggtatgtttgcaggcacggaagaagcgccgggcgaaatcgaactctaccaaggccgctcatacaaatcctatcgcggtatgggttccttgggcgcgatgagccaaggttctgccgaccgctacttccaagacaaaaccgacagcaccgacaaatacgtccccgaaggcatcgaaggccgcgttccttacaaaggcccgattgtgaacatcatccaccaactgaccggcggactgcgctccagcatggggtatttgggttgcgccaatattgccgaaatgcacgaaaaagcagaatttgtggaaatcacttccgcaggtatgagcgaatcgcacgttcacgacgttcaaattaccaaagaagcaccgaactaccatcgctgatttgaacagccttttcaaggaaaaatgccgtctgaaacctgattttcgggtttcagacggcattttttgtccgttcaaggcaagccgcacgggctgattgcgcggacgggcaaagcaattcggacggacacgccgaaagaatgaaaatgccgtctgaacgccgtttgcgccccgtctgccgaataccgccggcctttaaaacggcggtggaaataaacgcaatctttcaatacgggcgtttcaatttgctggaaataacgctccgtccgcccacatcaaaaaatcgggtggaggcttcgggaaaatatgccccgcctcctcaagccaccccgtcagcattatgatttgcctttccgtttttttaccttaatcggaaccggtttctttgcctttttcctcgattctgcggcggcagacgcgccccttccccttactttgccgcctcgggctgtttttttctcggcggcggttttcggcttccctttccccgccgtccctgccggtttggcagacgcggatgatttaactttccgccccctgccgctccccccggcaatcaggacaaaatcgatttttccgtcatccaaatcggcacgggcgacccggacggcaaccctgtcccccatgttgaaacggatgccgctgcgttcgccttcgattgccatgatttcggggcggaagttgaaatagtcttcgcccaaatcgctgatatgcaccaagccgtcaatgtggatgccgtccagtgttacaaagataccaaaactggtcatgccggagattttaccttcgaatacttcgccgaccttatcgcgcatataataggttttcagccagttttccacgtcgcggctggcgtcgtcggcacggcgctcacagaacgaggtatgcacgcccaaagcctgccagcttttttttggcgtgtaggtttgctgattcaacacggctttgatggcgcggtgtacggtcaggtcgggatagcggcggatgggcgaggtgaagtgggcgtatgcttcgtaggcaagaccaaagtgtccgtcgcaatgcggttcgtaaaccgcctgctgcatggagcgcaacatcatgacttgcagcaattcggcatcaggtctgcctttgaattgttcgacaagcgcggcatagtctttcggcgacgggttgtcgccgccgccaagttgaagccccaacagaccgagctgctcgcgcagggtggcgagtttttcgggcgtggggcccaaatggttgcggaacaaagccgtatgcttgtttttcaacaggaaatccgctgcgcaaacattcgccgccagcatacattcttcaatcagcttgtgggcatcgttgcggacaacggggacgattttttcgattttgccgttgtcatcgaaaatcatctgggtttcgacgctttcaaactccaccgcgccgcgttcgaaacgctttttctgaaggattttgaagagtttgtaaagggtgtcgatttgggctttgtacggatggtcgatgccgtctgaaatccatttccaaacttggttgtaggtcaggcgggcatgagagcgcattacggcggggtagaagcggtattctttgatattgcccgcataggtaacgaccatatcgcacaccatacacaaacgctcgacatcgggattgagcgagcaaatgccgttagacaggttttccggcagcatcggaatcacacggcgcgggaaatatacgctggtactgcgttcttgagcatctgcatcaatcacatcgtcagggcggacataatggctgacatccgcaatcgccacgaccagacggtaattgcgtccgactttttcggcaaacaccgcgtcgtcgaaatcgcgcgccgtttcgccgtctatcgttaccaaaggcaggtcgcgcaaatcgacgcggcctttcaaatcgcttttgcgtacatggacgggaatttttttcgcagctttggcacacgcttcactgaattggtgcggcaaatgatgcttgcgcacggcaatttcaatctccatgccgctgtcggcataatcgcccaaaacttcgatgatttttgccactgccggccggttttgctcaggataaacctcaatttcgccgacgatgacctgaccggattcaggtttgaaacgcgccacgccgtccggttccaatacgatgctttggttcagacgcttgtcttccggctccaaaatcgccacgcccctatccatatagaaacggccgaccactttgctttgcgcgcgttcgacaatatccagaactgtcccttcgcggcggcccntacggtccatgccggcaggacgaacagtgacaatatcgccgtgcataatgccgcgcatctggcgttcatacaaaacaaaatcaccgtctttggcgggcgtgagcggcacggcaaaaccgaaaccgtccttatgcgcctcgacgcggcatttgaccaaatccaatttgtccgccgcgcaaaccgcgccccgacggttgattaaaacctgaccgtcccgcgccatcgccttcagacggcgttcaaaaaagacatactcgtcttccgtaatcgacagctcgcgcgcaagcgattcgatttttgaaggcacacctttgcgctccaacaattcgattatccattcccgactgggcaaaggatgttcataacgctgtttttcacgacttaaaaacgggtctttttcccgtaaatttaaagatttaatatttttattcatttggactgttgacattctctttatgaactatataatagcgacttctttgcggcaggacactgtaccgcaaaacagcaaataaagcaaagcccgggtggcggaattggtagacgcgctagcttcaggtgctagtatcctcacgggtgtggaagttcgagtcttctcccgggcaccaaatcaaatgctttgctttatttcaatatttagattgcccgggtggcggaattggtagacgcgccagcttcaggtgctggtatcctcatgggtgtggaagttcgagtcttctcccgggcaccaaataataaattatcccgattgggataatttccgccattagagaggtggatgagtggtttaagtcgcacgcctggaaagcgtgtatacgtgaatagcgtatcgagggttcgaatcccttcctctctgccaaatacaaatcccaaacttttacggtttgggattttttattattcaaacaataatttcattgggaaaacccgttattgtctataatcgtcatcaaccgcttacaactatccgttaccgttttttgtggtatgttttgcggtatgtattaccctcttcctcaacctgtaaggactcaaaaggcgtattccttcaaacggcattgttcgacatgctgccgggaagccgaacccgataccgaaacgcgacggggcgatataccgctggaaaaatggcggcagtttcttgattgggtaggaaaaacgccgtctgaaacagcttcaagaagccgcaaagcccgtccgaataaaaaatgccgtctgaaatttttcagacggcatcgcgtatcatttaaacattaatccagtaaacatcaatccagctttttaaagtggcggcggcgttccaattcgctcaagtaacgcttgcgcagacggatggattgcggcgtgatttcaacgagttcgtcatcgtcgataaactcaaccgcaccttccagcgtcagcttgattggcgtggtcaggcgaacggcttcgtcggtaccgctggcacggatgttggtaagttttttgcctttgagcgggttgaccaccaaatcgttgtcgcgactgtggatgccgataatcatgccttcgtagattttgtcgttgggcgatacgaacatacggccgcggtcttccagattccacaaggcgtaagcgactgcctcgccctgctcttgggacaccagcacgccgttgtggcggccgggcatatcgggtttgacgggcgcgtaatcgtcgaacacgtggctcatcagcccgaccccgcgcgtcagggtcataaattcgccttggaaaccgatcaagccgcgcgctggaatatggtattcgaggcgggtgcgtccgttgccgtcgctttccatattagtcagttcgccacggcggcggccgagttcttccattaccgcgccttggttgtcgtcgggtacatccacggtcaggttttcatacggttcgcatttttgaccgtcgatgtcgcggtacacgacgcgcggtttgccgacggcgagttcgtagccttcgcggcgcatgttttccagcaaaatggtcaggtgcagctcgccgcgcccggatacgcggaacacgtcggcatcggcggtatcttccacgcgcagggcgacgttggtcagcaattctttttgcaggcggtcgcggatttggcggctggttacgaatttgccttccgtacccgccagcgggctggtgttgaccataaagtccatcgtcagcgtcggttcgtccacgctcaacatcggtaggcctttgggattgtctttgtcggtgatggttacgccgataccgatgtcttcgataccggaaataatcacgatgtcgccggcttcggcttcttcaagcggcacgcgttccaaacctttgaaacccaaaagctggttgatgcggccttgggcgatttgctgatcgtggttcatgacggcaacggtttggccgggtttgatgcgtccgttcaagatacgaccgataccgaggcggccggtgtagttgtcgtagtcgagttgggaaatttgcagttgcagcgtttcgtccgcgctgccgctcggtgcaggcgtatattttaagatagtatcgaacagcggacgcatgtcgttgctctcgtcggtttcttccaatttggcgaaaccgctcaaccctgaagcgtaaacaatcgggaaatccaactgctcgtcggtcgcgcccaagttgtcgaacagctcgaaagtttggtcgataacccagctcggacgagcggacggcttgtcgattttgttgatgacgacaatcggtttcagccccaaagccaaggcttttttggtcacgaaacgggtttgcggcatcgggccttcctgcgcgtccaccaacaagacgacgcagtccaccatccccaaaacgcgctctacttcgccgccgaagtcggcgtgtcccggcgtgtcgacgatattgatgtggtagccttcgtaatcgatggcggtgtttttggcgaggatggtgatgccgcgttctttttcaaggtcgttgctgtccatcacgcgctcgtcaacctgctggttggcgcggaatgtgccggattggcgcagcagttggtcgaccaatgtggttttgccgtggtcgacgtgggcgatgatggcgatgttgcggatttgtttcataattaatgtttttcaaaaactgtaagagataactacgcattataccacgctttaccggacagtatttgggaaatgaagatgccgtctgaagcccttgcctttcagacggtatagtggattaacaaaaatcaggacaaggcgacgaagccgcagacagtacaaatagtacggaaccgattcacttggtgcttcagcaccttagagaatcgttctctttgagctaaggcgaggcaacgatgtactggtttttgttaatccactatatcttcttacatacttttagttatccggttgcgcagccaccttgccgccggagcgatttcccctgccaacagccctgccgcaatgcctgccgattcttttatgacatccgccgccgcgccgtgcagccacgcgcccgcgcaggcggcttcaaaaaccggcacgccctgtgcgagcagactgccgatgatgccgcccaatacgtcgccactgcccgccgttgccaatcccgcgttgccgctttcgttgacatagatttccgtatcgggtgaggcaaccaatgttttgtgcccctttaaaaccacggttgcgccgaaaattgcccctatcttcctcactgccgccgtccgatccgcctgaacctgcgcaaccgtcgttccaagcaggcgcgcggcttcggcggggtgtggcgttaaaatcaggtttttacacccgcgcgccagatttcgggtttcggcatcggttgataatatgttcagcgcatccgcatccaaaacgacgggcttgtccgtgtgttccgtcaaaattccggcaagcgttccgaccgccgccctacctgtacccaatccacaaccgacaacccaggcgtttatatcttgacgtttggccaaactgtccgccgtatccagcataatctcgggaaaaccggcaataacggcaaaaggtagcgtatcctgattgaaacccgcccacactttgccgcagccgagatacattgccgccgatgccgccaatacgggcgcgccgctcatccctgccgatccgccgactacggcgagcgtgccgaaagtccctttgtgcgaatcttccgcacgggctttgaaaacatggggaaaacgcaatgccgtctgaagcatctggcggcggctctcgcctgaaagatgaaaaacgggaaacattgcccctccaatcggttaaaataaggctcgaaaacaaaccgattctaccgccggaaaccgattatgaaaaacaaaaccaaagtctgggacctccccacccgccttttccactggctgcttgccgcgtccctgccctttatgtggtatagcgcgaaagccggcggcgatatgctgcaatggcacacgcgcgtcgggctgttcgtccttttcctgctcgtatttcgcctctgctggggcatttggggcagcgataccgcccgtttttcccgtttcgtccaaggctgggcaggcatacgcggctatctgaaaaacggtattcccgaacacatccagcccggacacaaccccttgggcgcactgatggtcgttgcgcttttggccgccgtgtccttccaagtcggcaccgggctttttgccgccgatgaaaacaccttcagcaccaacggctacctcaaccatttggtttccgaacatacgggcagccttatgcggaaaatccacctcaactttttcaagctgctcgccgttttttctgcaatccacatcgccgccgtcgccgcataccgcgtattcaaaaagaaaaacctcatcctcccgatgataaccggcttcaaatacatcgaaggcaaaacctcaatccgctttgcaggcaaagccgcgcttgccgccgcattatcggttgcctcgcttgccgcagccgccatcctgctcctgtcctgaaacccgacatcaatgccgtctgaagcccttttcgcccttcggacggcatcccctcaccacgcaaacggtctgaatgcccgaaacggcttcaggccgtttttcttccgaaaccgttataaaacggaaaaccgccgcatccgcagccgcccccatatagctttcagcttctaacaaatacctttttattatttaaccggggaaaatccttttgtctaaaatgacccgcattccgacaaaaatgccgcgacgcaccgtatcggaaacaaggtgcgggcaaacagcaaaggagtcagccagtgaattatttccctattttcgccaacctcgccggccgccccgtattggtcgtaggcggcggcgcggtcgccgcacgcaaaatcagcctgctgctgaaggcgggcgcagaggtcagggttgccgcaaaacacctgaatgccgaactctccgcgttggcggcggaaaacaaaatcctgtggcttgccgaagaatttcgtgccgaacacatccgcacggttttcctcatcattgcggcaagcagcgaccaagccctcaaccggcgcgttttccatcttgccgaaagctgccaaaagccggtcaacgtggtggacgaccgcgaccattgcagcttcatcttcccgtcggttatcgaccgcaacccggttcagattgccgtttccagctccggcagcgcgcccgtcctcgcccgactgctgcgtgaaaggctggaagccctgctgccgccgtctttgggcgatatggcggaaatttcaggaaggtggcgcgatgccgtcaagggcaaactgaaatccgttaccgaacgccgccgcttttgggaaaagcagtttaacggacgtttcgccgccctcgtcaaaaaccggcaaaacacccttgccgaacgggaattggcaggccaattggaacaaagtcgtcaaaatgatcaaggcggctccgtctcgctggtcggcgcgggtcccggcgatgcggggctgctgacgctcaaagggctgcaggaaatccagcaggcagacgtggtgctttacgacgcgctggtttcagacggcatactgtccctcgtccgccgcgatgcggaacggatttttgtcggcaagcgcgcccggggcgagcgcaccccgcaagaggacaccaatgcgcttatggtcaggctggcccgcgaaggcaggcgcgtggtgcgtttgaaaggcggagaccctttcgtgttcggacgcggcggcgaagaattggaaaccttggcacgccatcagattccgttttcggtcgtccccggcattaccgccgccgtcggcgcgaccgcctatgccggcatcccgctcacgcaccgcgattatgcccaaagtgcggttttcgtaaccggccaccgcaaggcggatgcgcccgacatcgaatggcagaccctcgcccgcagccgccagaccttggtgatttatatgggtgcgctcaaagccgccctgattgccgaacggctgcaacagcacggacgctcgcccgacacgccggcagccgttatcagccaaggcacgctgccggctcaaaaaaccgcaaccggcacgctcgccaaccttgccgaactcgccgaaaccgcgccgaatccggcattgattgtcataggcgaagtggtggggctgcacgaaaaactcgcctggttcggtgaaaacggcgaaggagaaaaccgggtcgggcagacgtatcccgcattgggcggactgaatgccggacaacgggcggcataaggcgggaaaaatggaaacgacactgttcaaacccgccctgtggcagataccgcatatcggatccggcggcgaaaccgcccttgcggaaaaaacggaaaccctcaaacaacgcctgcaccggattgtcggcagccaccgggatgcacggtttgccagcagccttgcggcagaagatatggtgattaccgaccttatcgccggcgaaaacctcaatatcggcatttttaccttggatacggggctgctccacacggaaaccctgaacctgctggacaggctcggacgcgcatatccccatttgcggataaagcgtttccggccggttcgagaagatgccgaccgttatgtggaaagcaaaggcaggtttgccttttacgacagcgttgaagcgcgccgcgaatgctgccgcatccgaaaaaccgaaccgctcaaccgcgccattgcaggcgcggacgcctggcttaccgggcaacgccgcgaacaatccgccacacgcacggaactgccgtttgccgaatacgatgccggacggggcatcggcaaatacaacccgattttcgactggtcggaacacgacgtgtgggcatacatcctcgccaacaatgtgccttacaacgatttgtaccggcaaggatttcccagcataggctgcgacccctgcacccgccccgtcaaggcgggcgaagacatccgcgccgggcggtggtggtgggaaggcagaaacagcaaagaatgcgggctgcacaaataattcataaatatcagacagaagaaataaggaatatggtatgacgaaaaccgaaccgaacaacgcccaactcgactggttggaatccgaatccatccacatcatccgcgaagtggcggcagaatgcgaaaaccccgccctgctcttttccggcggcaaagattccgtggtcctgctcgccctcgcctgcaaagccttccggctgggcagccggccggtgaaactgcccttcccgctggtgcatatcgacacgggacacaactaccccgaagtgattgccttccgcgacgcgcaggcggcaaaactcaatgcccgcctgatagtggggcgcgtggaagactccattgccaaaggcacggtggtcttacgcaaagaaaccgattcgcgcaatgcggcacaggcggttaccttgttggaaaccatcgaggcaaacggcttcgacgcgcttatgggcggcgcgcggcgcgacgaagaaaaagcccgcgccaaagaacggattttctcgttccgcgacgagttcggacaatgggatccgaaggcgcaacgccccgagctgtggtcgctgtacaacaccaggctgcacaaaggcgaaaatatgcgcgtcttcccgatttccaactggacggaactcgacatctggcaatacatcgcccgcgaaaacctcgagctgccgccgatttattacagccacaggcgcgaagtggtcagacgcagggggctgctggtccctgtaacgccgctcaccccgaaaatgccgtctgaaacctccgaaatccttgatgtccgcttccgcaccgtcggcgacatcagctgcacctgcccggtagaaagcaccgcgtccacgccgacggagattatcagagaaacagcggttgccgacatttccgaacgcagcgcgacccggctggacgatcaggcaagcgaggcggcaatggaaaaacgcaaaaaagaaggctatttctaaatttcaaaaaccctttaagcagatatgaggaagaaaatatgacggcacaacaccaaaccccgctccgcttcattaccgccggcagcgtcgatgacggcaaaagcaccctgatcggacgactgctctacgacagcaaagccctgctgtccgaccaaatcaaaaccttggaatccggcaaaagcaaaggtttgaaagaagccatagacttctccatcctgaccgacggactggaagccgaacgcgaacagggcattacgatcgatgtggcataccgctatttttccacggcgaaacggaaattcatcatcgccgacacgccggggcacgaacaatacacgcgcaatatggttacgggcgcaagcaccgcttcggcggcagtcgtgctggttgacgcatcccaactggatttcggcgcgcagcccttgcagcttctgccgcagaccaaacgccattccgccatcctccgccaactcaactgcccgcatattgtggtggcggtcaacaaaatggacctgctggattacagcgaagacaaattcaacgccattgtggaggcataccgccgacttgccgaacagctcggtttgaaagacgcgcatttcgtaccgatgtccgcactcttgggcgacaacattgtttaccccggcggcaatatgccttggtataaaggcgaacccttattgtccattttggaaaccctgccgggggcggacgaagtcagccgcaccgccgacgatttttatttccccgtgcaactggtcgtccgccaagatgccgacaaggccgatgatttccgaggctatcaggggcgcatcgaacgcggttcggtcgccgtcgggcaaaccgtccgcatcgaaccgaacgggctgaccgccgaagtgtccgaaatcatcacgccgaaaggggaagtggcgcaggcttttgccggcgaggcggcaaccctccggctggaccgcgacatcgatgtttcgcgcggcgacctttttgtcgataaaaattccccgctcgccccgcaaaaacatctggaagccacgctttgctggtttgacgaacgtccgctcaacaccgcgcgcaaatacctgctcaagcacggcacgcaaaccgtgccggcaaaagtcggggaaattgaaagcgttttggatgtccgcacgctggaacaagaggccggcgcggaatccttgaagatgaacgacatcgccaaagtccgcatcaaccttcaaaaacccgttacggcaacgccttatgcggaaaacaccgccgccggttcgtttatcctgatagacgaagcgacatacggcactgttgcggcaggtatgattttatgagtgaacacgatatgcagaacacaaatccgccattaccgcctctgccgcccgaaatcacgcagctcctgtcggggctggacgcggcacaatgggcgtggctgtccggctacgcttgggcaaaagcaggaaacggggcatctgcaggactgcccgcgcttcagacggcattgccggcggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccgaaagaagccgtcgtgctgcacaaactgctgaacggcaaaaaagccccgaaattggacaaactccaatttgccgtactgggtttgggcgacagttcctatccgaatttctgtcaggcaggtaaagatttcgaccggcgttttgaagaattgggcgcaaaacggctgctcgaacgcgttgatgcggatttggactttaccgcctccgcaaacgcctggacagataatatcgccgcactcttaaaagaagaagccgcaaaaaaccgggcaacgcccgcgccgcagacaacgccccccgccggccttcagacggcaccggatggcaggtactgcaaggcagccccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatccggcaacggaaatacaggcgggcggaaagatgatgccggttgcgcgcgcactttcatctcatttcgaactcacgcaaaacactccggctttcgtcaaaggctatgccgcgttcgcccattatgaagaactcgataaaatcattgccgataacgccgttttgcaggatttcgtgcaaaacacgcctattgtcgatgtgctgcaccgcttcccggcaagcctgacggcagaacaattcatccgtttactgcgtccgcttgcaccccgtttgtattcgatttcttcagcacaggcggaagtgggcgatgaagtgcatttaactgtcggcgtggttcgttttgaacacgaaggccgcgccagaacgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgattttcggcaatccgcattttgcccgtgattttctctatcaaaccgaatggcagcagtttgccaaagacggcttcctgcacaggtacgatttcgcctggtcccgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattgattaaatataatcgggaggaacacaaaatgaccgtacagaccaagacaaaaggtttggcgtggcaagaaaaaccgctatccgacaacgaacgtctgaaaaccgaaagcaattttttacgcggcacgattttggacgatttgaaagacccgctcacgggcggcttcaaaggcgacaacttccaactcatccgcttccacggtatgtatgagcaggacgaccgcgacatccgcgccgaacgcgccgaggcaaaactcgagcccttgaaatttatgcttttgcgctgccggctgccgggcgggatcatcaaaccgtcccaatggatagaactggacaaatttgcccgggaaaacagtcattaccgctccatccggctgaccaaccggcaaaccttccaatttcacggcgtgccgaaagccaagttgcagacgatgcaccgcctcttgcacaaactgggtttggattccatcgccacggcggcggatatgaaccgcaacgtgctttgcacgtccaacccgatcgagtccgaactgcaccggcaggcttacgaatacgcgaaaaagatttccgaacacctgctgccgcgcacgcgcggttatctggatgtgtgggtggacggcaaaaaagttcaaagttccgacgacttccttcaagaagacgagccgattttgggcaaaacctatctgccgcgaaaattcaaaaccgcagtcgtcatcccgcccttgaacgatgtggactgctacggcaacgatttggatttcgtcgccgtttcagacggtaacggacagcttgccggcttcaatgttttggcaggcggcgggctttcgatggaacacggcaacaccaaaacctatccgaacatttcactggaactgggtttcgtgcctccggaacacgcgctgaaggccgccgaagcggtggtaaccacgcagcgcgacttcggcaaccgcagcgaccgcaaaaacgcccgcacccgctacaccattcaaaatatgggcttggacaacttccgcgcggaagttgaacgccgtatgggtatgccgttcgaacccgtacgcccgttcaaatttaccgggcgcggcgaccgcatcggctgggtgaaaggcatagacggcaactggcatttaacccttttcatcgaaagcgggcgtttggttgacgaaggcgggaaacagcttctgaccggcgtgttggaaatcgccaaaatccacaaaggcgatttccgcatcaccgccaaccaaaacctcatcgtggcaaatgtcgccgaagcagacaaagcaaaaatcgaagaatttgcccgaacatacggattaatccgcaacgatgtcagcaagctgcgtgaaaatgcgatgtcctgcgtttcctttccgacctgcccgctggcaatggcggaagccgaacgcgtgctgccggacttcatcggcgagctggataagattatggcgaaacacggcacgtcggacgactacatcgttacccgcattaccggctgcccgaacggctgcggacgggcgatgttggcggaaatcggactggtcggcaaagccgtcggacgctacaacctccatatcggcggcgaccgtgaaggcgtacgcatcccccgtctttacaaagaaaacatcaccctgcccgaaatccttgccgaattggacgacctgatcggcaaatgggcggcagaacgcaatatcggcgaaggtttcggcgatttcgccatacggacgggcatcgtcaaacccgtattaaatgcacccgttgatttttgggacgcatccaaagccgtcgcgattgcccgcgcctgaacccgtccccgcattcctgcggggattttcttttttgccgcacgccgtttcaatcccgcaaaattccgatacttggtataaaataccctcttttcccactctaaaaaaccgtacccgataccgtctgaaacagccctgtctttcagacggtataggcacaaggaaacacactatgcctgaataccgctccaaaacctccacccacggccgcaatatggcgggcgcacgtgcattgtggcgcgccaccggcgtgatggaaaccgacttcggcaagcccatcatcgccgttgccaactccttcacccaattcgtgcccggccatgtccacctgcacaatatgggccagctggttgcccgcgaaatcgaaaaagccggcgcaatcgccaaagaattcaacaccatcgccatcgacgacggcatcgctatgggacacagcggcatgctgtactccctgcccagccgcgatttgattgccgactctatcgaatatatggtcaacgcccactgcgccgacgcgctggtgtgcatttccaactgcgacaaaatcaccccgggcatgctgattgccgcgatgcgcctgaacatccccaccatcttcgtctccggcggcccgatggaagcgggcaaggttatcggcgtggcaaacatccagcccgaacgccgtttggacttgattgacgcgatgattgaatcggcggacgacaatgtcagcaaccggcaagtcgaggaagtcgaacaaaacgcctgcccgacctgcggctcgtgttcgggtatgtttacggcaaactcgatgaactgcctgaccgaagcactcggcctttccctgcccggcaacggttcgtatttggcgacccacgccggccgcaaagaattgttcctcgaagccggccgtatgattgtcgaaatcaccaaacgctattacgagcaaaacgatgaaaccgtgttaccgcgcagcattgccaccaaaaaagcgtttgaaaacgctatgacgatggatattgcgatgggcggcagcaccaataccattttgcacctgttggccgttgccaacgaagccggtgtcgatttcaaaatggcagacatcgaccgcttaagccgcgtcgtgccctgcatctgcaaaaccgcacccaacaaccacgactactatatggaagacgtgcatcgcgccggcggtatcttcgccatcctgaaagaactggacaaagcgggcaaactgcacaccgacgtgcacaccatccacgcgccgacgctgaaagacgcgattgaacaatgggacgtgaccaatcccgaaaacacccgtgccatcgaacgcttcaaagccgcgccgggcggcgtacgcaccacccaagcgttctcgcaaaaccgtatgtggaaaaccctcgacctcgaccgcgaaaaaggctgtatccgcgacgtggcacacgcctactcgcaagacggcggtttggcggtcttgttcggcaacatcgccgagcgcggctgcgtggtaaaaaccgcaggcgtggacgagagcatcctcaaattcaccggccgcgcccgcgtgtttgaaagccaagaagacgcagtagaaggcattttgggcaaccaaatcgtcgctggcgacatcgtcatcatccgctacgaaggcccgaaaggcggcccgggcatgcaggaaatgctgtatccgacttcctacctgaaatctaaaggcctcggcaaagcctgcgctctcttaaccgacggacgcttctccggcggcacatcaggtttgtccatcggacacgcctcgcccgaagcggcggaaggtggcgcgatcggtttggtacacgaaggcgataccgtcgaaatcgacatccccaaccgcagcatccaccttgccatttccgatgaagagcttgccgcacgccgtgccgaaatggaagcgcgcggcagcaaagcatggaagcctaaaaaccgcgaccgctacgtctccgccgcattaagagcttacggcgcgatggcgacttccgccgacaaaggcgcggtgcgcgacgtagcgcaaatcgaaagataagccccaaaacgtgcggcaaatgctgtctcgtctgaacagtaaaggtctgatgatggacaaatttatctgggcgatggcggtattttccgcaattttggcctcgttatcggcagcggctttagcgcgatcgagtatgtaaaagagctgccgctcgccgccgttgccgtgatgccttgcgcgccgaagtcgttgctgtggttgttggcgaagctgaggtagtcgaatcccgcgtcggcaaggtattgcccgtatgcggagggcgttcggaatgcatagcatattttgggggtttgcacattttttcggcgtaccgccttcgtcaaacagcgtgccttcgaggttgccgacggtaatgtccgcgtcttgcaaggcagattcgacgtttttcagaatattggtatcgggcaggtaatcgaccggataattgctgccgagcataatgtcgcccacgccgataatggaaacggtatcggctgtcttttcgtcaggcgcatcctgtccgtccacatcgccggtatttgaaacgggcgcggggtttgaaccgtcaatcggcagcacggggattccgttccggcaggatgcgccgagggcttgaccccggcggtttgcggtgcggaaacggcataaagggcgaaccttgacgaattgaacatcaaatattcgggcatcgaaaacaggtttgaaaccgccatcctgaagaaaaacggcgtaagatccggcttcgtctccttcgcccccaaccttgccgccgtcaaactgaacgattatgccaaagttagaaaacggattaccaaaaccaaacagaaagccgacatcgtcattgtgatgttccacggcggcgcggaagggaaacaggcggaacacctgccgttcgataccgaaatcttctatggggaaaacaggggcaacgtcgttgagtttgcgcggcttgccgtcgattccggcgcggatgtcgtattcgggcaggggccgcacgttactcgcgccgtcgaactttaccgcgaccgcttcatctcctacagcggcggcaactttgccacctacggcgcaatcaacacctccggcatcagcggcatcgcccccatttttaaaattatcaccgacaaacaggggcggttcgtttccggcaacattatccccatcactcaagtcggcgataaaatccccaaaatcgaccccgagaaaaccgttatcgggcggattatttatctgaaccgcagcgatttccccaaggggaacgggctggatgtctcgcccgacggcagcatcacgcgccggtaaaaagatattggaaatgccgtccggacaaatgccgtctgaaagcctttttccgggtttcagacggcatttttcaatcgtcaataatccactttaatcccagaggctttttccacttcggcgacctcgccttccggttcaaactgcaagggatacaggttgagcttttccatcaggattctgtcgccgtcctcatcaggattgcccgtggtcagcagcttgtcgccgtaaaaaatcgagttcgcgcccgccataaagcacatcgcctgcattgcttcaggcatattgctgcgccctgccgacagccggacataactttgcggcatcgtaatccgcgccacggcgatggtgcggacaaattccgtccagtccaaatcttcggcatcggcaagcggcgtgccttccactttgaccaaccggttaatcggcacgctttcgggctgcgggtcgagattggcgagactggcaatcagcccggcacgttcggcgcgggtttcgttcatcccgacgatgccgccgcagcagactttcaaaccggcgttgcggactttgcccaaggtgtccattcggtcttcgtgttggcgggtgtggatgatgtcgttgtagcggtcggggtcggtgtcgaggttgtggttgtaataatccaagcccgcctctttcaagtcttccgccataccttcttcgagcataccgaacgtgccgcaggtttccatacccaagcccttgacggctttgatgattgcggaaaccgtctccacgtctttgggtttagggccgcgccacgccgcgcccatacaaaaccggcttgcgccgcgcgatttggcgattttggctttttcgacgatttcatccacatccatcatctgctctttgcccagattggtattgtggtgcgccgattgcggacaataggcgcagtcttcgggacaaccgccggttttgatggacaacagcgtggaaagctggatttcgcgcgggttgaaattttggcggtggatttcggcggcttggtaaatgaggtcgaggaagggaagtccgaacagggcttcgacatcgcattttttccaatagcgcgcggtgggatgaggcttgcactcggtcttacggcgcaaggcgacgggggatacggtcataatgtgttctttcgtatttacagcggcgcaatgacgctgacaggcaaaccgccggcgcaatgacggcggttgcgggtaatcaaatggctgaaaacagcggcggcaagtgtaacgcgtttgaaaatacggggcaaacggtttttccgcctttgtgccgcgcagccgggcgatgccgtctgaagggctttcagacggcatcgcccgggctatctcaaagcttccagcagctttccgtgtattccgccgaaaccgccgttgctcatcaccaaaatatggtcgcctacttcggcgtttttcacgatttcggcaacgaaggcatcgaagtctttgccgacgttcagcctgccgcccaaaggcgcgagggcttcggcgacgtcccagtccacgccgccggcgtagcagaacacttggtcggcttctttgaggcttacaggcagggcggacttcatcgtgcccagcttcatcgtgttggaacgcggttcgaggacggcgaggatgcgcgcgccgccgacgcgttggcgcaaaccttgaatcgtggtttcgatggcggtcgggtggtgggcgaagtcgtcgtaaacggtgatgccgtttgccgtgcctttgatttccatccggcgtttgacgtttttaaacgcgcccaaggcttcgcaggcggtctgaatatcgacaccgacatgacgcgcggcggcaatgacggcgagcgcgttcatgcggttgtgcctgcccatcaaatcccatttgacgcgtccggcggttttgccgtcgagcaacacgtcgaacgagccgtcggcattggcttcgccggcctgccagccgtgttccgtgccgaatttttccaccggcgtccagcagcctttgtccaaagtatcttgcaggctttgctgccgtccgttgcagacgattaagccttcagacggcacggtacgcacgaggtagtggaactgggtctgtatcgcgcccaagtcggcaaagatgtcggcgtggtcgaattccagattgttcaacacggcggtacgcggacggtaatgcacgaatttagaacgtttgtcgaaaaaggcggtgtcgtattcgtcggcttcgatgacgaaaaacggcgattggctgttcgggtcttggcgcggcgtttgcggcaggcgggcggaaacgccgaaattttccggtacgccgccaataaggaagcccggcgcgaggccggcatattccaagacccatgcgagcatggaggcggtggtcgttttgccgtgcgtccccgccacaccgagtacccaatgatggtgcagcacgttttccgacagccattgcgggccggaaatataaggcaggccgaggttcaaaatcgcttcaaccacatccatcccgcgcttggcgacattgccgataacgtaaacgtcggctttaaattcgtccaactgagcggcatcgaagccttcatacacgtctatacccaaggcttcgagctgggtgctcatcggcggatacatcttcgcgtcgcaaccgctgacttcaaaccccgcttctttggcaatggcggcaagcccgcccataaacgtgccgccgataccgataatatggatgtgtttcatcaaagttccccaatcgttcaaattttgccgtccgacagcgcaagggctgattcggcttcaatcagtgcggcttgatgccggcagccgaaccgtctttctgtgcatttcctttcggattttggacgtgttcgtccctcaccgtgtccgaataatcgccgacccctgcgtcttccgccctgtcttttactgccggtctaaccgaactgtacacccggtcccgccccaaacccgcgttggtacaatgttttcccggagtttggctgtaactggttttaccattatggcggcacgcgtaaacatttgccgaaaatacggtctgaaccgctgtaacaagcaacatacttccaattattttagatacgcgcatatcaacctcctttatcgttcttcttcaaaaaagggaatgtatttcaatagcacttcatctaattctttcattccctgctcataattgaacgggtattcccaaccatcccctactttgatttcagaaatatctttaaacttccgcttaagggcggacactttgtccatatcgtcatcaatttcctgtttgccgaacggtattttccgcttttccaaaacctcgtcataataacaagataaattaagcaatagcccccaagcactatttgcaattacgactaatctatgtttttccctagttaagtaatctgcaccgctatcatagattgcccttgtcgggtcataaaaaattcgcaatttttcatagcgtccccacactttaaccgattcgcaattttatatccgcgattttgcaagctgcccataaaaaccgattgcctgtcaagacggcactacttgttaaagatgcccgataatgccgcaactcttccgtatttaccgacaaacgccctatttgcttagagctgttttgttttccacaaaactttaattcgttgatttaacaaattttttaccaaattctttatttgttcggattccattagcacgattttgagcaatatctgtcaaaaccatttccaccacacccaagccaaaaccgccgccgccacggcattggacaatcagatgagtttccactgcccgtccttccgcaatgccgccttcttgggcttcaaagcacccgcataaaaaaacggcgacagcagcatagaagcgatacataagaaaatcaatacgccgtaatagattttttcagacggcatttctcttcctcaatacgccgcccgttggcgcatttgttcaaacaggcagattgtcgccgccatcgcgacatttaaagactcggttgcatcgtgcatcggtatcctgacacacttgtccgccctatctaaaactgctttaccgacccccgcgccttcgttgccaaacacccaggctgtcggttcgcacaaatcttcgccgtacaaaaccgcctgcttttcctcgcgcaaggcggtggcaaacacacggcctttatagcgcaccaaccatatttccaaatccgcctgcggataaatctccgacaagaaatgcgcgcccattccggctcgcagcactttgggcgaccacgcgtccgcacaacctttgcccaaaatgaccgcgccgattcccgccgccgccgcgcttcgcaacaccgtgccgacattgcccgggtcttgcacgccgtccaaaaccacgcaatcgccgccggccggcaaagcacccgcatctggaatatcaatcagcgcaagcacatcatccgcacaagtcaggctgctgattttcttcaatatgccgtctgaaacggaaaaaaacccgtcttccggcaaaaccgccgtcaatttacggacttcttcagacggcattttcgcttcgggaatatataccccgaccggcatcccgccggattgcaggaaaacctgaagcaggtgcacgccctccaaaacggtttgggcgtattgccgtctgaactttccttgcgacaacaggcggtgcaggtgtctgatgtgttcattattggtcgaactgatgtgtttcacttcacaagccttttagaaatatgcaaccggacaatacccgactgaacgccgccgaaatctgtttgcgatattatcaaaataaaatgggaaagtcaggatggacgggcaaaatgccgtctgaaaccgagtattggaaatccgcacaacagtttgccaacgccaatggacggtttccgctgtcggcaacaagcggccaaattgggcgcaggacaggcaaaacccgtttcccctgaaggatttttttcacatccttatggatgccgcccatggccaacgtatccgatgccgctaccgtcctcaaaattccgtcctgctccaaaagatgctcaggaagcccaaacggatgccgcttcaacacaaatccctgccccgtcaatatttcccttaaatttccgcttatctgcctgtctttcaaaaaccgcagtttatccgttttttccagtcggaacacaaacagcctgcctgcataatgatgcaattcaaagccttgcaagttccaacgtccggtttttgcctccgtcaaaacccgggcaatgtcggcaagggcattctgattcggcacgggaatgccgttttccttcagaaaatgccgcaaaatatgggttttccggcgcggggaaaacgtcagccaccgcgccgtatcgaaataaccggccccgcaaacccaacggcagtcctgaacgacgacctcgtccaacaaagccaaatcttcctgcaaagcgcggacattgttcagcacatgccgcccgaaatggggaatctgcgccgaaagttcgggcaaaatacggtgccggaagcggtttcgcaaataagccgtatcggtattgctttcatcctcgatattcggcaaaccgtgtttttgggcataatcccatatatcttggcgtgaaaaaggcagcaagggccgccagatgatgcctttttccccaaaagggcggacggcgggcatagccgccaaagcgcgcaaaccgccgccgcgcgcgaccgccagcataaaggtttcgatttgatcgtccctgtggtgcgccaacgccaaaacgtcaaagcctttttcggcaaacgcggcataacgcttttgccttgccgccgcctcgatgcccaaaccgtttttttccacgcagaccttaaccgtttccagccccaccccgagcatatcgcaatagttttggcagaaatctgcccaatcgtcggcacggggactcaagccgtgatggatatgcaatgcatccggaataaaaccgcccttttttccggcgcggacaagcagatgcagcaaaacgacggaatccaagccgccgcttaatgccaccgctgttttttttccattcagaccttgaggaaaacaatccttcaagcattgctcaaacgcatctaaagtcagcacggttccgtcccgataaagaaaaagcaagcagtttcagacaaactgcttgctgcttgttctacctgaattattgttccgaaaatttgccgtaagccataatgcggtcgaaacggcgcgaaagcaaatcggcaagcgggatgctttgcgcttcgtgcagttgtttttccaaaacggcttttacgtttttcatggtttgcccgaaatcccgatgcgcgccgcccaatggttctttgatgacggtatcgaccaagtccagcttttgcaggcggtcagcagtaatgcccaaagcctgagccgcatccgccgccttttcggcggttttccacaaaatagacgcgcagccttcgggggagataacagaataggtcgagtattgcagcatattgacgtaatcgcctagggcgaccgccaacgcaccgcctgaaccgccttcgccgatgacggtacacaaaacaggaacgcgcaggcgcgtcagttcgtacaggtttttgccgatggcttccgactgcccgcgttcttccgcgccgatgccgggatacgcgcccggcgtatcgataaaggtcattacgggcaagccgaatttttctgccgtcttcatcaggcgcagggctttgcggtagccttcaggacggggcataccgaagttgcggcggattttttctttggtgtcgcgccctttctgatgcccgacgaccatcacgctttgtccgttgaaacgcgccaatccgccgacaatcgcataatcgtcggcaaagtggcggtcgccgtgcagttcttcaaaatcggtaaacagtgcctcaatgtaatccaaagtatagggacgctgcggatgccgggaaacctgtgaaatttgggcgggtgtgagtttgctgaaaatcgatttggtcaggtcgttgctttttttctgcaaacggtgtatttcgtccgaaatatcgacggcagactcgtcttggacgaaacgcagctcatcgattttgttggtcagttcggctatgggttgttcaaaatccaaaaaaacaggtttcatagaatgaagctctcatcaacagattctgccgctatcatacgctatttgtgcatattccgcagttaatttattgtccaaaacggcttttccataccctctttttgtgttcggacagcatggaaaacagtggattagtgcatatatactagttataaggcggcgtatcttatgctaaactcgaaacaaattcaattatttcaaacaaaatcgtatgaaagacaagcacgattcttccgccatgcggctggacaaatggctttgggcggcacgttttttcaagacccgttcccttgcgcaaaagcacatcgaactgggtagggttcaagtaaacggctcgaaggtcaaaaacagtaaaaccatagacatcggcgatattatcgacctgacgctcaattcccttccctataaaatcaaggttaaaggtttgaaccaccaacgccgcccggcatccgaggcgcggcttctgtatgaagaggacgcgaaaacggcaacattgagggaagagcgcaaacagctcgaccaattcagccgcatcacttccgcctatcccgacggcagaccgaccaagcgcgaccgccgccaactggacaggctgaaaaaaggagactggtaaaaccattcccgctgcaaacagaagcacgaaccgcgtaccgccgcatttcagacggcattcccgaaacttattccgcctcgtctatccatgcctgctgcacggcttcgaggatgcgttcgccgcaacgggcggggtcgtcgtcaaattcgggcaatgccataatcaggtcgcgcagttgggtaaagcgcacggttctgggatcgatggtttcgccgtgcaggtcatagagttcttcggcgatgcgctgggtgtcggtccatttcatatgaatttccttttatcgtccggcattgaagccgtgtagaatatgtttcggcaaaactgccgccccttgaggattgctgaatgtttcaactcgccggacaacacatcaagcaccagcctatgtgtcgtcctgatctgggaggagttgtccctcccaaacaaatctgattctaccgccccgaagagcggggtttcaaccgacaaggaagattgatgaacaatatgtttgccgcaaaattgtccaaactggtttataccgcttccgaccatcctgattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcatctacacgcaaattgcggaacgccttgccgggtcgggcggcggtttcacggttacggtagaaagcgtgtccgccgcctgtccggagcttgaaggacgctatctcgagcttgtccgccgcgccgccgtctctttcggtttcacgcaaggatgggaaaatccggcaggcgggcaggaaaaaacacaagccgtcccggatgccgcatcgggtcattccgtcagaaaaccaatcaaaatcaatatagaagcgagagtggaacgctatccggcatactgcccgaccgtcgccctaaaagtatagtggattaacaaaaatcaggacaaggcggcgagccgcagacagtacagatagtacggcaaggcgaggcaacgctgtactggtttaaatttaatccactataacccgccggcggtttttccggctgcaaaaccgataaataccggtgcatcgcgtccgagtaatccgcctcggatgccgcactggattattccgtcagaaaaccgataaaaatcaatatatagtgaattaaatttaaaccggtacagcgttacctcgccttgccgtactatctgtactgtctgcggctcgccgccttgtcctgatttttgttaattcactatagaatcgaaagttccgcctgtacgaacgcctgttttcgggcgattgcgccttatccgcgcaacaatgccgtctgaagcgtgccggcttcagacggcctgttttcagtgttcttcgcgcgcgtggttgatggtgtatttggggatttccacaatcaaatcctcgccggcgacaaccgcctgacaactcaggcgcgaatcggcttccaaaccccaagcctgatcgagcaggtcttcttccaattcggtcggctcttctaggctgtcgaaacctttgcggataatcacgtggcaggttgtgcaggcgcaggatttttcgcaggcgtgatcgacttcgatatcatggtcgagcagcacgtcaaggacggttttaccttcgggtgcgttatcgatgactgcaccctcggggcataatgtcgtgtgtggaagtacggtgattttgggcatttttattgtctttctgtaaaaagtgtttgtgttcgttttcggaaaactgtctgcctaatgtcgcggttcgagcaggtcggcaacattttgccagcccgtcaggcaggcaaaatcgagggcggtatagccttccgatgtcgttgaggcaggatttgcgccgtattcaagcatggcttgaaccataagtgcatttcctgcgatggcttcatgatgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcatatctgctcctcaacgtgtacggtatctgtttgcaccttactgcggctttctgccttcggcatccgattcggatttgaaaagttccaaatattcggaataggctttttccaaatccgcccgcgaaaaacaggtgtaaatatggatgccgtctgcaatttcgtcggtcagcctcgtgccgcttttgccgaaatatgcttctttaaaaaggcggattttcgattttttcggcttgtagaatgccgcgcccgccaaaagccggggcagcgcgtaagggtattcccggtgtccgcgccgtaccaaatcaagcagttgtttgcggcctgacccggcattcccttcctgcctgcgttcgtggacgcttttttcaaattccgattccgccgtttcgtttttcgggaacacgatttcgccgcgaagcgataaaaacaaacgtttcacaaggttttcgtccacggcgaacaattcggtatcgcctatcctgcttttgctgaaaatttcatggagcaggttttctttttctttgtaattgtcggttttgacggcgaggatgcgttccaatccggcaacgttcgcataaccgttgttttccaaatggcgcattctgccttcaaaattgcttacatccgaaatgccgattttatacacgcccttgatgacggttttcatcagatagacaatgcctgacttttccatatcgatgtttttcaagtgttttcgagccttcagacggcatcggattatttctatgccgtctgaaaccgtttaagtatcaaatattatcgacactctggcctgtcagcgcgcgttggatgttgcggttcatgcgtttggcggcgaaattgtcggtgatgctgccgagtttggcggcggcggcacggatgtcttcggcttttccgtctttcagacggccttgcaaatcggcgatgccttgccgaatctgttgcaattcttcggcatccagcaaatcgctgtccaactcgagggcggcgttgacggcatcggtcaggctttcggcttcgactacggcttcggcacgggcgcgtgccgccatatcttcggcggcattgctcatgctgtctttgagcatttgggtgatggtgtcgtcgtccaagccgtaggagggtttgacttcgatttgcgcctgtacgccggtgctttgttcttgggcggaaacggacagcagcccatccgcatcgatttggaaggttacgcggatacgcgccgcacccgccgccataggcggaatgccgcgcagggtgaatttggcaaggctgcggcagtcggcaaccagttcgcgttcgccttgtacgacgtgtatcgtcatcgcggtctgaccgtctttgaaggtggtaaagtcctgcgcgcgcgcggtggggatggtggaattgcgcgggatgattttttccgccaagccgccgtaggtttccaaaccgagcgacaagggcgtaacgtccagcagcagccattcgccgtcggttttgttgcctgcgaggacgtttgcctgtatggcggcgccgagcgcgacgacttcgtcggggttgaggttgttcagcggggtttgtccgaagaaggtggcgactgcctgttggacgtgcagcatacgggtcgaaccgccgaccataatcacgcctttgacttcgtttttaccgacaccggcatctttcaacgcctgtgtgaccggttcgagcgttttcatcaccaaatgctgcgtcaggttgtggaactcggcgcgactgatgcttgtgtcgattgccatgccgtctgaaagcgtcgcctgaatgcgcgcttcggtttgcgtggttaattgttctttggcggcgcggacgagcgagagcaggagttggctgtcttgttcgttgagttgggagagtccgttttgttcgagcaggcggcagaacaggcggtggtcgaaatcgtcgccgcccaacgcgctgttgccgccggtggctttgacttcaaacagtcctttggtcagttgcaatacggatacgtcgaatgtgccgccccctaagtcgtacacgacaaacgtgccttccgaggcgttgtccagcccgtaggcgattgcggcggcggtgggttcgttgagcaggcgcaatacgttcaaacccgccagacgcgcggcatctttggtggcctggcgttgggcatcgtcgaaataggcggggacggtaatcaccacgccgaccaaatcgccgcccaaggtttcttcggcgcgcgatttaagggttttgaggatttccgccgacacttcgacaggcgttttcaccccctgccgcgtatgcagttcgataacgcgttgattgtcgccgaaacggtaaggcaggtagtgcgtattttgatgcagatcggcaagcgtccgcccgataaggcgtttggcggagctgacggtgttcagcgggtcggttttttgggcggacagggcggttttgccgacttcaatgccgccgttttccagatagcggacgacggaaggcagggtaacgcgcccttcggcatcgggcaggcaggcggcactgccgctgcggacggtggcgaccaagctgttggtcgtacccaaatcgatgcctgccgccaaacggtgccggtgcggggcggcggacatacccggttctgaaatctgcaaaagagccataaattctgcctgtcggtgcggtgtgtaaaggaaggaaagcggcattttaacagaatttgcgccgatagttgagcaaaccgctaaggattaggtcgtgccgccgaaattgccctctaccgccaaatgccgataaaatccgcctttcccgcccatcattaggaatataaatcgtgaaaggactcgactattgccgccaaaaagcagaagaaagccgctccagttttttgtcgggcttccgtttcctgactcaggaaaaacgggatgcggtaacggttttatatgctttttgccgcgaattggacgatgtggttgacgaatgttccaaccccgatgttgcacaggcgacattgaactggtggcgcggcgatttggacaaggtattcggcggcgcgatgccggaacaccccgtcaatcaggccttgcggcaagttaaggaaaccttcaagctgccgaaatatgaactggaagccttaatcgacgggatgcagatggatttggttcaagcccgttacggcagttttgaagaattgaaactgtattgccaccgcgtcgcaggcgtggtcggctgcctgattgcgcggattttggggttttcagacgaccaaacgctggaatacgccgacaagatgggacttgcgctgcaactgaccaacatcatccgcgatgtcggcgaagacgcgcgcagggggcggatttacctgccgatggaggaaatgcggcggtttgacgtacccgcaagcgtgattttgcaatgcagcccgacgggcaattttgccgaattgatggcgttccaaatcaaacgcgcccgcgaaacctaccgcgaagccgtatcgctgctgcctgatgccgataaaaaagcccaaaaagtcggactggtcatggcggcggtttattacgagctattgaacgaaatcgaccgagacggcgcacaaaacgtcctcaaatacaaaatcgccctcccttcgccgcgcaaaaaacgcattgccctgaaaacctggttattcggattcaaaccgcgccccggcacgccggaacgggcataaggcgcataccgcccgccgcccgtcaggcaaacccgattcccacagccccgccggacggggtttcaaccatcgtctgaaagtctgcatcgtaaccgcgcaatcccgttggcgttcgcgctttgaaatggaattgctgggaatttaaacaggagcagaagtaaatgaaagcagtcagggatatagccttatggctggcagtaacggtttggatcaactttttccccgacagttaccgctatgataccgttccacagggacggtacggatactggcatgcagaccatccgtggtatccctatgcgcgctttctgctgcctttatttttagcctgtatccttttctaccgtcattttcggaaacggaaatagatacggctgcaaaaccattggaggaataaatgatgaacacgccgcatccgcgcccgaaaatcgccgtcatcggcgcaggctgggcaggactgtccgccgccgtcaccttggcgcggcacgccgacgttaccctgtttgaagccggccggcaggcgggcggcagggcgcgcacactggccggaaataccgacggtttcggttttttggacaacgggcagcacattttgctcggcgcataccggggcgtgttgcgcctgatgaaaaccatcggttcggatccccgtgccgcctttttgcgcgtaccgctgcactggcatatgcacggcggtttgcagttccgcgccctccccctgcccgcgccgctgcatattttgggcggcgtgctgcttgcccggcgtgcaccgactgcattcaaagccaaactgcttgccgatatgtccgatttgcagaagtccgcacgcctcggacagcccgacacgacagtggcgcaatggctgaaacagcggaacgtgccgcgtgccgccgtgatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaagcaggatttgggcgcaatcgtcgccgaacccgccttggcggatcttcaacggctcggcgcggacatccgcctcgaaacgcgcgtatgccgtctgaacaccctcccggacgggaaagtgctcgtcaacggcgaagctttcgatgccgccgtccccgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggccttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcagccgatgccccgccgccggacttgtcgtggttgcaccggcaccgcatcttccccgccggcgactacctccacccggactaccccgccacgctcgaagccgccgtacaatcaggtttcgcgtcggcggaagcctgcctgcaaagcctgagcgatgccgtctgaaaacgccggccgacatcgggacgctttacaaggtgcggcaaaacgctaaaataccttaaccgacaaccaaaaaggaaaaagtatggcgacactgtccgacaaaaccatcttagtaaccggcgcatcgcaaggtctgggcgaacaggtcgccaaagcctatgcggcggcaggcgcaaccgtgattttggttgcccgtcatcagaaaaaactggaaaaagtgtatgacgcgattgtcgaagccggataccccgaaccattcgccatctgctttgaccttattagcgcggaagaaaaagaatttgaacatttcgccgccaccattgccgaagccacgcaaggcaaactggacggcatcgtccactgcgccggctatttttacgccctctcgccgctggatttccaaaccgtcgccgaatgggtcaaccaataccgcatcaacaccgtcgcacctatggggctgacccgcgccctgttcccgctgctgaagcagtcgcccgacgcgtccgtcatcttcgtcggcgaaagccacggcgaaacacccaaagcctactggggcggcttcggcgcgtccaaagccgcgttgaactacctgtgcaaagtcgccgccgacgaatgggaacgcttcggcaacctgcgcgccaacgtcctcgtccccggccccatcaattccccgcaacgcatcaaatcccatccgggcgaagccaaaagcgaacgcaaaagctacggggacgtgctgcccgcatttgtctggtgggcaagtgccgaaagcaaagggcggagtggcgaaatcgtttacctctaaatccggaaaaggcaggcatcccgcccgcgccgcgattccgtttgaaaaatatccgtaccttccgcgcgcatccgtcccgcacagacaaacaccttgacttaaatttacataaggacaataatgacaacccgttatttccttaagytgaccatagggtaaatg

SEQ ID NO: 37773 - DNA, 20844 bp, Neisseria meningitidis
taccaacccggatttgccaatacgttacgcaaaatcacgttcggcacgcgggtcgagtaatagcctaaaccgatataggatctgttgatcatgaaagtcgacgcaatgccaagcaattttgccagcgcgtccgcatcggtcagggcatcgggcaaatcgagttcagacggcatacggatgctttgcggcacggtgttgccgacaaaatcgtccatacktttctcgccgacagcggcaagcaacgccgcttcgtcgccaaaactcaaatgccgcgcggcaaattcgtcggggttgaacagttcggacagtttcatttctactccttcgggtttgtagggctgccatcaggcagaatttttagacatcggatgattcgggcaagggtagcacaaaagacgggataatggcggacaatgcgccagaatgcagcaggtcaggacaagcagcgccacaagcggcagcgataagggaaagccgccgcccaaaaccatgaaacctgcaggcaccagccaagctaagggatgcgccggaagcggaaaaacaatattgagcagaaccaaaatcacgacaaacagcggcagacccgccatcaggttggcacgcctgtatgttgcgtacgggtcggatgcttcttcaggttcgcaatattccatgatttcagcctgtccgggctttatccacagcaggctcggacggtcggtcatgccgtctgaaccggcaggccgtctttttcaaaaaacgccataccgctgcaacttcatgcggctgtatggcgtaggctttgcacttcagacggcatatgcgtcccgaagcagtttggtgtcccagtcggttcatgattatataaacaacttgggtgcggataaacctttgtttatctaaacccctgttttctcaaaaattgattcaaatcttcggcaaatttccgatagcctttgccgttggcgtggatttggtcggatttcagattattatcgcccaaaatttccgcccacgcgccgccgaacagcggaatgccgtattcctcggacaaatcctcatacagcggatgatcgctcaaatgcccgaacaacgcacccagtgtgatgtgcggcacgccgacgaggacggcggggatgttttccttctgcacggtttcgatgattttcgcgatattggcgcgggtctgctccttgggaactttgcgcagaaagtcgttgccgcctatgccgacaatcacaagcttgggtttgcgtgccaacagcgcgggcaggcgcgacagggcttgggcagatgtatcgcccgatacgccgccgttgacaatattccaacccgtcagtttttgcagttgcgcggggtaggattcgccagggtttgcgccgtagccgaaggtaagcgaatcgcccaaggcaagtacggtgcttccttcgggaattttggcgtgggttcgggcggattttctgccgcaggcggtaagcagcaacgcgcctgcgccgaggaggaaggttcttctgttcattggtttttcagatggcatcgagccatttcgggtggtatttcagggtttcacggtaaaccggacagctttcggcgtgcgcgcctttgaggtagccggtactcatcagaaattcgccgacgatttcgccgccgacgaatttgaaatgttttttaaagagtttaacccattcgtctttgcttcgcggatggtgcgtgtcgagccagttcttgaacgagccgtattcttgttgcaacgcttggatttgccgtgcattgaaaatggcggcatcgattttcaggcggttgcggacaatgcccgcgtcggcaagcaggcgttcgcggtcggtgtcgtcgaaggcggcaaccgtatcgatgtcgaaaccttcaaatgccgtctgaaacgcctgccgcttcttcagcatcagcgtccagtttaatcctgcctgattgatttccaacaccagccgctcaaacaattcattgtcgtcctcaatcggaaaaccgtattgcgtgtcgtggtaatgtttgttcgggttatcggtgttttcgggaagtgaggcggcaaattcgcaatagttcacggtttactcgaccatctgttgcgccgcctgtttcagtccctgttcgagtgcggcggtcatcgcggcgtagccgtcaccctgctgttcggtttcgatatggaagggtctgttcgtaccgtcgggtaggacggcgtagccgctgatgagggttttgcccgtgtagctgccttggaatgcgtcgatatagaccgtccatttttcggtactgccgctgcgtgaggcaggaacaaagatgcgtgtgctgtccaaacggttgaatgcattgctcaacgccgcttcgagcatatcgtccaaggtgtctgcccagacgtggttttgtgcggtgttgaggcggtaggggtcggtttgatagaccagtccgccgcgtttgagcggttcggcaagacggacttcgacggcagtttcgccgccttgcgttgcaggacggatgtagcggctgtcgggcaacacgaaatattgtgtgctttgcacagtaccgcaggcggcaagcgacagggcggcggcaatcgggaaaaggcgcattatcggcttcctttcgggatagggtctttgctgctgctgttgaaaatcagcgcgttgggtttttctttcaaagtattaatcacgggttgaacgtcttttaaagttttgtccaaactttgcagcgtattttgtacgtcgccgtagataggcgattgcggcgatacgccttgcagggttgtgcgcaactctttcagggtttggttcagttcgttcggaatgttttgtgtctgcggtttgccgaccagtttgtcgatggagcttagggcggcattggcagatttgagtgtggatttgagctcggcaagcgaaccgttcaattcggcaaccgtcttatctaaaggcagtttgtcgaacttgtccagcaaatccgccaatttgacctgcaaatcgtccaaaccgccgccctgggtcgcgataacggtatcgcctgcataaacggtatgcggtcgcagcttaggtgatgcggaaggctgatcgttcaactcaatcattttgcttccggtcagcaggttgttgctggagatggtggcggtcaggcctttgtttaaggccgtctgaaattgttgtttccaatgttctttgctttgttcgtcggcattgatttccaaacgggaaggttcaatgcggatgcgtacgggtatccagccgttttcaaacaggtgcaggctgtcgttgcggtcgaaataaggaacgtcggaaaccacgccgacattcagccctttgtactcgacgggcgaaccgacggtcaggccgcgcacggattgtttgaaaaacgcggtgtagtacagcgagcggtcgtcaggcaggttggcgacttcgctgcggctgtcgtaaagcgtgaagctgtcttcgcttttgacgtttttactgtttttggttttcggcgaatcaaatgaaatcgcgcccgacagcagggcaggcagaggggcggaattgagtttgatgccgctgcctgtggtttcgatattgatgccgctttccagccaaaaacggctggcggaatgaatcagtttgtcgttggggctttggatgaagatggtgtaatgcacgctttggtcggacgggtcgaaatgcgcgctttcgacttgcccgaccataaaattttcatacaaaacagggctgttgacgttgaggatgcggtcgtttttaccaatcaaattcaagcgcagcccgctttgcccgatggcggtaacgggcggaatgtcctgcacttggaacacgtcttttgcctcgtcgcttttgccgggtgtaaaggcgatgtacgaacccgaaagcagcgtacccaaaccggttacgccgctttggtcgatacgcggcttgaccacccaaaactgggtatcgctgcggatgaggccggatacgtccgcattgagttgggcggttacttccacgcctttttggtcgtcgcgcagtttgattcgggtaacgcgtccgacatcgatgctcaatactttgatgaccgtattgttgacctcaatgccttccgcgctgtccatcaagagcgtaaccacaggccccctgttgcggatttccttaacccaaagccagccgccggcaatcagcgcgatcagcggaaccagccagacggcagagaggaaggtgttgtttttgcggacgcgtgcttgggcgtgtccgtttggaggagggctgttgtcagtcatgtttttccgtttcattgaaagcaatgccgtctgaagcgcgtttgtcccaaagcaggcgcgggtcgaaataataggcggacagcatcgtcagaatcacgaccaggcagaaatagactgccgcactgcccggaatgacgcgcgcggcataagtgtggaacgaacacatcaaaataataatcacaaaaatatcaatcatcgaccagcggccgaccgcttcggtgatgcggtagaggtgcgacaatttctttgcacccgttggcaaagcgaagcgggcggacgcaatcaaaaccgacattgccgcaatcttcagtaccggcaccaaaatactcgcgctgaaaataaccgccgcaatcagcctgtcgccctcgtcccacatataagcgatgccgttaaggatggtattgacctccgtggcggcaggattggacgaaatcataatcggcaggatattggcagggaaatacaaaataaccgccgccgtcagaaacgccgacgaaatactcagacttttcggccgtcggcggtacagttccgcaccgcacacgccgcagggggattcggcactgtcgcggaaatacaggcagcggctgcaacaggttttaccttccgatgccgtctgaaccgcattatcccccgtcagccgcccgatttgaaaatacacccaatgctggggaaccgataccgaagtccgaatcagcataactgacagcgcgaacatcagataaaacgccggcccgaagcgaacctctgccacagacgagagcttgatatacgccaccaaagtggaaacaaaaaacacatccaccatcatcgcctgtctcaagcgcaccatcacacgcgttgccaaacgcagcgcaggatacgcctgtttccgtatcagcgcggcatagacatacaggcacagcagcagaaacagaaccggcgcgccgaaagtcagcacaaacatcacttcggccaaaaaaccataatcctgaaacaccatcaggcgcatcatctcgggcagcgaaaggacggatgccgcacccggtatcccgacctcgatatacgtcataccgtaagcaaacgccattaaaatcagcgaagccgccgcataggcgggcggggcggaaaaaggatgcctgcccaccctgaagagtttgtgtccgcaacggggacagaacgccgcttctccactgtccaaccggggtacatccgcgcggcagccgcattccggacaatctaccgtatgcggcggcagggcttcgtcgcagcagttgccgcgaaggctgtgggggatattttcggcaaacggcttcatcgggaaagtggcaaatataagtggcggcattataaaggaaaaaaggcgatacacccaatcaggatgcaaaaccggcaggttcggcagtatgaacaaacccttggtgtccggcaaaaatattttttgagcggttgtccgccgactgccgaacccatttgataaaatcccgattctgtaaagaatagtaaaatacctgcttaaaaacatcacgcaaatgatattttttccaaaaatatgtgataataaatttcgtttatgattctttattatttttatagtggattaacaaaaatcaggacaaggcggcgaagccgcagacagtacaaatagtacggaaccgactcacttggtgcttcagcaccttagagaatcgttctctttgagctaaggcgaggcaacgccgtactggtttttgttaatccactatatatgcgggcaagtgcggattttgcccgcaccgcatccttatcccttaccgacaaaggaaaaaatatgagtgaaaccgaaaatcaagcattgacatttgccaaacgcttgaaggcggataccacggcggttcacgacagcgtggataacctcgttatgtctgtccaaccgtttgtcagcaaagaaaactacatcaaatttttgaaactccaatccgttttccacaaggctgtcgaccacatctataaagatgccgaattaaacaaagccattcccgagctggaatacatggcgcgatacgatgccgtaacgcaagaccttgcagatttgggtgacaaaccttacgaatacggcaaaccgctgccgcatgaaaccggcaacaaagcaatcggctggctttattgcgccgaaggatccaatttgggcgcggcatttttgttcaaacacgcccaaaaactcgattacaacggcgaacacggcgcgcgccacctcgcaccccatcccgacgggcgcggcaaacactggcgcgctttcgtcgagcatctgaacgctttgaacctgactcccgaagccgaagcggaagccatccaaggcgcgcgcgaagcctttgcattctacaaagtcgtgttgcgcgaaaccttcggcttggcagccgatgccgaagcaccggaaggaatgatgccgcacaggcactaaaaaataatcgaaccaaataaacaagaatcgaaccaaataaacaaggtctcggcatagctgtttgcagggacctttaattacacggcgcggctttgtttacatggattactgtcttattaaatattaatgattatcataaaatctattattcgctaaccgatggatgaacaatccatacatcttgagttgataatatgaaaccattacaaatgctccctatcgccgcgctggtcggcagtattttcggcaatccggtcttggcagcagatgaagctgcaactgaaaccacacccgttaaggcagagataaaagcagtgcgcgttaaaggtcagcgcaatgcgcctgcggctgtggaacgcgtcaaccttaaccgtatcaaacaagaaatgatacgcgacaataaagacttggtgcgctattccaccgatgtcggcttgagcgacagcggccgccatcaaaaaggctttgctgttcgcggcgtggaaggcaaccgtgtcggcgtgagcatagacggtgtaaacctgcctgattctgaagaaaactcgctgtacgcccgttatggcaacttcaacagctcgcgtttgtctatcgaccccgaactcgtgcgcaacatcgaaatcgtgaagggcgcagactctttcaataccggcagtggtgcattgggcggcggtgtgaattaccaaacgctgcaaggccgtgatttgctgttggacgacaggcaattcggcgtgatgatgaaaaacggttacagcacgcgtaaccgtgaatggacaaatactctcggtttcggtgtgagtaacgaccgcgtggatgctgctttgctgtattcgcaacgtcgcggtcatgaaaccgaaagtgcgggaaaccgaggctatgctgtggaaggggaaggcagtggcgcgaatatccgtggttcggcacgcggtatccctgattcgtccaaacacaaataccacagctttttgggtaagattgcttaccaaattaacgataaccaccgcatcggcgcatcgcttaacggccagcagggacataattacacggttgaagagtcttataacctgaccgcttcttcctggcgcgaagccgatgacgtaaacagacggcgcaatgccaacctcttttacgaatggatgcctgattcaaattggttgtcgtctttgaaggcggacttcgattatcagaaaaccaaagtggcggcggttaacaacaaaggctcgttcccgatggattattccacctggacgcgcaactataatcagaaggatttggacgaaatatacaaccgcagcatggacacccgattcaaacgttttactttgcgtttggacagccatccgttgcaactcgggggggggcgacaccgcctgtcgtttaaaactttcgtcagccgccgtgattttgaaaacctaaaccgcgacgattattacttcagcggccgtgttgttcgaaccaccagcagtatccagcatccggtgaaaaccaccaactacggtttctcactgtctgaccaaattcaatggaacgacgtgttcagtagccgcgcaggtatccgttacgaccacaccaaaatgacgcctcaggaattgaatgccgagtgtcatgcttgtgacaaaacaccacctgcagccaacacttataaaggctggagcggttttgtcggcttggcggcgcaactgaatcaggcttggcgtgtcggttacgacattacttccggctaccgtgtccccaatgcgtccgaagtgtatttcacttacaaccacggttcgggtaattggctgcccaatcccaacctgaaagccgagcgcagcaccacccacaccctgtctctgcaaggccgcagcgaaaaaggcatgctggatgccaacctgtatcaaagcaattaccgcaatttcctgtctgaagagcagaagctgaccaccagcggcactcccggctgtactgaggaaaatgcttactacggtatatgcagcgacccctacaaagaaaaactggattggcagatgaaaaatatcgacaaggccagaatccgcggtatcgagctgacaggccgtctgaatgtggacaaagtagcgtcttttgttcctgagggttggaaactgttcggctcgctgggttatgcgaaaagcaaactgtcgggcgacaacagcctgctgtccacacagccgctgaaagtgattgccggtatcgactatgaaagtccgagcgaaaaatggggcgtattctcccgcctgacctatctaggcgcgaaaaaggtcaaagacgcgcaatacaccgtttatgaaaacaagggctggggtacgcctttgcagaaaaaggtaaaagattacccgtggctgaacaagtcggcttatgtgtttgatatgtacggcttctacaaaccggctaaaaacctgactttgcgtgcaggcgtgtacaacctgttcaaccgcaaatacaccacttgggattccctgcgcggtttatatagctacagcaccaccaatgcggtcgaccgcgatggcaaaggcttagaccgctaccgcgccccaggccgcaattacgccgtatcgctggaatggaagttttaatctggtattattgaattaatcgccttgttgaaaattaaagccgtccgaattgtgttcaagaattcattcggacggctttttaccgtaaatctgtgtgatggggttttatattgatacagtatccgaactcaggcagggggtaatgttgcaggattaaaaatgccgtctgaaaaatgtttcagacggcattttttggttgccgatatgttaacggacgacgttggcgcgcatgaccacgcggacgtggaacgagcctgcctgacagtcgtattgtccgccttgcagcggctgcttgtcgaagtagctgtggaagccggtaacgccgcgtccgcaagggtggcggcagatgccgcattgtgtttataatgccgtgtcagacgtttgatttatgggaaaataatgatgcttaccaatcaggaagtaaccggtgtcaaactgggataccgcaaagccgttttatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataaatagcaaggtgtgaataaaacggcggatataatcaaatatatgtaatgagattcccaaaatcttggtaatgatgtatattagtcaagttagctaatcatgagaagtgttatgtttcaagcaaatattcatcaggcaaaaaccaatttgagtcaattgattcaaagagcagaagcaggggaaatcgttattattgcgaaggcaggtaagccttgcgtccaactaatcggtattgaaaaaccggcacgaaatgcaggaaggttgaaaaaattcagtcatatggaaaatacggatatttcacgtattcttgaggatgacaatgaaacggcagctttattttttgaggagtcggctctgtgagaaagattctgcttgatacccatgcgttgctgtggtggttgttggatgacaagaaactggggatatctgcacgcaaactgatagaaaatccgagaaatgcgatctttgtcagtgcagcaagtatttgggaaatttccatcaagcagaacaaggggttgttgaaattaccggaagagttttttgatgtgcttcaagaagaggattttgaaatgttgcctataggtctgtttcatgcaaaacaggctggaagccttccggagatacacaaagaccctttcgataggatgttgattgcacaaacccaagcggaaggctttgaactgatgactgtcgatgaatatattccgcaatatggaattagagttgtcaacgcatcaagctgacaaatacaaaaactgtgtacacaagaaagaccgccgaggcggtcttttcggttattgtcttcgcttaaaagccagacttctgtcgtggactataggtgtgtcccgatctgaatctgccgcacaataaggcaaggggattaaaaatgccgtctgaaaaatgtttcagacggcataatggcttaggggttcaacacgcgtgcgatgagggctttttctttaccctgcatattggggattttgacctgaatgccgttgcccggggcaacatcgacaggctggcctttgcgggtcatttgttccaatttgatggtttggttgccgctcgggtggatgatttcgagtgaatcgctgacggcaaagcggtttttgacttccactgttgcccagccgttttcatcgatttcggtaacgtgtccgacgtattggctttgtttggcggtggaatggccggtcaggtagttttgataatcctgagtttggtggcgttcgaggaagccgctggtgtagccgcggttggcgaggccttcgagttcgctcaacaggctgtaatcaaacggacggcctgcgacggcatcatcaatcgctttgcggtaggactgggcgacgcgtgcaacataatagagcgatttggtacggccttcgactttgaggctgtccacgccgattttggcgagtttttcgacgacttcgataccgcgaaggtctttggaattcatgatgtaggtgccgtgttcgtcttccataatcggcatcatttcgcccgggcggttggattcttcaatcaggaaaactttgtcggcgtagggatggcgtttttgaccgttgatgccttcaaagttttggttggcttcttcttgggctttttcaaagttgaaaccttgcagaagctgggcatcgcctgcatcgctttccgtggcattgtgaaccttgtaatcccaacggcaggagttggtgcaggtgccttggttggggtcgcggtggttgaaatagcccgacaataggcaacggcctgaataagcgatgcacaatgcgccgtggatgaagacttcgagttcgatgtcggggcattcttggcggatttcggcgatttcttccatactcaattcgcgcgacagaataatgcgttcgacgccgatgttttgccagaatttcacgccccaatagttggtggtgttcgcctgtacggacagatggatcggcatttccggccatttttcgcgcacggtcataatcaaacccggatccgccataatcagcgcgtcgggtttcatggcaatcagcggctccatgtcggcaacgaaggttttgagtttggaattgtgcggcagggtgttgacggttaaaaagaattttttgttgcgctcgtgcgcttctttaatgccttgttctaaaacatcaagtttggcaaattcgttgttgcgggcgcgcagtgagtaacgcgggctgccggcgtaaacggcgtctgcgccgtagtcgtaggcggcgcgcattctttccaatccgccggcgggcaataagagttcgggtgctttcatcgtgtttccttttcggttgaaaccccgccctttagggcagtagaatcagactttatttgggaggggcgtaaccccttccgaatcagggcaacatatagggcgacgctttatgtgtcgtcctgtgtgttgaaacatgatttgtatgctttgtaaaaatgtttcagacggcattgctgcaaatgccgtctgaaaagggtttgaggatgggcggattatccgcctttttgtattttcggtcaattttgacgggaaatttataaggatttatcaagtatttgcctgcttgggatataatgcggtagtttgaatgcgagagagaatgtgatgaatcctaaaatcgtgtttttcgacattgacgatacgctgtaccgaaaatatacggatactttgcgcccttccgtgaaaacggcggtggcggctttgcgcggcaaaggtatattgacggcgttggcaacggggcggtctttggcgacgattcccgaaaaggtcagggatatgatggcggaagcgggaatggatgccgtggtaacgataaacggacagtttgcgctgctgcacggaaaaaccgtgcgcgaagtaccgatggatgccggtttgatgggcagggtttgcgcgcatttggatggcttgggcatggattatgcgtttgtcggcggagaggggatcgctgtgtccgcgctgtcggaatgcgtgtgccgcgccttgaagcatatcgccagcgatttttttgccgataaggattatttttcaagcaaaccggtgtatcagatgctggtgtttgcggaggaaaacgaaatgccgctttggtcggatattgtggaacgggaaggcttgaaaacggtgcgctggcacgaggaagcggtcgatctgctgcctgcgggtgcgtcgaaaacggacggcatcagaagcgtggttgaagcattgggatgggaaatggcagacgtgatggcgttcggcgacggtttgaacgatgtggaaatgctgtcagaagtcgggttcggcgtggcaatgggcaacggggaacaggcggcgaaagaagcggcgaaatatgtttgccccagcgttgatgaagacggcgtgttgaggggcttgcaagatttgggcgtgatttgaacgcatcataacaaccctgccggtttcagacggcagggtcggttttcagcccttcatacagccttcgttttgaagcagggtaaataagggcgcgccgcttgcacggatattcttgccgccttgaaggtcggtaaattccaaaatggcggcggcttcgacaatttctccgccgagtttgcggatcagttccagtccggcaagcatcgtgccgcccgtggcaatcaaatcatcgaccagcagcacgcgcgaaccgagtttgacggcatcggtgtggatttccaccgcagcttccccgtattcgagcgcgtagctttgcgatacggtttcaaaaggcagcttgccttttttgcggatggggacgaaaccgacgttgagctggtaggcgagtgccgcgccgataatgaagccgcgcgcgtccaaaccggcaacgatgtcgattttctgatccatatagcggtaaaccaataaatcaaccaaaaggcggaagtattccgcgctttgaaggacgggcgtgatgtcgtggaataagatgcctttttgcggccagttttcgattttgcggattttgtcggcaagcgcgccgacactcatagcttcgggatgaaccagcattgcgtgttccaagtttgatgtttttaacgccatattgtagccgtcagcctgtcgcttgccaaatcaatcaaaacaatagcggcaaaatatgggcatcggcaaataggaaactgggtgtccattgtgatacaatcggctggaaaatatacaggtaaaaaatatgtccgcttatcgaaaaggcaacatctttatcatttcggccgcttccggcacgggcaaaaccacgctggtgtcgcggctgttggcaaaccataacggtttgcgcgtttccgtgtcgcacacgacgcgcccgccgcgtgaaggcgaagcaaacggcgtacattatcactttgtttccaaagaagagtttgagtcgcttatcgcgcaggaagcttttttggaatacgccgacgtatttggcaactattacggcacaggcgcggagggtgtgaatgcgttggcggcggcaggctatgacgtgattttggaaatcgacgttcagggcgcggcgcaggttcgcgacgcgctgcccgaagccgtcggcatctttatcctgccgccttctttcgacgtacttgccgcgcgcctcaacggacgcgggacggacagtcgggaagttatccaaaggaggctgtcgaaggcaaggcatgaaatcgagcagtccgtattgtttgactttgtcgtggtcaatgacgacttggcgcgagcggaggaggatttgcgccatattgtgaatgcctgccgtctgaaaaggtcgcggcaactggggtttattgcagatttgttggaaaattcctagaaaacggcgaaaatacccggtttcccaatttaaatatttttgaaagaaagcaaataatatggcacgtattaccaccgaagactgtaccggaaaaatttccaaccattttgacctgacattggtagcggctcgccgcgcccgccagcttgagaacggcaacacgccgcttgtggacgatgtccgcaataacaaaccgaccgttaccgccttaagggaaatcgccgccggacatatcggtacagaactgttgacgcgcaataaataaattctgccggaaacgcacgccggaacactttgccgccgtgcagtccgacggtttgaaatgaaaaacacatacataccgaaagccgtctgaaatgcccgccccccaaccttccgccccttacgaccccctgaccgccgaagcgcgtgccctgcttttccataccgcctcctacctcaagcccgaggaacaggcggagcttgaaaaagctgtcgcctatgcgtttcgcgcccacgacgggcaaacccgcaaaagcggggagccctacatcacgcatccgattgccgttgcgacgcagctcgccctttggcatatggacatacagggtctttgtgcaggcgtgatgcacgacgtattggaagatacgggcgtgacaaaaggggaaatggcggcggtgttcggcaatacgattgccgagatggtggacggtctgtccaagcttgaaaaactcaaatttgaagatcatgcggagcatcaggcggagagtttccgcaaactgattttggcaatgaccaaagatgtgcgcgtgattgtcgtcaaacttgccgaccgcctgcacaatatgcggacgctcggttcgatgcgcccggacaaacgccgccggattgcaagggaaacccttgaaatctatgcacagattgccaaccgtataggtttgaataacgcatatcaagagcttcaggatttatcgttccaaaacctgcatcccaaccgctacgagactttaaaaaaagcgatggacaagagccggaagaaccggcaggacgttgtcggcaaagtcttgcgcgcattcggccagcggctggtaggcgcgaatatagaggccaaaatcaaaggcagggaaaaaaacctgtacggcatccatcagaaaatgatggcgaaaaagctgcgctttgccgaggttatggatatttacggtttccgcgtcattgtcaacagcattccagcctgttatgccgcactcggcgcattgcacaccctctatcagcccaagcccgggcggttcaaagactatatcgccattccgaaaagcaacgggtatcaaagtctgcatacgactttggtcggcccttacggcttgccgattgaagttcagatacgtaccaaggaaatggatgctgttgccgaaggtggaatcgccggacattggagctataaatcatattctaagacggtcgatcaggcggtgcttcacacaaaccggtggctgaaaaatatcttagatttgcaggcaagcagtgccaatgccattgagtttctcgaacacgtcaaagtcgatttgtttccgaacgaaatctacatccttacgccaaaaggaaaaatcctaactttgcccaaaggggcaacgcctgtcgattttgcttatgcggtgcataccgatatcgggcacaaaaccgttgccgcacgtatcaacaatatcatgatgccgttgcgtacgaagctcaaaaccggtgattctgttgaaattatcacatccgaacacgccaaacccaatcccgcgtggttgaatttcgccgtgtcaggcagggcgcgcagcgccatacgccaatatattaaaaaccttaaccggcacgatgcggtcgttttgggagagagcctcttacaaaaagccctgtccagtttgctgcccaaagatgtcctgctttcagacggcatcaaggaaaaatatcttgccgatctcaacgacaagcagacatcgtttgaagaagtgctgtacaacgtagggatggggcataccctgcctgtttatgtcgccatgcacattgccgagttggcaggggagcatttcggcagcgaggtcaggctcagttccattaaagtcgatgggcaggaaagcgggcatattcattttgcagagtgctgccaccctgttcccggcgattccatccgtttgctgttggttaagggaaaaggcatgattatccatagggatacctgcccgacgttgttgaagtccgatcccgaacagcagctggatgcagactgggaaaatatgaacgggcagaactaccgtgtcgggcttcaagtccaatcggaagacagccacggcctgttggcattaatggcgcaagcgatttccgattccggtgcagacattgagtcggtcgaaacaccgtctaaatcccagtcgggaacggaaggttttgtcgaattcaaattcttattgaaagtcaagaatctgaatcaattgaatcagattattcaaaatctgcatagtattccatatatccgcaaagtcatcagaagttgaagcaggtaaaacgggttgccttttgattaacaggcaacccgttttatggtttatccgttcaattgcttatttgctcaaatatacggcaagcctttcaacaatccgcattgccgcttcatctttacttgtttcgggaaaagacagttccccgtcgtccccgataatggtaatccggttggtcggtttgcccattgcgattgaaacatcattggcaacgatcatcggtagctttttcttaatacgtttttcccgcgcatatgtcattacattctccgtttcagcggcaaaaccgatgcagaacggcgggttcggtaatgaggcaatagaagccaaaatatcggggttctcatccaattcgatggataacggtttggcatttttatcttttttgaatttttgagtactcctattcttaaccctatagtctgagacggcggcaacagaaataaaagcatcttgtttgtcgattaaacgatgcactgcgcgatgcatattttcggcactgacggcttgaaccgtatcggatatgccgaaaggcagcgcggtttgaagctgtccgtgaatcaggctgacttctgcaccggcggcacggcacgcccgcgccaaagccacgcccattttcccgctggagatatttgtgatgcctcggacagggtcaatggcttcaaatgtcgcacctgcggtaatcaagacttttttgccctttaaaattttcggtgtccataaatccggaagcagatccagcaattcggcaggttccggcatccttcccataccattttctccgcaagcctgttcgcccaagcccggcatatagacagtaatgccgtctgaaaccagttgtgcgatattccgttggttggcagggttgagccacatttccacattcatcgcgggcgcgatggcaagcggacatttccgtgcggctgccagactggtcagtaggttatctgccacgccgttacagatttttgccacggtattcatacttgccggcgcaatcagaaaaacatccgcattccgggtcaggttgatatgttccataccgtttgaaccgttgccgccgtgcgtgtcggtcaggacaggattgccgcttaaagcctgaaaagtcagcggagaaacaaattcagttgccgagcggctcataaccaccgtaaccgaatgcccctgttttttcagcagtcgcaccaactcgcaagacttatacgccgcaatactgcccgttacacctaaaagaatatgtttgcccattttgacaatttctaattacgaagaaaaaacagcagccattctataacaaagtacggatacattagataccgtttggatacaaaatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtaggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgtacgcaggg

SEQ ID NO: 37774 - DNA, 9941 bp, Neisseria meningitidis
gtagccggcgcacgacaagccttgcggagcggcatctgccgaacaagcctccctcgccgaagaactgggcatcagcattgaccgcaagtttaacgagcagctcaaaggcgtgtcgcgcgacgattcgctcaaacgcatcctcgcgcacggcggcaaaaccgtcagcgaagccgagttcgccgaactgacccgccgtaaaaacgacaactacgtcgagatgattcaggcagtcaaacccgaagacgtgtatcccggcattttgcccctgctggaagcattgagggcaaacggcaaaaaaatcgcccttgcgtccgccagtaaaaacggcccgttcctgctggaacgcatggggctgacccacttcttcgacgccattgccgaccctgccgccgtcgcacattccaaacccgcccccgacatcttcctcgcagcagccgagggcgtagatgcggacatccgccaatgcatcggcattgaagacgccgccgccggcgtcgccgccatcaaagccgccggcgccttgcccatcggcgtgggcaaagccgaagacttgggcagcgacatcgcgctggtctccggcaccgccgagctgacctacgcctacctgcaaagcgtgtgggaacagtcgggcaggtaaaacgcgtcagataaagtgtcaaggaagcaaaagaccgtctgaacagtgtttcagacggcctttttgcttttagaacagaatgataacccaacttacgcaaccctaaaaactaaatgccaatctcttaaccatgctattcaaatttatttgaacgattttttttctaaccagccaaccttaacaatcactattaaaatgcgcgccgatgttctgtctccgcctgtatgcggcttgggcgacggcgaggctgcattcgagcaggttgcggttttcgtattcggacgcggtgtgcggttcggcttggttttgcttccaaagctgcagttgggcgatggcgcggcgcaggccggtatcgttgcgtaggatgcctagatggcgttggttgaacgtttgcaggacggggcggctgaatgtgttttgaaggtcgtctgaaaagatgcctgcttcggcggagaggctttcagacggcctttggaatggttcggcttggaatgcttgtccgtctgcgatggcttgggcgcagagccttgcggtcacgacgcattcgagcagggagttgctggcaaggcggttggctccgtgcagcccagtgcaggcggtttcgcccaaggcgtagagctgcggcagggaggttctgccgcaggggtcggtttggatgccgccgcaggtgtagtgttgcacggggcggacggggatggcttggcgcgtgatgtctaggccgcattgggataaacagtgtcgatggatggatgggaaatgccggcggacgaacgctgcgggttgatggctgatgtcgagcgagacgaagtcttgcgtttgtttggcgatttcggctgcgatggcgcgggcaacgatgtcgcgcggtgcgagttcggcgcggcggtcgtaatgcggcataaatcgttcgcccgcttggttggtcaggatgccgccttcgccgcgcacggcttcggaaatgaggaaggtgcgtccgttttcagacggtcttgccaagcctgtggggtggaattggataaattcgaggtttccaactgcgcagcctgcgcgtatcgccatggcgatggcgtcgcccgtgcattcgggcggcgtggtggtggcggcgtaaatctgtcccaagccgccgcctgcgagtacggtatggcgggcgcggatgcggtaggtttcttgtgttcggcagtcgaggacggtcagtccgcacgccgcgcctgattcggtttgaatgtccaacgccatctgccgctcgcaaacgcggatgttcgggcggcggcgtatttgggcaatcaggctctgcatgacggcttcgcccgtgtagtcggcgacgtgggcgattcgtcggcaggtatgcccgccttcacgcgtcaggtgcaggccgttatgattccggtcgaacgccacgccctgcgccagcagccattcgattgccggtttgccctgcgacaggatggcgcggacggcggcttcatcacacaaacccgcgcccgcttccaaagtatcggcaacgtgtttttcgatgtcgtcctctcccgaccacgccgccgcaatcccgccttgcgcatgacggctggcggtgtcgtccagccggtttttgcacaaaataacgatgcggaacgattcaggcagcgacagggcgagcgtcagtgccgccagcccgtttccggcaatcaatacgtcgcaatcggtttgcatggtgttgtccttgtttgagaggccgtctgaaacggtatagtggattaatcaatgccccgacatatgcgacatggtattgagaagcaccacgcccagcaaaatcaaaccgatgctgacaatcccaatgaaatcagctttctcaccgaaaaacaccacgctgactaaagccgttaaaaccagtcccacgcctgcccaaatggcgtatgctgtagccagcggcatggttttcagtgtcatagacaaggcccaaaaacacaccgaaaagctgactaccacgccaatagaaggccacagtttgctaaacccgccactcagtttgagcatggaagaaccgcagacttcgcttaaaattgctacagtcagaaagagccagtgcatttgcatgtttttacctgataaatgaaagaaagtataattatatcaatgcaataaaataaaaaaacagtcttgttgttaaagattttttgtgtgcaaatcccgtcttgggaaagcaggcgggcggtattttcaggctgcacccattacgaacgacaaatcaggcggggcccatgccgttgaacacatcttttttcttcagccctgccgcaaagtcgagcatacgctgcaaaggcagtttggcggcttcgcccagcttcctgtccaacaggatttcgttacgtccgcttgtcagggcgtatttgatgccgcccagcgaattcatcgccatccacgggcagaacgcgcagcttttacagcttccaccgttgcccgccgtcggcgcggcgataaattgtttgtcgggcgcctgcttttgcatttcgtgcaggatgcccaaatcggtcgccacgatgaattttttttcaggacgcgatacggcggctttgagcagtttgctggtcgagccgaccacgtcgcccagttcgatgacgctttgcggcgattcaggatgaaccagcaccaccgcttcggggtgttccgccttcaacgccgccagctcttgccctttgaattcgttgtgaacgatgcacgaaccctgccacaacagcatatccgcgcccgtttcgcggcagatgtagtcgccgaggtggcggtcgggtccccaaatcagcttctcgccgcgtgatttcaaatacgatacgatttctaacgccaccgaagacgttaccacccaatcggcacgcgctttcacggcggcggaagtgttggcgtacaccaccaccgtgcggtcggggtgttggtcgcaaaacgctgaaaacgcttcttccgggcaacccaaatccaaagaacattccgcctccaaatcaggcatcagcaccgttttttcagggcagaggattttcgcgctctcgcccatgaagcgcacaccagccaccaccagcgtaccggcttcgtgttccgcaccgaagcgcgccatttccagcgaatcgcccacgcatccgcccgtctccaaagccaaatcctgaatcagcggatcaacgtaataatgcgccaccaagaccgcgtttttctccttcagcaaagccttgatttcgtctttcagacgatctgccgtctcgcggtcgggcgtgtcggcaaccttcgcccacgcctgacggatttggcaggcggaagtcggcgtttggatgagtggcatatcgtagtcgaacgagcggcgggcggcggtttgcatgatgtttccttgtagctgtttttcagacggcatgaaggtttgccgtctgtttttcaaactgtttttacattatgctcaacttgagtataatatgcaaggtcgtctgaaaacaggtttgcaataccgtaaaaccgacccgcttcgttccgacaaaccgctttggtttacaataaagcctttcccacccgcagaaagccgagcatggatgcctaccccgaagccgaagccccgccgcaaagcatcgtcgagctggttcccgtattgattgccgttaccgacggcggcctgcgggtattgaccgtcgcccaaggcatgctcctgcccaacggcccgctctcccccctgcgcaattccttgcaggcaggcgtaaaactgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgacagcatcctgcacccggatgcgaaatggcaggactgctacggctatttcccgtgggaagacttgcgcaccgacggcgggcagcgcgacgccgtcgtcggccgcctgcgcatttgggcaaactcggcggacacggaggaagtgcgccaaaagcggctcaagcgcattcatttgtgctggggggtcgaaccggaaaactggtcggaagaatacgttttgcaacgctatgaaatgctgtatgaaagcggcctgatagcggaagccgccgagccgcaggcaaacttcgacttcgcgcttacggggcagcccatgcgccacgaccaccgccgcgtactggcgaccgccctgtctcgcctgcgcgccaaaatcaaataccgccccgtgatttttgaactgatgccgcccgaattcacgctgctgcaactgcaaaacagcgtcgaagccatcagcggcagattgctgcacaagcaaaacttccgccgccagattcagcagcaaaacctcatcgagccgtcggataccggcgtatcgggcagcaaaggccgtcccgcgcagctttgccgcttccgcgacgacgtcctgcccgacaggctgatttcggacatcggactgccgctgggcagccgttagcccgttttcagacgacctatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgtaaaatgaagttttgccccatcggtgcaacatcaatctttttcaacaaaggaaaccccatgccgtctgaaaaaaccctctttcccctgcccgacaccctgttgcgccccatagtagaacaagccttgagcgaagacttgggcaggcgcggcgatattacgtccgccgccgtcatcgcccccgacaaaaccgccaaactcttccttgtcagccgcgaagacggcgttatcgccggcatggacttggcgcgtctcgcctttcagacgatggatccgtccgtccgcttccaagccgaaatccgagacgggcaagccgtccgcgcaggtcagacgcttgccgccgtcgaaggcaacgcccgcgcgctgctcgccgccgaacgcaccgcgctcaactacctcacgcacttaagcggcatcgccaccgccaccgcgcgtgccgttgccgaagtcgccgaatacggtacagacatcgtgtgcagccgcaaaaccatccccctgctgcgtgtcctgcaaaaatacgccgtcagggcaggcggcggtgtgaaccaccgcatgggtttggacgacgccgtgctcatcaaagacaaccacctcgcctattgcggcagcatcgcccaagccgtgcagcaggcaaaacaggctgtcggagcattgacctgcgtggaaatcgaagtggatacgttggcacaactggacgaagccatcgcagcgggcgcggaacggattttgctggataacatggacgacgaaaccctgaaagaagcggcaaaccgctgccacacgcaaaccgcccacccccacaccatctattgcgaagcatcgggcggcatcggcttcgaccgcctgaagcgcgtggcgcaaaccggagtggacggcatcgccctcggctatctgacccacagcagccgttcgttggacataggtttggatttcgtggcgtgagttttagggtgcgggcggctgtctgatatgtcaggcaaggaaccgcttaaccctaatccggttattgcctcagggaggaaatgccgtctgaaagattcttcagacggcatttttcgtaaaggtcgtgatgctttagaaaaaacagcatttcaggcaggtattttgtttgcccgacagcgcggcggcatcggtagggcaggaaaaaggacggggggcggcagttttatgccgtctgaaagcccgcctttacgcttgtttgcaaaaaaagtgggaaaaggaacatacaatcctgtacaatcatccataaatatttgatttataatacgatttataaagataatcacaatcatccatatctgccgcccgtcaatccgcttggcgggcggcaaaggttttaggaataccgatgaacacaataccgctccacaccatactcaaacttatggcgcatcccgaacgtatggcgatactgattcaattgttggacagcgaacgcaatatcgccgaactggcaaaatccttatccctgccggccaccgcagtttccaaccatttgaaccgcctgcgcgtggaaggtctagtcgattttacgcgttaccaccgcattatcgaataccgcctggtttccgaagaagcggcggcgattctgcacacggttcgcgatttggaaaacaaacgcgtggcatagtgttagaatcctttccttttgccgtctgaacgtttcagacagcatttttcggaaatgttatgaaaatcaccacttggaatgtcaattcgctcaatgtgcggctgccgcaggtgcaaaacctgcttgccgacaatccgcccgatattttggttttgcaggaactcaaactcgatcaggacaaatttccggccgccgctttgcaaatgatgggctggcactgtgtttggagcgggcagaaaacctacaacggcgtggcaatcgtcagccgcagcgtgccgcaggacgtgcatttcggtttgcccgcactgccggacgatccgcaacggcgcgtgattgcggcaaccgtcagcggcgtgcgcgtcatcaatgtctattgcgtcaacggcgaggctttggacagccccaaattcaaatataaggaacagtggtttgccgcactgacggagtttgtccgcgatgaaatgacccgccacggcaaactggtgttgctgggcgatttcaatatcgcgcctgccgatgcggactgttacgaccctgaaaaatggcacgaaaaaatccactgttcgtccgtcgaacggcagtggtttcaaaacctgctggatttgggactgaccgacagcctgcgccaagtccatcccgaaggcgcgttctatacctggttcgactatcgcggcgcgatgttccaacgcaaactgggcctgcgtatcgaccatattttggtgtcgcctgcgatggcggcggcgttgaaggatgtccgcgtcgatttggagacgcgcgcgctggagcgtccgagcgaccacgcgccggtgacggcagaattcgattggtaaaagaccgtgttttgatatggcgttgacaagcatccttatcttcaatttattcaataggatagctttctatctgactgaaaaataattgcctttccccggcaaacagccgaaatcggcggattgttcaaacacagcctattttcctgaaaaatttatgaaatacatagggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcagacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcccgacagataacacagatttttataagggtttttatttaaataaggattatatagaaggtatatatcctagtaggcataatggcagctattacaaaatatagtggattaaatttaaaccagtacagcgttgccgtactatttgtactgtctgcggcttcgtcgccttgtcctgatttttgttaatccactatatctgcatcagtttcatgaaacgcaagtcggaagcgtcaaacaactgattgcccattttgaccggctgattgacgaattggacaaacaaatcgacgaccacacccacacgcattttgacggcaaagcccaagtggcagaacaaatcaaaggcatcggttcgataacgacggctacgctgatggcgatgctgcccgaattgaggcggctgtcgcacaaacggatagcgggtttggccggcattgccccgcacccgagggagagcggggaaaccaaattcaaaagccgctgctttggcggaaggtctgcggtgcgtaaggcactgtatatggctaccgtggcagcgacacgttttgaaccgcttattcgggatttccaccaacgcccgctgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgctacggctcgatgaatcgtcagaaatacctgcatcgtcattcccgcgcaggtgggaatccagaccggtcggtgcggaaacttatcaggtaaaacggtttcttgagatttttcgtcttggattcccactttcgtgtgaatgacggaatgtaggttcgtgggaatgacgtggtgcaggtttccgtatggatggattcgtcattcccgcgcaggcgggaatctagtctgttcggtttcagttattttcgataaatgcctgttgcttttcatttctagattcccactttcgtgggaatgacgggattttaggtttctgattttggttttctgtccttgtgggaatgacgggatgtaggttcgtaggaatgacgtggtgcaggtttccgtgcggatggattcgtcattcctgcgcaggcgggaatccagtctgttcggtttcagttatttccgataaatgcctgttgcttttcatttctagattcccactttcgtgggaatgacggttcagttgctacggttactgtcaggtttcggttatgttggaatttcgggaaacttatgaatcgtcattcccgcgcaggcggcaatctggaatttcaatgcctcaagaatttatcggaaaaaataaaacccttccgccgtcatt

SEQ ID NO: 37775 - DNA, 2445 bp, Neisseria meningitidis
gtcggttcggttttgatgcagcgtatgaaagaagaaaacgacttcgcccacattcctgaagcgtttttctttaccacttccaacgtcggcggcgcagcccctgatttcggtcaggcggctaaaacattattagatgccaacaatgttgccgaactcgccaaaatggacatcatcgttacctgccaaggcggcgattacaccaaatccgtcttccaagccctgcgcgacagcggctggaacggctactggattgacgcggcgtcctcactgcgcatgaaagacgacgcgattatcgtcctcgaccctgtcaaccgcgatgtcctcgacaacggtctcaaaaacggcgtgaaaaactacattggcggcaactgcaccgtttccctgatgctgatggctttgggcggcctgttccaaaacgatttggtcgaatgggcaaccagcatgacctaccaagccgcttccggcgcgggcgcgaaaaacatgcgcgaactcatcagcggtatgggcgcggttcacgcccaagtggcggacgcgcttgccgatcctgccggctcgattctcgacatcgaccgcaaagtatccgatttcctgcgcagcgaagactatccgaaagccaacttcggcgtaccgctcgccggcagcctgattccgtggattgacgtggatttgggcaacggccagtccaaagaagaatggaaaggcggcgtggaaaccaacaaaatcctcggccgcagcgacaatccaaccgtgattgacggcctgtgcgtccgcgtcggcgcgatgcgctgccacagccaagccatcactctgaagttgaaaaaagacctgcctgtttccgaaatcgaaacgattttggcaggcgcgaatgactgggtgaaagtcatccccaatgaaaaagaagccagcatccacgagctgactcctgccaaagttaccggcacgctgtccgtccctgtcggacgcatccgcaaactgggcatgggcggcgaatacatcagcgcgttcaccgtcggcgaccaacttttgtggggcgctgccgaaccgctgcgccgcgtattgcgtatcgtgttgggcagcctgtgagccctgtttgaatggaaatgccgtctgaagcctgtttcagacggcattttccttgcaaccctgccggataacgccctgccggcactgccgacgtaaaaaataaaggattccatttccggcggtatgcggcagcccgactttatccgaacctgatgcgcctgcacgtcaatgaaaacagcccgattgcggacttcctgctacagccgaaattccgataaggcaagcgttcacgccagcaacatttcctgcatcagcttcataccccactgccagccgccgagcatgccgttcaaactgcccgaatgcggggaaaccaacaggcgggcgttccacaaatccgcctgtttttgcgcccaaccgtgcggcacgccgccgtgttcgggtacaaccaatgcggcacggcagggacagcggacgcgttggaaagcgtgttccgcatcgtcgggaaaaatatcgggacgctgcggtacaaggatgatgttggcaattttcttccgtgtcaggatgtctgcctgatacagccacgccaaaaatgcggccgcgcccgcaccgtgtgcgacaacggcgacgtatttgccgcgtatgcgttcaaatgccgtctgaagccctgcctgccattcccctatgctttgaccggccgacgcttcggacatctgcacgacgggataactgatcgcccaacggtctatccacatctgatcctctccggcatcgcgtatcagccaaagcgtcaaatcttcgagttcaaaaccctgcataccgccccgcctatttcagcaggtcccggagggtaaaggcgatgagcagcgaagcgggtacgctcaatatggcgcagacggtcaggcaggcaaaaatattcaccacccgccgccagcctttccaacccaaacatttggacgcaatcagcaggcagggcaggcaaatcagcagccacaccaacgcccatatcgggtttgccttggtcggcgcaagccagccttgcatccgcgacaacataaatatcgcccacaccaacatgggcaggataaacgcagcgacgacccatgccgcgcctattcctgtttttccgtccacattccaatcatatttacccaaaaccttattcggcagcatagtcatactccacgaccagcggcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcttgcgcgttggcattgccggaagaaagcaggctgctgttgaaatcttccgtccagtcccaaatcagcccgtgcatatcataaac

SEQ ID NO: 37776 - DNA, 78845 bp, Neisseria meningitidis
ggaatttcgtgtcaagctttcgtgtgtgaaaatttttgcagtggaaacgtggacgggcggtttgacgatgacataccactgtttcggaatatccatttcgtccagcctgtcgcctataccccgcgcaaacgcatttttgccgaaaataaaaaacggtacgtccgcccccagagccgcgcccgaatcaatgagctgccgctgcgtcagaccgcactgccaccaacggttcaacaccagcaaaacggttgccgcatccgagcttccgccgcccaaacccgcccctgtcgggatttttttgtccagccatatttccacgccggcggggttgcgcgcatatttttgcagcaacgatgcggcacggtagctcaaatctacttcctgcggcatgccatcaaccggattgtgcaggatgattttgccgtcgtccctcggtttcaaatatacggtatcctgcaaatctatcaggcagaatatgctttcgatattgtgataaccgtcttcccgcctgccggtaatcctcaaatcgagattcagttttgcaggtgcggaaaacgcctgccgtccgtccgcaatattcatctgtccgccttatctcgtgcgcgccgcacagcgttccggggtttcggtttcagacggcataccgatttcggtgaaaaccagcctgatgttcaaatttccgttattcagttgcaacgttcggacttgccccccactgtcggcggttctgccgacagtccaaccgtattgttccaatatgccgtccggcaggatgcggtaaggcgcgcccgccacacgcctgccatctgcccagatatgcagatattggattggcagtttgaaaccgaccagctgcctgctcaattcttccgcactttccgcctgatagacatttcctttgccgtccactgccaatgcgccgtccctgtcttgacacaactgcccgagcgtactgcccaaaggggtattgatattgatggtttccacgggcggttggtatgtccaatcgaaatttgcatacgaacctttcccttccgctttcactgccaaccgcccttctgctgcaaaactgctgatgtgttcggacggctgccacaggttttcgttattttgaggtaattgcgcgcaagcggtcaaaagcaggatgaccgatgcggatacggtgtgtttcatcagaatttccttaacggatgccatcctgccggccgatgggttcggcgtgccgtgcaaaacgcgtgcgaactgcgtgccgtttgcccgaatgccccggcttcccggcaaaccttatgccgtctgaaaggatggacctgcattatttccgaggttttcgggaaggttggggcaatgcgatgccgtgacgtttgagcgtttcccgccatattttcttgtctcccgtaaggtgtgccgcctgcgtccatacgtcaaccgcctgatcgcgttcgcccaatgcccacaacacttcgcccaaatgggcggcaacttcgggctcggggtcgttttcaaacgaataccgcagatacggcagcgcgctttccgcgtcgcctttcaggtaatacgcccagcctatgctgtcgttgacagcggtatcgtccgggttgatttggtatgccgtctgaagcagggcgaaaccttcgtccaaacgtttggaatcggtcagcaggctgtagcccagattattcataatctgagcgttatcgggtgcaagcctgaacgccctttcaagatctgaaatcatttttttccgcttgccaagccgatcgtaaacaactgaccgctgtaccaatgcctctgcctgtaactctgtattactgccggcaggcggtttttcgataatcttgtccaaccccctcaaagcctcccgtttatcgggcagcttcgacagggcgagcatctgtattttggacaaattgtctgccgtaaaataccgcccctgctgttcgggaagtttccgcaccctgccgatctgccgcaaagccgccctgccgccgtccaactcgacagccgccgcagccgccagcacacctttgtcgaacaggtattccggcgcggatacttttttcagccactgcctgactttggcgtaatccctgcggtcggcatacatcatcgccgccgttagcgccgccctgctccgctgttcctccgtccccctgccgtatgccttttcggcgtagccgtcgataacggaagcaccttcttttcggtttgccgccaatatcgctgcctgaatatacaggtctgcattcggattgcgttccaacagcacgttcaaacgcgcataggcatcatccagcctgtgcagggaaaccagattcataatttccatttcctgccagacggccgaaaggttttgggtgtctgtctgctcgaaaaagccgtcgagtatttcgggatatttgcgtgcagtcagacgcaacgtcattaaagtggggggcaatatttccgtatcgagcttcgccaaacgctgcaaagctccgattgccttttccttttcgcgtccctgtacgctgaacaccacatcggcaaccgccgcttcgggcagatgttcatatttcaacgccgcgcggcgaaccgctttcgatgctttttgcgccaacccgtcctgttgcacggcggcttgtgccaacaataaaaacaccctgcggttctgtccttcgtccgcctgagccagcacttcttccagtccgtccagatgctgatttcctctttccctcagcacgttccgcagccaccccgcccgtttttgcgccttacccggtataggctcaatctgccgccatttctgataaatcatttccgcctgttcaaacgcgttcagcgacacggccatttccaaggcgcgttcggcgacttcgggggattttgtgcgttccaacatcagcatataggttgccagagccgttcccgcctgccccttttgcaaggcggtttcccctcccagcaacgtaaatatctgattaacccgctcgcccactgccgcaagccgtgcgcgttcgtttttgatttcttcctcgctgtaacgctgctgctttctgaaaacctttccgacttccttcggctgtttcatatcccccgcaccgcctccggcggcagatacctgtccggcaatcaaggttgccgtcaacacagttaacattttgaaacggttaggtaacataatcatcctttatccgacagccgtccgaaccttcagacggcatataatcaggcgtaactttatcacaagcagaatcgtttgtagatttgcgaaaccccgttcaaaaaataaatgccgtctgaaacgcaaatccgcttcagacggcattcccgacgcttgcggtttaagggagttttatttccaaattgtcaatcaggcgcgtcgtccccagacaggcggcggccaagaccaccagtttcttatctcccgcccgcgccacttcgagcgtatcggcgcggcggatttcgacataatcgaccacccagccgtattctgtcagggattggacggcacgtttttccaaacctgcataatccaaactgccctgcaccaaggattcggcaacagcctttaattcgcggtacaggcgcggtgcttcgtcgcgttccgccgcactcaaatactggttgcggctcgacagtgccaacccgtcttccgcgcgccctgtatcaacaggcactatttcaacatcaaaattcaaatcttcgacaaaacctttaatcacggcaagctgctggtaatccttcttaccaaaacaggcaatgtccggggaaacgatgtggaacaatttagaaacaaccgttgccacaccgcgaaaatgccccgggcggaatttgccgcacaactcattttgcagattgggcggttcgacgttgtaacgctgttccacgttcggatagagttctttctcatcgggcgcgaaaacaacggcaatgccttcggcggcaagtttgtccgcatcctgttgcaaagtgcgcggatatttgtcgaaatcctcgccctgaccgaattgcaggcgattgacgaaaatgctgaccacgacactgtccgcgcgttttttcgcctcacgcacaagcgcaagatgtccttcatgcagattgcccatggtcggcacaaatgccacctttcccgcatttttacgccacgcgcgcagttctcgaatggtatgtatgatttgcataacggtaatccttatccttcgggcttcctgcccgacaaaacgcgccgattatacgcgccgcgcacggcaaaacaaaatgccgtctgaaacggctttcagacggcatgctgcatgtaaaccgctcaatctgcaaaaatatgttccgcagcagggaaggttttggctttgacttcggcaacatacgcccgaaccgccgcttgaacactatcatgcccctgcataaagtttttgacgaatttcgccgtcttacccgggaaaatgccgagcatatcgtgcatcaccaaaacctgcccgtcgcaatccgcacccgcgccgatgccgatggtcggacaggaaacagtttcagttaccttttttgccagttccgccagtacgcactccatcagcacgaccgccgcccccgcatcgtcatgcgccttggcatcgttaagcaacgcctgcgccttgccgccgcgcccctgaactttatatccgccgaaggcaaacacggattgcggggtcagaccgatgtgcgcacaaaccggaataccgcgcatttgcaaaaattcagtcgtttccgccatccacacgccgccttcgagtttaaccatatgcgcgccggcagccatcagttcggcggcggcggcaaacgcctgctccttactctgctgatatgcaccaaacggcaaatcgctgacaatcatcgcattttttgcaccgcgtgctacacattcggtgtgataacacatatcgcgcaggctgacgggcagcgtcgatttccgcccctgaaccgccatccccaaagaatcgccgaccagcagcatttccacgccggcatcgtccatcagcgcggcaaaactggattcgtaagcggtcagcatagcgattttttcgcccgccgccttcattttttgcagtgtgttcacagtaatcatcagatattgttaccccgcccttttcagacggccttttcagtttgaaacgggctattatagtgaaatgcccgcagccctgccaccgaccgtgccgcaaatgcaaaacagcccgactgttttacacaatcggactgtcaaatctggtgccggcaccaagagtcgaactcgggaccccctgattacaagtcaggtgctctaccaactgagctataccggcttactgaaatgttttgcaacaccatcagcagaaatggtgccggcaccaagagtcgaactcgggaccccctgattacaagtcaggtgctctaccaactgagctataccggcaaagaaagcgaattatgcaggcaatgccgcaccttggcaaggaatttatccgaaagccccggcaaatccgaataagtaatttatttgaaaagaaattaatttgaaacagaacaagcatcggcattctgataaaatatccgcctttcaaaccgaccgttcacaccgatggcaagacatccctaccgccgcctgcgtcctgcaaaatccggctttcccgaagtcggcatttccgaagaaggcaatatccgttcgcttcacttgggcagcgacaccgttcaaagctcgatgaacctcgaccacccgtccgagctggtgctctcttacagccgcgcgatgatgggctggctgctgtttaccgacgctcttccgcaacatatcacccaaatcggcttgggcggcggctcgtttgcacgctggatagatacctacctgcccgacacgcgccaaaccgccgtggacatcaatccgcaggtcatcgccattgcccgcaacctgttcgagttgcctttcgagggcgagaaatttgaaattattgaagcagacggtgcagaatatatcaaagtcttccgccacaacaccgatgtgattttggtggacgggttcgacggcgaacaaatcatcgatgcgctggttgaagaaccgttcttccgagactgccgcaacgcactctcttcagacggcatattcgtaaccaactggtggagcggcgacaaacgctaccaacgcttcatcgaacggttgttgagcgtttttgaagggcgcgtcttggaacttcctgccgaaagccacggcaatgtcgcggtaatggccttccaaagcagccccaaagagcaaaacatagacaaactcaaaaaacgtgccgacaaactgagcaacgcatacggattggacttccaccgtatgcttgccggcctgaaagcgtccaaccccaacaacggcaagcatttccacctttaagcaactatcttcacggctgcatcggaacatgcggaaaatcaagaggaaatcattatgctgaaacccgaaaccatacacatatccggtcctgccggcattttagaaaccatccatatcccgtccgaacaagtaccggcacgcggtgttgccgtcatcaatcatcccaaccccctccagggcggaacaaacaccaacaaagtcatccaaactgccgccaaagccttaagcaaactcggcttccactgctacctgcccaaccttcgcggcgtaggcggcagcggaggcacacatgattacggacgcggcgaaacgcaagactgcctcgccgtcatcgattatgcccgcgcccaacaccccgaagcccccgaatttgccttatccggcttctccttcggcggttatgtcgccacatttgccgcacaagcgcgcacacccgatttattgctgctcatcggcgcggcagtctgccactataccgaccgtccggaaccgtccgccgttcccaacgttgccaaaacgctgatgatacacggcgcggaagacgaagtcgtcgaaatcgggaaagcactgaaatgggcggaaccgcaagatttgcccgtcattaccatcgccggttccacgcatttctttcacggcaaactcatcgtcctgcgcgacaccatcctccgcttcgcgcccgtatgcctgaacggataaaacccctttcagacggcatcgataatgtaaaacccgtatcggcggcatccgccgatacgggtttgcgttccctctcattataggcaaaatccgctgcaaaacaccctttcccgacccgacaaaggatctgcaaacgcaatcttttttgccaatagcttcaaaggtttccgataatcctcgctgcccgcttcagacggcacgggatagagcgcgtcattcaacagcggcatacccaaacccatcatatgcacgcgcaactggtgtttcttgcccgtatgcggcgtaaggcggtaaaggctgaattcccccctgttttcaatcagttcgaccgtcgtatgtgcgtttggttcgccttccgcctcttgcgtcgtaaaaaatttctcacccctcaccaaacgcgaaaccacatcgagcggatacggcaaatccgtccttgtcggcgcaagcgcctcatacgttttccataccgttttgttttgaaacatcgtctgataggctccgcgcgtggcaggattgtgcgacagcagcatcacgcctgccgtatccttgtccaagcggtgcagcggcgtaatgtcctcaacattcaaatgctgcaattcaggccgcaaacgcaggcgcgtgagcagggtttcccgcaaaaacctgccgctggggatgacgggcagaaaatgcggtttgtccaccacaatcaaatgctcatcaatatgcaaaatcttttcttcaaacggaatacgcggctcgctctcacggctggtttcacggtaataaaacaccaccttacccggctcgaacaaagaatgttcgtccaacgccgcaccatccgaaccgaccacaaaaccgctgttcaaccgcctgcgccaatcgtccgcgcccacaaaaggaaagcggatgcacagaaaatgcagcagcggcagcccgtaaaactgcttttcatgcggcagcaccaaataactgggtttgacaccgttcaacagcggaagaggattattgcgttttttcatgcggcggattgtaaccgtttttcacaaacttttcagacggcatatcgaaacataattgacaaaaacaaacatattgttttttatgatttaaaaatttatttagacaagattatcggatattcattattattagtaaataagaattaatatcaataggagaaatatgaagcgcatctttttgcccgccttgcccgccatcctgcctttatccacttatgccgacctgcccttgacgattgaagacataatgaccgacaagggaaaatggaaactggaaacttcccttacctacctgaacagcgaaaacaaccgcgccgaacttgccgcaccggtttacattcaaaccggcgcaacctcgtttatccccattccgaccgaaatccaagaaaacggcagcaataccgatatgctcgtcggcacgctcggtttgcgctacggactgaccgggaataccgacatttacggcagcggcagctatctgtggcacgaagaacgcaaactcgacggcaacagcaaaacccgcaacaaacggatgtccgacgtatccctcggcatcagccacactttccttaaagacgacaaaaaccccgccctaatcagctttcttgaaagcacggtttacgaaaaatcgcgcaacaaagcctcgtcgggaaaatcctggctcatcggcgccaccacctacaaagccatagatccgattgtcctttccctcaccgccgcctaccgcatcaacggcagcaaaaccctttcagacggcatccgctacaaatcgggcaactacctgctgctcaaccccaacatctcatttgctgccaacgacagaatcagcctgaccggaggcatccaatggctgggcaggcagcccgaccggacggacggcaaacgggaatcctccagaaacacatccacctacgcccatttcggcgcaggtttcggtttcaccaaaaccacggctttaaacgcatccgcacgtttcaacgtttcagggcaaagcagttccgaactgaaatttggcgtacagcatacattttaagcaggttttgattttccaaccttgtaatccaaaggagttattatgaaaaaacaaattaccgcagccgtaatgatgctgtctatgattgcccccgcaatggcaaacggattggacaatcaggcatttgaaaaatacgtattccacacgcaggcagatgcgccgatgcagttggcggagctttctcaaaaggagatgaaggagactgagggggcgtttcttcctattgtggcaggtgctttgatgggaggggcaattagtgcttgggctaatcacggcatttctaaaattaaaacagggcaatttgcttcaacaagaagtaccttggctgcaaccgctggtggtatgataggcggcggatatagcagtgcgatgttgcgcggtgcagggattactactagtgtttttgcccgttctgcttggaaagggggaaatgctattcctaatgcagttattcgtgcaaatggtgcagcattaaatcagtcttctagcgccgcaatgggaaaacatagaagataaacgaaatggatgatctaatactatattttttatcaggtatattcggaaatcaagttgctgaatatattataaaaaacaaccgtgagataaaagttccctttattgtgctttacgcaatattttttacgttgatttatactgtggctttgttgtttctcagtctaatctattgggtcaatggtgcggagattgcatggaaggggataggtattttcagtatgtcggtcagtttttgtatagtcttctgtctttatttgattgacaaggcaggaagatgtaaggataagaaacaatagggatcagatgcggcagcaaacgtagattgggtctaggctcaacctgcgtttgctgcatctttggaagaaatagtggattcgaaaaaataggaagaattctgattaatggtatgcgaggtgtagcagtggggactgttgctggtggcataaatggttatgcaggttctacgggtaagaacactgacattcgccgttaaataataaataaaccaacttccaaccaaacctgctatcggtttggttggaagtgagaggaggtaaggtagtgtttgctgttattttcttttcgacattgggctgtattttagcatggataagagatattcctaaaataaaatcaaaaaaaattttggcaagatccttatatattataggaataataaatgtaataatcagctatgtattaattaaaaatatattggtttctgtttcggatggaggtggaataaaatatgttgcaatatatttatcaaatctttttttttggacagtattgatgtatgttcttgtgaaaagattatctaaaaagccaagctgaaacccagtacacaactcatcaataaaaatcccttttgcacggaacaatgacaatattcaaattgctggatttgcaatctgatttacctattgaaattgggtgtgcaacatacgttctaagcagggctttgattttccaaccttgtaatccaaaggagttattatgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaaggagacagagggggcgtttcttccattggctatcttgggtggtgctgccattggtatgtggacacagcatggttttagttatgcaacgacaggcagaccagcttctgttagagatgttgctattgctggcggattaggcgcaattcctggtggtgtaggcgccgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaactcctcctttttttctatttgaagatgtgtctttggatatatttcaaggattgtcggaattggaaaagaaaatagagccgcaggatttgatggatgatgtttaccgtgcttttgattcggttggaaatattctgaatttccgtatagtagaaaaagagcaaaaagggttttgggtaagtaccaaaatcaaaacagttgtatttgattcggcagatatgtcttctgatgatctttttctgaaatgcttacagtcttcatataaggcttattttgaaactgaacctgccggtttagataaacggcagctgatgaaaacgttaattcaaaaatgcggattcagttgttgacgaaaaaatggattctgaactaacagaaactgatttcgaccatgtatgaggtaaaaaatgtctttcggctatttgattgcaacatcgcaaccttgcgaattgttgacaaaatctcgaggtgaaactttttctttaattatggataagatggatttatggatttatttcagattttgtgaaggaaatatttatacaataaggaagaatgaaactgaatcttgtcttacagaaagaggaggcgaatggttgaaacatatttatgaatttaatcggggaagttttattttttcttatgtgcttctaaaaaagagagaaagcgaagagaattttacagaaattgttttaaaatcaataaaaaataataaaattttgacagttaaggtacggtcaggcttgcattttgacttaagaaatatttatcgtattgagatgtaataatgcaattgatatgtgccgattggacaggtataggaaattttatgaaaaccttcgaaaaaacatggtctgcacaatatcgggatatggaaatttcagtacggaatttttggaatttggagcggacaggggcggaagtctatatcaacggaaggcgggtttatcataacgaagccgaaatggcgtctgcttctttgcgttagctaatgggggaatacctggaatttgaagaaagcggtacgaaaattaccgttgaaatcggcagcgcgtggcattttaatgaaactataagaaatattaatacacatttaagaggtacgaaacttccaggttctaactggagagttcaagataaggggcattttcatctttggaaaagataatagattttaaggtaagggagactaattttaatcaggcatggcgtgttatacgcgccatgcaaatagataatatatccgatgaacaggttgtgattgtcagaatgtcttgttatcttaagaaagatgaaatttttaagaatatagaaagatatggatatcagtcatcagatattaagaaaattagtcctccttttccattaaatattttacctgttcccaaaccttattatttttatctttatgatacccatttgaatcaaatttatgatttggcttggtcatgtaatgattttttaatgtttgaaatatttattttggatagggaaagcatcaaatatatagataaagataaactttttaaatctagagaaacactatattcgaattttaaatctattaaaaatcaatgcaaaaattattttttttgcggttttgattttgatgccccttactttaaaagcggtgtgagtcaggtggcagattataattttgttcctgatgcattttctttattctttatttaatcaaattatttgaataagcgtagggtgggcacttgctgcccacgcgttctgtttcaagtttattattgggtgaatatttggaatttgaagaaaacggtacaaagattgctgcggaaatcgacagtgcatggcattttttgggcgcggcttgtcggatttcaataaatggaaagtattatgcgggtaatcggattgtttggtttgccaaaaaagccgaaagctaggaataatttgacaagggcagcctgaaagattttcaggctgccctttatgtggacaatatgatgaagttcaaatatgtttttctgttggcgtgtgttgtcgtttctttatcttatcgtttgaatgctgcaccgatgtttaacgataatcctgttgtttacggaaaaatcaaagtgcagagttggaaagcgcggcgggatttcaatattgtaaagcaggatttggatttttcctgtggggcggcttcggtggcgacgcttttgaacaatttttacgggcaaacgctgacggaagaagaagtgttgaaaaagctggataaggagcagatgcgcgcgtcgtttgaggatatgcggcgcattatgcctgatttgggttttgaggcgaagggctatgccctgtctttcgagcagctcgcgcagttgaaaatccccgtcatcgtgtatctgaaataccgcaaagacgaccatttttcggtattgcgcggtatagacggcaatacggttttgcttgccgacccgtcgctggggcatgtttcaatgagcagggcgcagtttttggatgcttggcaaacccgtgagggaaatttggcaggtaagattttggctgtcataccgaaaaaagccgagacaatttcaaataaattgtttttcacacaacacccaaaacggcagacggagtttacagtcggacaaatcaggcaagcacgtgcagagtaagtcaaatgccgtccgcaaaccacctccaacctcacaaaccctttaaaatccgctataatcgcccgcaatttgatttaagcattcttacttgaaatggcacaaaaaatccaatccgtcaaaggcatgaacgaccttctgcctgtcaagcaaaaagatttcaaactgacggctgcgttttggcaggcgtttgaagatacggtcggccgctggacacgcgcttacggttatcagcaaatccgtacgccgattgtcgagcaaaccggtttgtttgtccgctccatcggcgaggaaaccgatgtggtcggcaaggaaatgtacaccttctccgattcaaacgattctttgagtttgagcttgcgtcctgaaggtacggcttcctgcctgcgtgcggtggtcgaacacaaccttctgtacaatagcccgcaaaagctgtggtatatggggccgatgttccgccgcgagcgtccgcaaaaaggccgttatcgtcagttccatcaggtcggtatcgaggctttgggttttgaagggccggatattgatgcggaaatcatcgcgatgtctgccgacttatgggaaaaattgggtatccgcgaatacctgactttggaaatcaacagcttgggcaaccgtgaggaacgcgcggcacaccgtgcggcattggttgaatatctgacccgttatgaagataaattggatgaagacagcaaacgccgtctgaaaaccaatcctttgcgcgttttggatacgaaaaacccagatttgcaggaaatctgcaacgcggcgccgcgtttggtggattacttgggcgaggattcgcaaaaccactatgtacgcttcaaggcgatgttggatggtttgggtatccaatatattgaaaatccgcgcttggttcgcggtttggattattacaatcagacggtttttgagtggacgaccgacaaactcggcgcgcaggcgactgtgtgcggcggcggccgttacgatggcttgattgaagaactcggcggcaaacctgcgccgtctatcggctttgcaatgggtatcgagcggctgctgcttttggtgagcgaatacggctctctggaagtgaacgctgcgcctgatgtctatgcaatgcaccaaggcgaaggggcggacttgcaggtgatgaaatacgcacaagccttgcgcgcgcaaggtttcaatgtaatgcagcattccggctatcaaagcctgaaagcgcaaatgaaaaaagccgacaacagcggcgcacgctttgccctgattgtcgcgcaagacgaactggcgaacggtacggttacgctcaaagacatgaacggcgcacacggtcagcaaactgtcgccgccgaggatttaacccctactttacaacaatggaagaacgcataaatggcagcccatctcgaagaacaacaagagttagacaactttaaatatttttggaaaaccacgggcaaatggctgtttgccttgctgattttggcggcactcggctacttgggatacacggtttaccaaaaccgtaaagtttcccaaaatcaggaagcggcggcggtgctggcaaacatcgtagaaaaggcgcaaagcaaagccccgcaaagcgaaatcaatgccgaattgaccaaactccaacaaagctacccgcattccatttccgccgcccaagccacactgatggcggcggcaaccgaatttgacgcgcagcgttacgatgttgccgaaggccatttgaaatgggtgttgtccaaccaaaaagacagcctgattcaagcgttggcggcgcagcgtctgggcgttgtgttgttgcaacaaaaaaaatacgatgccgcgcttgccgcgctcgatacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataaatgccgtctgaaatgccaccctctcttcagacggcatttcagacaacactatcctacggcaattcccgtaaaacccatccgccgtgtccaacggacacctgctcgtgttcagttctcccgaacggcacttgacacagaaagactcaatcatgaaaccaaccatcgcgcttgttggtcgccccaacgtcggcaaatctactttattcaaccgtttgacgcgcaccaaagacgcgctcgtgcatgacctgcccggtctgacgcgcgaccgccattacggacacggcaaagtcggcagcaaaccttatttggtcatcgataccggcggtttcgagccggttgtggacagcggcattttgcacgaaatggcaaaacaaaccttacaggctgtcgatgaagctgatgcagttgtgtttttggtggacggccgtaccggtttaacaccgcaagacaagattattgccgaccgtttgcgccaaagtccgcgccctgtttatttggccgtgaataaaggcgaggggggcaatagggctgtacttgccgccgagttctacgaacttgctttgggcgacccttatgttatttcaggtgcacacggcgatggtgtgtattatctgattgaagatattttggaaaaattccccgagccggaagccgaagaagccgatgcaagacatcctgtttttgccgttatcggtcgtccaaacgtcggcaaatctacgctggttaacgccattctcggcgaagagcgcgtcatcaccttcgatatggcaggtacgacgcgcgacagtatccatatcgatttcgagcgcgaaggcaaaccgtttaccatcatcgataccgcaggtgtgcgccgtcgcggcaaagtggatgaagcagtggaaaaattctccgttatcaaagcgatgcaggcggttgaagcggcaaacgtcgctgttttggtattggacgcgcagcaggacatcgccgaccaagatgcgacgattgcaggtttcgctttggaggcaggccgtgctttggtggtggcggtcaataaatgggacggcatcagcgaagaacgtcgcgagcaagtgaaacgcgatatcaaccgcaaactgtatttcctcgattttgccaagttccactttatttccgcattgaaagagcgcggtatagacggtttgtttgacagcattcaggctgcctacaacgcggcgatgattaagatgccgacgccgaaaatcacgcgcgtattacaaagcgcgatcgagcgtcagcaaccgccgcgtgccggcttggtgcgtccgaaaatgcgttatgcccaccaaggcggcatgaaccctcccgtaattgtggtacacggcaattcgctgcacgcgatttccgacagctatacgcgctatctgacccaaacgttccgcaaagccttcaatctgcaaggcacgccgctcagaattcaatacaatgtttcggaaaacccgtatgaaaatgcggaagacaaaccgaagaaaaaaccgctgcgccgcgtcagcctgagcaaccgtattgagaaacgcgaaggccgaaaggaagagaaaaaccgcttcaagaagaaaaccaaagtcagtgtgaaaaaacaattcagcaaataattcccgacatttcaaacaataggaaacattatgtggttcaagcagattagtttttatccgctcaacaaagaaaagctgcctgaggcagacgtacttgccgacaaacttgctgaagctgaatttacccattgccaaggcttagactggttcagcgaaggctttaccgcaccggtttcattctcccctgaactcgttttccctgccgactttaccttgcgcgtcgccctgaaaaaagaagaaaaagtcctgcctgccggcgtcatccgcgatattttggaagagaaggtagcggaaatccaaaacaatgaagcccgcaatgtcggccgtaaagaaaaacaagagcttaaagagcaaattacagacgacctgctgccccgagcgtttacccgcagcagccgtacagaagcggtgtttaacacccgccacggctacctgctcgtcaataacgcggcttccgccaaagcagaaaacatcctgaccaagctgcgcgaagctttgggcggtttggaagcctcgctgccgaataccaagcaatcgccctcttccttgatgaccggctggctgttgcaagggcattgcgaaggcggttttgaattagacagcgattgcgaactcaaaggtacgggcgatattgttcccgtcgtcaaagtatccaaacaagatttaaccgccgacgaagtggttcaacacgtcaaaaacggtaaaaccgttacccaactgggcttggtgtggcgcgaacaaattgcctttatcctcactcaagacttcacactcaagcgcatccaatacctcgacgtattgcaggaagaagccgaaagcaacggcgacgatgccgccggccttgccttcgcctcgcaaattctgatggcggaatccgtcagcaccatgttggaagaactggtttcctatttgggcggctggcaagattgatttttcagacggctttttcacgacaaaataccgtcaaccaaaatccaatggaataacccttatgcttaaacatctcgcattcctactgcccgccatgatgttcgccctccccacttcggccgccgtcctgacttcctatcaagaaccaggctgcacctacgacggcaatgtcggcaaagacggtaaacccgccggcaaaggcacatggcgctgccaagacgggcgcaactataccggttcgtttaaaaacggcaaattcgacgggcaaggcgtttataccgttgccgccaaccgcgaaatatttatcgaaccgttcaattccgacagtaccaaattccgcaacatggtactctcgggcacgttcaaaaaaggcttggcacacggcagatttaccgtctcgcaaaacggcgaaaccctcttcattatgaaatgcgaaaacggcatgattaaagaagtgaaactgcccaaaaacaaataagccccgttttcagacggcatcccccaatgctttgtccgaacactgcaagaaacaaggaaaacattatgagcatcaagtccgacaaatggatacgccgaatgagcgaagaattcggcatgatcgaccctttcgagccgaaccaaatcaaagaagccgacggcaaacgcatcatctcytacggtacgtccagctacggctacgacatccgctgcgcaaacgaatttaaaatcttcaccaacatcaacagcaccatcgtcgatcccaaaaacttcgacccgaaaaacttcgttaccgttgaagacgactgctgcatcatcccgcccaattccttcgcactggcgcgcacggtcgaatatttccgcatcccgcgcaacgtcctgaccgtctgcttgggcaaatccacctacgcccgctgcggcattatcgtcaacgttaccccgttcgaaccggaatgggaaggctacgttaccctcgaattttccaacaccacccccctgcccgccaaaatctacgcaggcgaaggcgtggcgcaagtcctcttcttcgagagcgacgaaatctgcgaaacctcatacaaagaccgcaacggcaaatatatggggcaaaccggcgttaccctgcccaaagcctgaaatataaatgccgtctgaacccttatcgtcgggtttcagacggcatttgccgttcacctcaaatcagaactgaaccgtcccattgacgctgatgctgatttcctccacaccaggcgcggcggaatccgcaccctccatattgacgcttgccgccatcggcatggcacgaagcatttttgcctgagcagctccccctcccgcgatatggctgccgatgtgtcccaaattcaatttgacgattttataaccggacgcacccaaaacgcccgccaacttttcggcacgcgccttgaaacgcaaaacggcatccttgctgacctgatcgatgacctcgttgcggcgttcgcgcgacacatggaaatccgtatattccaacgcggcatctgcttgaatatcggcaataaaacggtttaactcatcaaaatctctaccttcgaccttaaattccgcacgctcctcccagcctgtttgaatgcgtctgccgttggtatattgatagcgcggcatcgcactgcgcgataccaattcggttttaaagctaccatttttcgattttctgatgaacttgttgaattttttaacaaactcagcattgacggcatttttgtcccgtccttccgccgtcacttggaaacgtgcggacattgtatcctgagccacctcgacacccgccgattcggaaaattcgacaatattgtaattcaatgcttcagccgctgccggaaaagataccgccgacagcgaagccgccaaaacaagacgcaacatatccgcctccttaccgataaaactgccaatctaacacaccggcgcgccaaattgcattagcgtaaggcaacaatttaaatattcggtctgcgtctgtcttataataaccgcctttccgatacggaatcccactatgcccgaacccttgcacgtcctcgtcatcccctcatggtatccgcaatccgaacaggatgtggacgggatttttttcaaaatcaggcactggcattgcagaggaaaggcatcaaaaccgccgtgcttgcaccgatgttccgctacttgcggaaagaaacagcaagcatcctgaccgacccttacggttttgcaaaatatagtggattaaatttaaaccagtacagcgttgcctcgccttgccgtactatctgtactgtctgcggcttcgtcgccttgtcctgatttttgttaatccactatatcggcaaagcggtttggacatctatgcatggcacggcatgtatttcttcccccgctttccgttcatcgacatcgaccgcatccgctgggtgtgtgcgggtttgaaagctttcaaacactacatccgcgaaaacgggctgcccgacctgattcacgcccactgtatgaactatgccggcatacttgccttcaagatttcccaaaaatacggcatcccctatgtcgtcacggaacacagcagcaccattacgcgcggtttggtgcgcccgcaccaatggcagcctatgaaaaatgcggcggcacacgccgccgcacgtctcgccgtcagccgccatttcgcacacgtcctgcaacacaaatacggctgcgaatggcagtacctcccccaacatactgggcggaatattcaaccgaccgtttgaacaaagagaaaaaaaacaacaaaccgcatttcgtgttctgcaccgtctcgcaccttcgccgtctcaaaggacacgatgtcctactcactgcctttgcccgggcgttggcacaatgcccgcaactgcgcctgaacatcggcggcagcggacaggaagaacagcggctgaaacagcaggcggcagacttgggcattacccatgccgttacatttttgggcgcattgcagcccgaagcagtcttggatttgatgaggaacagcgacgcattcgtccttgccagccgcacagaaaccttcggcgtagtctatatcgaagcactgtcccaaggattgcccgtcattgcaacacgctgcggcggtgcggaatctattgtttcagacggcaacggatatttggttcctgttgacgacgacgatgcccttgccgacgcactcatcaaaatgtgtgaacaccactctgatttcgaacctgcccgacttagagaaaactgtctgaacgaatttggcgaaaatgccgttataggcaggttgatcggcattttccgacaggcaatcgcagaatacggtaagaaaataccggtgaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttaaatctaatccactatagattaaaatcacacaatatccaactattcggaccttcatatgacacataccgtccacctgcatttagaagaaaccgacaacttggcgttgcagcgtctgtgcggttcttttgacaacaaccttgatttacttgccaaagcactcgatatccacatcagccgccgttttgaacatttcactttcaacggcgcatttgcacacgccggcaaacgcgcactgctcaaactcttggaaacggcgcagacgcgcgacctaaacgacggcgacatcaggcttgccgccgtcgaagcccaaaccgaagatgccggtcatcaagaaaaaaaccatgaccacgcctattatttccgcaccaagcgcggcagcatcggcggcagaacgccacggcaaaacggctatatccgcgccctgctcaaccacgacatcgtattcggtctcgggccggcaggtacgggcaaaacctatctcgccgttgccgccgccgtcgatgcgatggaaaaacaccaagtcgaacgcatcattttagtgcgcccagccgtcgaagccggcgagaaactgggcttcctgcccggagacctgacccagaaagtcgatccctaccttcgtccgctttatgatgccctctatgacctgatgggctttgaccgtgtaaccaagctgattgaaaaaggcctgattgaaatcgccccgctcgcctatatgcgcggcaggacgctcaacggcgcatacatcatcctcgacgaagcgcaaaacaccacgcccgaacaaatgaaaatgttcctgacccgcatcggcttcggcgcgaaagccgtcattaccggcgacaccagccaaatcgacctgcccaaaaacatcaaatcgggattaaaagatgcgcgtgagaaactgcacaacgtggaagggctgtatttccacacctttaccggcgaagacgttgtccggcatcctttggtgcaaaaaatcgtcgaagcctacgaatcggcagaacacgactgacattccaatgccgtctgaaacccgatgcatggaaaatcaggcagagaaaaacagatacggaagccaagctccgtatccgtatccgtttctttatccgtccaaccgatacatcaatcgaattttctgcatcggattgcctcatcttcgcaaaacattgccgaagtttcgcggttgcacgcctgacgcactttctgccgcgccacgccttcattccgatcgcttgcctcaaacgtcttctgaaaaggcgtaacgctgcatacatacatggtggaatttgaaccgaaaaggtcgattttgacggtattgccgccgctttccaatacggcgacacggtgttccaactgcgccagacgtgcttccaaatcgccgattctgtcggcaaatgcaggcatggcggcacacgcggtcaaaatgcccaaaatacattttttcatcaatttttccttgttgcttgaaccctgcccacccggacatcctttttccgagaggcagggttagactttatttacggggatgaatccccttacaaatcaggataatgcatagaacggcactttatgcttcatcccatgtgttgaaacttcattgctccatgtctgttgacccttattcccaatccgttcccacaaccttcggcttgggtttgcgcctgcgacggcggcgttttttcgcctgtccttcgtttttttcgtgtcgggcggcggcttcgtttttggtcatctccgaccgctgttccgtcgatgccgtctgaaacgccgtccaccactcggcaagggcgcggtccgcattgccggtttcggcgcgcaagagcaggaaatcataggcggcacggaaacgcgcctgtgcaaacagtttgtgcggccttgcgcctttgcggttttcaaactgcggctggaacatccaaatttcgcgcatcgtggcggaaaagcgttgcggcacgccccaaccgcgttcgacggtttcgcgcatcgtattgattgcatcggacagggcgggcgcgggtttcaaaccctgttgcagattgcttttccaatggcgttccaactcgggccacatcagagccgccaatacaaaaccgaccgaaaccgatttgtcggcacgcagccgctcatcggtatttttcagggcaagcaccgtcatttttccggcgatgccgtctgaaacgcgcaaggcattgagcagcagatggatgtcgtccggtatgtcaaatccgttcaaacgttttagacactcgcgagcgtgccctgaaaacagcaatttcataatttcgtcgaacagcctcgctaccggttcgtgcttcagacggcatatcgattcggcaatcggtgcggcggtttcttccgacagctcaaagcccaatttgcccgacaggcggatggcgcgcaaaatcctgacagggtcttcctgatagcgttcggcggcatcgccaatcataaccagcctgtgggcggcaacatcggcaatcccgttgtggaaatccaaaatctcttctttttcaggatcgtaatacaaggcattgcaggtaaaatcgcgccgcatcgcatcttcttcgatgctgccataggtattgtctttcataatcctgccgcgtgcattctgatgtactttcgcaccgccgcgaaacgtcgttacttcgatagtctctgcaccgttcatcacatggacaatctgaaaacgcctgccgatgatgcggctgcggcggaagagtttgtgcacctgttcgggcgtggcatcggttgcgacatcgaaatctttgggttcgatgccgagcagcaggtccctgaccgcgccgccgaccacataagcctgaaaccccgtccctttcaggcggcgtatgacgttttcggcggcaaagctcaacatttcggcacggatgttgtgtctttcggcaggaatgaccgttttactttccgcttttttactgctccgaccggaaggcagcatcttattcaaccattttttcagcataaatattctgacccgaagagcggcatctccacaggcaaccgtgttcagacggcatcaggcgcggtttgcaagatgccgtaaccataaacaaaaggcgtagaaactacgccgtccgaatcacgccgccctcgcggcggcaacgcgtcattataacagattgccctccaaaaaaatcagaccctgcttttgtggcagagtctgaaatttgatgcgccttctccgattgggaacattcccgtcgtacaaacaggcaaatgaaggaacagaaatcacattcaaacagtgttccgccgcctctacgcggcttcccagtaatcgatatacagctgcaattcgagattgttgcgccattcgttggcaacggggcggtaaaccgtgcggatgtattcgggaatgtcttcgctgcaacgccaaaacatcgcttcaaattcgcagccgtctttttgcagccagacttttttgtgtttgccctccgcgcccaaaggttgctggcggacgacgtggaactcgtcggtaaagctcggcggcgcgaagccctgcccccaaacgtgacgggcaaggttttgcgcctgttccaacgtgatgtcgcaggcgggcaggctgccgtcggtgatgaaggtttgcgacaaatcgtcttcgcacaccatttcgcgcacggcttcttcaaaggtcgtctgaaacgcgggaatgttgtgttcaagtatgctcaaacccgccgccatcgcgtgtccgccgaatttcaaaatcaaatcgggatggcgtttggacaccaagtccaaagcatcgcgcaggtgcaaattgggaatggaacgtcccgaaccgcgtacttcgccgttgtcggcaggcgcaaacacgatggtcggacgataaaaacggtctttgaggcggctggcgacaatgccgaccacaccttgatggaagtcgtcgcgatacgccaccaaagtcatctgacctgaaggcagggtttcggggaaatcattcagtgcgtcttgcagcatagactgctcgatttcgcggcgctcgatattgaggttgtttaactgagccgccagttcctgagcttcggaatcatctcgcgccaacaggcaggcgatgccgaccgacatatcgtccagccgtccggcggcgttgatgcgcgggcccaacgcaaaacccatatcaaacggctgcgccttgcgccaatcgcgccgcgccacttcaaacaaggcgcggataccggggcgcattttgccggagcgcatccgtttcaaaccttgcgacacgaggatgcggttgttgtggtcgagagggacgacatcggcaaccgtgccgagtgcgaccaaatccaaaagttcgcccaaattcggctctttgatgccgtctgaaaaataattgcggcggcgcaattcggcacgcaacgccatcaatacataaaaaatcacgcccacgcccgccaagcttttgcttggaaaaccgcagcctttttggttcggattgacgatgatgcagtcgggcacggtctcggccggcaagtggtggtcagtaacgatgacatccaaacccagagcctgcgccctcgccacgcctgcgatgctggcgataccgttatccaccgtaatcagcaaatccacgccctgcgcggcagcgatttcggcaagttcgggcgttaagccgtagccgtgttcaaagcggttgggcacaaggaaatccactttcgcccccatcgccgccaaaccgctcataccgacggcacacgccgtcgcaccgtcggcatcatagtcggcaacaatcaggattttttccttgcgcccaaccgcatccgccaaacggcgggcggcggcttcgcaattcgtcaacgattgataaggcaggagggaagcgagtttgtcgtccaattcggcaggactttgcacaccgcgcgaagcacaaagctgggcgattaaaggatcggcaccggcggtgagcaaatgattaaaaacgtcggtattgacggatcgggtttggattttgactgacataacgtggggttttactgtgcgtgtgtgcttaaaatgccgtctgaaagcttttcagacggcattgctgttcatttgcgggcggcatccacgaccgcacccagagccgccgcaggcaaggccagtaccgcgcccgccgcatccagtatcaaaaaggggggcgtatataagatatttgcaaacagcttggatttgtcggtatgttcttcagtaaccgtgtaataaatatcggcaggcacactttgctcaaaatggtaatcggcgttcagtttttgcggtgtggcgtagtatttgcctttggcggatacgcagcgcgtgtaaatggtccgattgtcgagtttgaccgcttcaaacccgagctgtttcagcttggcgatgtcggcaggcttgtcggtatcgtagcgcaggcaaaggccttcggtactgaaattctggctgccaggcgattcgagtttgaccggcagggcttggtggcgagcatagctcggggtatcctcaactatttggaagggtttgtccagccctgccttcaaaatgcccgtcagcttcgccgaatcttcgggattgacgacgaaccagtattttccgcccatcatcaccaggctgcccttttccaattgggcattgtcttcggcaaccacaccgaaggcgcggatttggtctttgtcaacgtgtttgcgggtgattgtttcgctgaccgggttgttcattccccacaacatcaacgtacagccgttcagcatcaaggttgccgccaaaacggcggcggtcgttttacggaacaacattttatcctccaatctaaataacggcggatgtcgtctgaaaatatgcctaaatttccgcgtccccgttttccatcacggttttcaactcttgaaacagggcgcggaaattttttggtggtttgttttgctcctgctcttttttggtattgcggatgagtgtcctcagcttgcccgcgtccgcatgcggaaaatccgacataaactgcgtcaacgcgccgtcgtctgccaacagccgtacgcgcgcctgttccacgcgttgcaaaaaggcgttgtgcgccgcatcgtcgccgcgcagcttggcaagaaacgcctcgatgggcgcgggatcggtatcgcgcatcagcctgccgataaattgtgcctggcgtttgagcgcgccgttggatgtgatttttttataggcggttaccgcctcgtacaaatccgcatccaaaccgatttttttcagcgtatcgtttgagagcttggtcaacgccatacccaaatcctgcaaatcgttcatctgctttttcatttgggttttgctgatccattcgtcttcttgttcaaacatcttgattctcgaatttttccaatagcgcattttaacagaatgccgccgcgttcagacggcattttgcaccgtccgccctgcaaacggcgcgcttttgcccctgccgcccgaaacggttaaaatgccgcaaagcatcatcaagaaagatttctatgctgttcaaccacaccgcttccgaactcctcgacctctgccgccgcacgctcgacttggcaaaagcgacgggcgcaaccgccgccgaagccgatttcagcgaatcattgggacaaagcgtcagcgtgcggctgggcgaaatcgaacaaatcgagttccagcaggacaagtcgctggacattaccgtttacgtcggcaaacgcaaaggccgcgccagtactgccgacttctccgaaaaagccctgcaagacaccgtcaaagccgccatcgacatcgcccgccacaccgccgaagacggttgcgccggacttgccgatgcctgtctgatggcaaaacacatcggcgaccccgacctttaccacgaatgggatttggatacggaagccgccgtcggcttggcaaaacaatgcgaacaagccgccctgaacgaggatgagcgcatcgaaaactccgaaggcgcggcggtgcaaaccggccattaccaatacgtttacggcaacacccacggttttgccgcacaccggcaaggcacgcaccacagcatttcctgcagcgtcgttgccgccgacgaaaacggcatgcagcgcgactactggtacgattccgcctgccgccatccggatatggacagccccgaaaccatcggtcaaaccgccgcccgccgcactttgcgccgactcggcagccgcagcatcccgacaggcagctaccccgtcctcttcgataccaccgtttcgggcggtcttatcggacacctcgtcggcgcactctccggcggcgcgctctaccgccaaagcagtttcctgatcgacagcatcggcaaaaaagtcctgcccgatttcctcaacctgcgcgaagaaccgcacatcccccgctctttccgcagcagctattttgatgcggaaggcgttgccaccgcaccgcgcttcgtgattcaaaacggcattgtcgaaggctatttcctcagcagttacagcgcgcgcaaactcggtatgcagaccacgggcaacgccggcggcgcgcacaacctgtatttgaaccatacgcacgaaacgcaatccgacctgctgaaagaaatggggacgggattgttggtaaccgaactgatgggacagggcgcgaacaccattaccggtgactactcgcgcggcgcggcgggtttttgggtggaaaacggcgtgattgcctaccccgtccacgagattaccgtagccggacgcttgcaggatatgtaccgcgacattgtcggcgtggcggatgacgctttgcggcgttcgtccaacaaaatcggctcgattctgattgcggggatgacggttgccggaagctgaacgccctgccgatgccgtctgaagacgaaggcagcacgttttgccccgtgcctacccgtttgccgttttatgccgcaccgccttttgccgacaacattgcacattttttcatcagcactgattttcccttatccgtcaaaatactaagccacttgtccacaacagggtacacacaagttcaggataaggcgtgcggggattggggtttttccgccgccggcaaaacggcagacaaaaacggcgggacattgcctgtcccgccgttttcaaatatacatttgaccgtacatcaggaattaagcagcctgaatgttggcggcctgtttgcctttagggccggtggttacgtcgaaagagacgcgttggccttctttcagggttttgaaaccttccatattgattgctgagaagtgagcgaacaaatcttcgccgccttcatcaggcgtgatgaaaccaaaacctttagcgtcgttaaaccattttacgataccggttgccattagaaacttcctatactcaaaaattaacaaaatcagcaaaacaaggcatacggcaaaccgagccgtctggcgttccttccagcttgatatactcggcggatgcccaatcctgcttaaccgtctttttacatttgttaagacaaaacgtcaagctatgttttcaaaaaagtgggaaaataggcaaaagtaccgaaaatacaacaaaaatgccgtctgaacgcggctttcaaatgggacacactatgaccgcgcaacaccaatccgacacgctcttgcaccgtctgaacaccctgccgccgaaacgttacggcgttttcctattgaacgacgattacaccacgatggaatttgtcgtcgaaatcctgaccgaaatctttatgctcggacaagaacaggcggtagcggtaatgctcttggttcatcacgaaggcaaaggcctgtgcggcacttacacgcgcgatattgcccaaaccaaacaacaacaagtcatgcagcgggcaaaagccgaagggcatccgctgcaatgtattgtcgaggagatttaatatgcttgcacccgaattggaacagattttgcagcagctttaccgcgaggcgcgtaaggctcattatgaatttatcagcctcgagcatctgcttttggtactcatcgaagaagatgcctccgtccacaacgtcctcaagctctgcggcgcggatttgaaagtggtgtccgaacagctcgccgccagcgttgccgaaaacacccccctgattcccgaacaccttttagacacggtcgaaacccggcccacgctcggcttccaacgcgtgatgcaacgggcgatggtgcatacccagtctgccggaaaagccgcagtcgaaccgttggacgttttggtcgcgctgatgagcgaaaccgacagccacaccgtctatttcctcaagctgcaatcggttacgcgttttgaagttttgcgctgtattgcccacggcwctcccgatgaagatgaagatgaagatgaagatgaagacgatggcaactattcttcagacggcatggacgacgataatggaaaccgcaccaaaccgggcaaaaaccctttatcggcgtacaccgtcaacctcaacgccgaagtcaaagccggccgtatcgaccctttgattggtcgcaaacacgaaatggaacggctggtgcaaatcctatgccgccgccgcaaaaacaatccgcttttggtcggcgaagcgggcgtgggcaaaaccgcgctggcggaaggtttggcacatcaaatcgtcaacggcggcattccagacgcgcttaaagatgccgaagtgtacgcgctggatatgggctcgctgttggcgggcacgaaataccgcggcgactttgaagcgcgggtcaaatccgtcttgaaacagctcgaaaaaatcccgcacgccattttgtttatcgacgaaatccacaccatcatcggcgcgggcagcaccagcggcggcaccatggacgcgtccaacctgctcaaacccgcgctggcaaaaggttcgctgcgctgcatcggcgcgaccacctacgacgaataccgcaccattttcgacaaagaccatgccttaagccgccgcttccaaaaaatcgacgtggtcgaacccaccgtttccgaaaccgttcaaatcctgcgcggcttgaaaccgatgtttgaagccttccaccaagtccgctacactcaaggcgcactcgaagccgccgccgaactctccgcacgctacatcaacgagcgtttcctgcccgacaaagccatcgacgtgatggacgaagcaggcgcggagcaacggattctgcccaaatccaaacagaaaaaagtcatcggcaaagcgcaaatcgaaaccgtcatcgccaaagtcgcgcggattccagaaaaaaccgtgtcgcacgacgacaaacaggtgctgcaattcctcggccgcgatttgaaaaacatggtttacggtcaggaaaacgccatcgacgcgttggttgctgccgtcaaaatgtcgcgttccggccttgccctgcccgacaaaccgataggcagtttcctcttctccggtccgactggcgtcggcaaaaccgaagtcgccaaacagcttgcctactcgatgggcgtaccgctgcaacgctttgatatgtccgaatatatggaacgccacgccgtatcgcgcctcatcggcgcaccaccgggctacgtcggctttgaacaaggcggccttttgaccgaagccatcaacaaacagccgcattgcgtattgctcttggacgaaatcgaaaaagcccaccccgacattttcaacgtcctcctgcaagtcatggacgcaggcaaactgaccgacaacaacggcaagagtgccgatttccgcaacgtcatcctaattatgaccactaacgcaggtgcggagagtctcagccgacccagcctcggctttaccgccaaacgcgagcgcggcgacgaaatgcaggctatcaacaagctcttcacgcccgagttccgcaaccgcttggatgcgattatcccgtttgcgcccttatccgaacccgtcatcaccaaagtcgtggacaaattcctgctccagctcgaacaccggctcctcgacaaaaaagtcgaagccgaattcacgtcggcattgcacaaatatctggcggaaaaaggttttgacccgcaaatgggcgcgcgcccgatgcaccgcctgattcaggaaaaaatccgcaaaccgctcgccgacgaactcctgttcggcaaactatccgacggcggcttcgtacggatagactgggatgcggcaaaagaagaagccgtgttgaagtttaagaaaagcaaggtcaaaataaaaaccgcctccgcataaaatcaaaaatgccgtctgaaatttcagacggcattttgtcaaatatcggtccctattccggcaaacttctccacaaacgccgcaatcttttgaaaaacactttgtttcttcgtcagatattgcgggttgagcggactcattttcggcagggtttcggtcagttccgtgccgttttcgctggcatagccgcgtttgagcgagctgattaaatagcgtttggcggcggtttcgttcaggccttcggcggcaatcaatcctgccgcttcgtgccgcatcacctcttgcgcgtaggtgtagaaggtttccagtatggcgggaacgtcgggtactttgtccaaatccgtatcgttgatgaaatccacaatcagaccctctttggcgcggtggccgatgctggcgcggatgatgcggcggatttcttccaccagctccgctttgcctttgatttttttgtggtgttcgaaaaccagttgcaggatgtaatccagattgatttcctgtgatttgagcaaatccacctcaaaaaccacatcgtcccagtcgatttttgattgctctttctgttcgcctgctttttggcggcgcagccagtcgcggatgtcattgtaggcggaacggtagtcctgcaccgccctttcagacggcatcggcacttgccgcatttcctgcacgtcttcatcgctcaggtagtatttttcttgaaacgccttcatcgcatcttcgtccgccgcgtccacactctgcaactcgcgcagcgcggcaaattcatcgtagttctgcaatacgttttccgcccgcaggtattcgccgaagagtttggcaaaatcttttttgtctttttccgtttcgattttgtcgggatcggggaaacgctcgcgcaattcttttgccacatccagataaccgcgccgtgcttcgccggtctggctgtcggtatagccgttcatgtattcttcgtaacttttttccagcaccacgtttttggtgtttttgtcgccaaacaaggtaatcgcatcaatggttgcctgctccaaatcgcggaagcagacaatattgccgaaggttttggtggcatcgtaaatgcggttggtgcgcgaaaacgcctgcatcaggccgtgatagcgcaggtttttatcgacgaacaacgtgttcagcgtcggcgcgtcaaaacccgtcaaaaacatgccgaccacaatcagcaaatctatttcctgatttttcacccgttttgccaaatctcggtagtagttttgaaaggctttgctgtccgtgccgaaattggttttgaaacaggcgttgtaatcgttgatggcagcctgcaaaaattcttttgcgctgctgtccatcgcttccggttcaaaagtctcatcgacaatttcaccgacggcgttttgctcttcgttggccgcaaaggaaaaaatggtggccactttcagcgggtgcaagctgcctgcctgttgtgttttgaacgcttcgtaatagcacttcgccgcatccacgctgctgacggcaaacatcgcgttaaagcctttgccacccgcattcagccggtgcgttttctgcctgaactgattcaggatatattgcgtgatttcgcggatgcgttcagggtgcagcagggctttgtggttttcggcggcactcagtttcttctcgtcctgttccgcttccacggctttgaactgcgggcgcacgtcgttgtaatccactttgaatttcaatactttttcatcgcggatggcatcggtaatcacataagaatgcagctcccgcccgaacacgcccgccgtggtttccgcgcccaaagcgttttcgggaaaaatcggcgtgccggtaaagccgaactggcagaattttttaaatttctttttcaggtttttttgcgcttcgccgaattgcgagcggtggcattcgtcgaaaataaagacaactcgctgatggtaaaccggcagattatcttcgcccttcatcaggttgttcagcttttggatggtggtaacgatgattttgttgtcgtctttttccaaattgcgtttcaagcctgccgtgctttccgaaccgttcacgctgtcgggcgaaaaacgttggtattccttcatcgtctgatagtccaaatccttcctgtccaccacgaagaaaaccttgtcgataaatgccgattccgtcgccagacgcgccgccttaaagctggtcagcgttttgccgctgcccgtggtgtgccagacatagccgccgctttccggtttgctccaattcttcgcctgcgccgagctgttgattttccacaaaatgcgttcggcggcggcaatctgatacggccgcataatcagcagcgtatcattcgcatcgaacacgctgtaatgcagcaaaacgcccagcaatacgcttttctgcaggaacgtggcggtaaagtctttcaaatccttaatcggatgattgtccgaccgcgcccaattcatcgtgaaatcgaagctgtttttgtcgcgcttggtggtgttggcgaaatagcgcgtgtccgtgccgttggaaatcacgaagatttgcaggaatttgaacagcgaattttcgctgttgaagctctctttgctgtaacggtgcacctgattgaatgcctcgcgcaccgccacaccgcgctttttcaattcaatctgcaccagcggcaggccgtttaccaacacggtaacgtcatagcggtttgcatgcgtgcccgtctgctcaaactggttgataacctgcacatggttgcgggcaaggtttttcttgtccagcagataaatgtttttcagacgacggcggattcgcatttgaagtgcaactttccctaacagaaaaaggccagtatgcggtagcatacgacctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggaccgtcatcaaaagcgaaatcgtaaatatggtcgtcgtggattttgcgggttttatcggtaatgttttcagacggcctgtccagatattccgtcaaaaaccgcgcccattcgccgtctgaaaacgccacatcgttcagccgctgcaactgcgcgcgcaggttttccagcagcctgctttggctgttcaaatccttgcggtattcgtaaccctgattctgcaaatcggcgattaactccgcttccaaccggttttccgattggtagctgcccgactgttcgattttttcatattggtcgagcacgatgaaattcggcgtttcagcgatgggtttggtttcgaggttcatggcttatctctttgttcatcatcttgaaaaaaattatagttatccagcaagtgttgcaaaagcaatttgacagtttcttgttcttgtggtgttggctcggcaaatgcctcattagataatgtagaatgacttgtaaagttaataatacgttgaaaatagtttcgtctgctgtcttcgggcaaaatatcagacctttgcttatagcctaaaaaattagctgttttttcatacaggtttctcagcaacataaaatgaaaccgttctacctgctgattctcgatagctttttcaataactccttttaagtgaaggtgatatgaaaaacttttattggaatcaccttgtttttcaagaatatcaaaactaccatcttcattttttaacagaagataacttttcttttccttttctaatttttttagttcattgtatagaacgttgtaaaataaaacattatgtgtagtaatgataaactttaacctcggtttgctaagctttatcaaatcagccaaatcaaccgcttgctgaatcagatgattttcatccaaagagctgacagggtcatcaataaaaatatattccaaatcgtcaaactgatctgtggaacgtccttcttcgctatcttctggaatattcaattcagcgatgacttgtctgattaatacatagaaaatgctccaaataaaattactttcttcacctttggaaattttgatattttcaatctgctcatcattaccacgagcaaaataaaatgcaatttctgaaaaatcatcattaaaatcaggagtcaacttatcatctgtataatattgaaagtttttaataacagctccatccagtccattatccctaagcaaccagtcggtaaaactattcttttgaatttttaatcttggagcttcgttcgctaacaaatcattgtcccaaaagaataaatcctcagtaaatgcattatagtagagaaattttcttcttgttggctctccgtctggctcttctgaactggttggagcaattaaattcttaaactctctggacaaacgtgttttccctgttccgttaaaagcatagattagctggacttttttatcgtttccttttagttcctcagcaatttcggttaaactttttcccatgatatttccttatcaatatttttcagacggcatgatttaaagaccagctatgacttttcaggcagcctttgggaagctcaacaactgcccgcggtaatattcgtattgtttccggcgcagggcaatttcgtacggtaggccctcgctgatggagtgggtcagggtgtcgaatttgtcgaggatggcgacgattttttcctgttcggggagtggagggatggggattgaaatatcttttatcattggtttcgttagctgtggaataccgctttcaggaactttataatttgattcaatacttttcataaagtagtaggcatattttaggtttaattcaatttttggtgttaacactaacaggcgtactattgggaaaaaaggtttattctgaaagctagcccaacctatagttcctctagctgatatagttaagctaggttgattgattttagcaacattagtccagccatatagtgccttacttcctataccattagataaaatggggatacaaaattcttccgtttccacttcagagaaagcgtcttttggtacgtcgcctccagcaaaaatattaaatacctcccccaacgtcttccaaaccacatctttcagacggcctttatagccatcagctatcccccccgatttgattgttaaaatctaaaagaaagtcgcggtaataccggtattggcgtttgcgcagggttaattccgcttccagcgtagcttccagcgtagcttacagctctgtgaatttgtcaagtatttttacaattttttgttgggtttccaggggtgggatggggatcgaaatattttcaactactaatctatcaatagtaggaactccaccaactctcttttgggattttatatatccttctcttgtttttaaaaagtagaatataaacttatcatcaagatagtttggtgtttgaatcacaaaagtaccatcagatgaccagaaatctacgccactccatataacttcaccaatacttcccgtattaataatcatcgtttgattagctctacgattaaactggtcaaaccaaccaagaggaatcaatccgccatgaaaaaccggatatttcccaccttcaattagctctttctttgtcaaacgttttcctcttaatactttcgccacttcccccaacggcttccactccaccggtgccgtctgaatcatctcaatcaattttttcgctttgttttgcatatccatggttgttttccgtttctttcccgttgcggcgggatgtggggcagttgcggggtgcttcggctcactctgtccgtttgccgttatttctgcgggctgaagtccgtcctgctttcaggctgcctgcaatggtgtgcaggctgctttttcaggtagcctgaatggtagttattttgtgcggtcttttttctgtttgatctgttgcacggctgttttttccaacgctttaacgctttccagataggcttgctccaccggcgacaggatgcgcgcttcataggcgcggtattcgcgttcggctttctgctctgcctgtttgcggctgatgctgcctgcaccctgtaatgtgccttgtccgtacagcccggaaaatttgtccaattcggctatccagtcgcgcatatacatggggctttgctcctgcgctttgatttccgctaggtcgaagaaggcggaaaccagacggttcaggcggaacagttcgtcttcggtcagatagtttttggcgattttggcttcattcagcgtggggattgcgccttgaaaggtggtcagccccataaagtctttgctgctgtcggcacggctgtatatcagctcagctgcggtttgccggctggcggcatagtgcagtttgttttgaacggcggcaaaaaaggtttggctttcgctgcttttggggttgtagtcttggctggtggcatataaatcaagcacttgccggtatagggctttttcgctgctgcggatgtcgcgaatgcggttgagcagttctttccaatagtcgccgccgcctgtgcctttcaggcgttcgtcgtctatggcaaagcctttggtcagatattcgtccagccgttcggttgcccattggcggaattggatgccccgcgcggaacggacgcggtagccgacggcaataatcatgggcagggaataatgggcgattttgcggtttaccttgcgcccgttttcattttgaactgtcaactggaagttgacagttgccttctcttccaattcttgctctgcaagaatggttttaatgtgtttgctgatattttgtttggtggtttggtacagttctgccatgtccgcctgcgtcagccaaagctgtccgccaaattcctgcaaggcaaattgggcagtgccgtcgttggcggtgtataggatgatgctcatgcttcaatctctgcaatcacttcgtcaatttcacgccgcagccgttcgattttggcgacggtttcgccgatttcggcgttgagctgtttgatgtcgataatttcgcgtgtgtcttcggcttcgacatagctgctgacggcgaggttgtagccgttgtctttgacggtttgctgggcagcgttttgggcgatatgcggcacatcggctttatcggcgaagagtttgacgatttcagcaatgtgttcttcgattaagacgttgttgttggtttcttttttaaagaagccgcttgcgtcgatgaattggatgtcggtattgtctttgtgtttggacaaaaccaggatattgacggcgatgccggtgccgtaaaagagattgggcgcaagggcaatcacggtttccacgtagttgccctccaccagatattggcggattttctgttctgcgccgccgcgatagaaaatgccggggaatgagacgatggcggcgcggcctctgccggaaaggtagttcagtgcgtgcaggatgaaggcaaaatcggctttggatttcggggcaagtacgcctgcgggggcaaagcggtcgtcgttgattaaggtggggtcgtcgctgcctatccagttgatggaataaggcggattggaaacgatggcatcaaagggtttgctgtctttgagctttgggttggtcagtgtgtcgcccaattcgatgtggaattggttgtaattgacgttgtgcaggaacatgttcatgcgggcgaggttgtaggtggtgtggttgatttcctgcccgaagaagccttcttcgatgatgtgctcgtcaaactgttttttcgcctgcaagagcagactgcccgagccgcaagctgggtcgtagattttgttgactttctcctgtccgtgcaccgccagccgcgcaatcagcttggatacgctttgcggggtgaaaaattcgccgccggatttgcctgcgttggcagcgtagttggaaatcaggtattcgtaggcatcgccgaaaaggtcgatgtggtggttttcaaaattgccgaaatcgagttccgccacgcctttgaggacggcggcaaggcgtttgttcttgtcggcaacagtgctgccgagccggctgctggtggtgtcgaagtcgtcaaacaggcctttgatgtcctgttcggacggatagccggaggcggagctttcaatcgcggtaaaaatttctttcagcttggtgttgagctcttcgttttgatgggcttcggcggcaatattgcaaaaaagctggccggggtagatgaaatagcctttaactttgacggcatcgtctttgatttcgggcgtgatgatgctgtccggcatagcggcgtaatcaatactgctgtcgcctgcctgcatatagtcggtgaagttttcgctgataaagcggtagaaaagtgtgccgagaacgtattgtttaaagtcccagccatccaccgcgccgcgtacttcgtcggcaattttccaaatttggcggtgcagttgggcgcgttgttgcatttcggtcatcatcgaaatccatataaaagttaaacaaatcaaaatcgcctgatattttcagacgatttttttacgggcattcaaattaagccaaattttccagcatccatttgacgtagcggtcgacgcctgatttgacatcgaaaaattcttccttatatccggcttcgcgcaatttggtgatgtcggcttgggtgaagctttggtatttgcctttgagcgcgtcggggaagggaatgtagcggataagttcttcttctaccaactctttcaagctcatttcaggtttgccttcggcggcgcggcatgcgttgacggtggcggcggcgagttcgttgaactgttggctgcggccggtaccgaggttgtagatgccggaaagttcgggatggtcgaagaagtagaggttgactttggcaacgtcttcgacgctgacgaagtcgcgggtttgttcgccgttgccgtagccgtcgttactgccgaacaggttgacgtaaccgtgttcgcggtattggtggaagtggtggaaggcgacggatgccatgcggcctttgtgttgttcgtgttgtccgtaaacattgaagtagcggaagccgacgacttgggcggtgagaccttctttcatgcggcgacgcaatacttggtcgaacaggaatttggagtagccgtacacgttgagcggtttttcgagttcgcgctcttcgcggaagatttctcctttgccgtaaaccgccgcactggaggcataaaggaaggggatgcgttcgtcctgacaccagtccagcaaatccagcgtgtactggtagttgttgtccatcatatacaaaccgtcgtggttcatcgtatcggaacacgcgccttgatggaaaacggcttcgatgttttgataaggtaaaatgtgttccctcacttggcggatgaattcgtgtttgtcgagataatgggcgatttcgcactcggcaaggtttttgaatttttcgcctttgctcaaattatcgacggcaacaatgtcagtaataccgcgttgattaagtgctttgacgatgttgctgccgataaagccggccgcgcctgttacgatgatggtcatattcggtttcctttgttttgagtaaaattaataaacttagttacaagaaatcatcgatattgtcctgaaacacaaatttgcgatgatattccaaatatttttctcttccttcgggatatattctcatcttaattttttgcatttggattgatattaagtttttcccatgtgtaacggcttagtcgagtaccgcaaatcaaacgaccatcatccaagaaagtaatataaccttgatcgaacaaccaatcataagtcggcgttaaagctaacccatttaaataatctaatgcctctttctcatttttctcagtaatacaaaccatataaggtttaatatgactagcccttaacaaaatctcatctgtaattaatgtaaatggacattgcgacatatgatttataacatccttgcgatatttctgctgcccttttctacttttctgtttaatgatttcttgctctacgaattgattaaattctgaagccggtatttctaatttttctcttgataagagttgcgggtgcacgatagagcgaaattgataatccaaaaatattcggaaataaaataatggttctgaatcttctatatctttgacaggcaatagtttaagaattgataaataactaattttgggcaatacaatcttacgccaaattgaccatatatcatcctccgaacggatataacccctacggtaacctttagaattttccaaatggtctgatacatcatggattgaaaagaaaatattttctgtaggcagattattaatacttaaaacgtaatcatcataaaaccttgaaatatcatgatgatatttctgttcttgtttgtgatattcaacttttgcatcaaccaaataacgctgtaaatttttcttataaaaaaaacaatttttctgaatgaaaggatattctaccctccttccattttttgtctcagtaatcccccaattttcatactcaaaaaatgtacttagttttcgaccactatcatcaatataactacctacatatttgcgtgcttccccattaccaccaaaaacagataacttgttattcctgtgaataaaactatcttccgcacgtaaattttgaatactatcgacaataaaatactctatgttttcaatagtaattctttgaaaatccggcattttactctccataaagcgtaatatccatttgttttaatatagcgattaatacatcaacaacaatactgtttcccgcttggcgatacatttgagtatcactaactaaaattttaaaatcatctctaaaacccattagccgcaaacattccctaggtgttaatttacgaatacgtccacgattatgagtaacataattatcaaccccggcacgatgcattttatgcatagtttgcaataatgggcgagctacaggcaaatcagtttccgtactggttttaaaattttttgttcctcctgccaaaacataatttttgattttttcagaaagataatatttttcctcaacgttatttacatcaaaaataaagtcatcaaattcagattcgcgggctgcctgaaaaataaaatcaccatgccaattaaattgttgatttgctttttggcataaggcaatttctccattaatctgtgtataacgtttttgtctatttttagaactggtaacaaatttcgcacccttttcacgtaaaaaatatttgctatcagtatagtcctccaaaaaatcttgcatagtatgttctaattcaatcttttcaggaaactgaaaaccatttataggaggggtatgaaagccaacaacaaaaatacgctcacgatgttgaggaatcccataatccttactattcattatttggaaatataagtcataaccaagtgaataaaaaacactttttacaactttccaagtttttccattatcatgattaagcaagccctttacattttcataaataaatatctttggttggacttcatccacaacgcgagcaaattcatagaataatgttcctcgtgtatcttctaatcctgcacgtttgccaaccatggaaaatgcttggcaaggactgcctccaactaaaatatcaacttgatttctaaactttctcgcatcaaattgagtaatgtcgttatgccaaaaatcttcatttaatttatagtttccaagataactttttttaacgtatggatcaatatctcctgaaaaaacaatggtatggtttaaatttaatcggtggaatgcctgttcaaccgcaccaatcccgctgaatacggttgctaatctaatatgtgaatcaggtttaagaaaagttttagatttccaaccttgttgactgggaaagagcaaagttttttgtaatcgagtatcgtgtgtctgtgccattgtcgaaatagtcatacttatatcgttctgtttatcttatcaatatgaaaactacattgttgattgccctgacaatgccttgatcaattcggcaaacgagcaaaccgccgtaccgagtttcgccacgacaaccccggccgcagtattggcaaggtacatggcttcgggcatggtgcagcctgccgccaaacccaagcccattccggcaatgacggtgtcgcccgcaccggatacgtcgtaaacttcttgggcgcgggtgggctggtaaatcggttcgccttcgctgaacaaggtcatgccttcttcgcttcgggtcagtaaaacggcggtcaggtcgaggtggcggcgcaggttttgcgctttttcggtcagctcgctttcgtttttccaactgccgaccacttctttcaattcggcgcggttaggcgtaatcagagttgcaccgacatatttttcgtaatcgtcgcctttggggtcgattaagacggttttgccggcgtgtttcgcccaatcgatcatatcggagatatgcgacaggccgcctttgccgtagtctgaaaaaatgattgcgtcgtattcgggcaagatttcgcggtatttctgcttgatttgttccaacacttcgcagttgggatgttcttcaaaatcaagacggataagctgctggttgcgggcgacgacgcgcagtttgacggtggtggcgatttgtttgtcgcgcatcagataggaggcgacgccgtcctgcaccatcagcgcatcgagcgcgtcggcggcttcgtcgttgccggttacggacaacagccctgccctgccgcccaacgaagcgatgttgcgcgcgacatttgccgctccgcccgcgcgttggtcgattcgtccgattttcgccaccggcacgggggcttcgggcgaaatacgggacacatcgccgaaccaatagcggtcgagcatcacgtcgccgacaaccaggactttggcttgcgcgaaacgggatttgagggtttcttgttggaacttggcggacatattgcctccgttgtattttttcagacggcctcagcctgtaaggccgtctgaaaatcagtttgcttcaaggtttgccacgcggttcacttcgcgcaatacggctaccggatcggcagcttgggttacaggacgacccattaccaaataagtcgaaccggcagccaaggcttcggccggtgtcatgatgcggcgctggtcatcattattgccggcaacgtccaagcggatgccgggcgtgaccaagacaaaatcctgtcccaattcgcggcgcagcggcgcggcttcttgggcggaacagaccacgccgtccaagcccgaactttgcgccagttttgccaagcggatgacttgttcttcaggggcggtgttcaaaccgatttccgccaaatcactttgttccatgctggtcaacacggttacgccgattaagagcggcttcgtgccgtatccggcaacggcttctgctgcggcttccatcatacggcggccgcccgatgcgtgcatatcgaccatccaaacgcccatatcggcagcgactttgcaggcttgcgcgacggtgtggggaatatcgtggtatttcaaatcgaggaaaagtttgaaaccttgattgattaagctttctgccaaattgcgtcccgtcgcggtaaacagctctttgccgattttgatttgacacaatgtcgggtcaaggttgcggacgaatccgagcgtgtctttttcgttggaaaaatcaagggcgacgataacgggggtgcgttgttgcggagtttggaagtcggagattaaaggattcatggtgttttcgtttcgggttttcagacgacctttatcgtctttttcgcagtatagtggattaactttaaaccggtacggcgttgtctcgccttagttcaaagagaacgcttctctaaggtgctgaagcacaaagtgaatcggttccgtactatctgtactgcctgcggcttcgtcgccttgtcctgatttttgttaatccactataacaacgtaaattcaaaccgtaggtcgggcattgatgtccgacctacgcggactcaagcctccgacaaactgtttcggataaatttgaaccggtacatcagccgtcattcccgcgcaggcgggaatccattgataaaactcagttcatcagatttaaacagcgattgcccaaattcagaaatggattcccgcctgcgcgggaatgacgccaaatgattatttttcggttgcaacacgctgtttatcaaaaacaggtcgtctgaaaacctgattttctgttttcagagtgcgaagcctgcccgtgggtacgaccttttcgatttatttgcccaatgcgcccaatacttcggctttcacggcttctactgcttgggtgccgtcaactttgatgtatttaggcgcgtgttcgccttccagtttgctgtaaaaatcgaccaaaacttcggtttgctcgtggtaaacggcaaggcgttttttcacggtttcttctttgtcgtcgtcgcgctgaatcaaatcttcgccggttacgtcgtctttgccttcaactttgggcgggttgtaggtaacgtggtaagtacggccggaagccaaatgcacgcggcggccgctcatgcggtcgacaatcacgctgtcaggcacatcgatttcaacgactgcatccaaatccacgcctgcttcaaccatcgcttcggcttgtgccaatgtgcgcgggaaaccgtcaaacaagaaaccgtttttgcagtcgtcttgcgcgatgcgttctttgaccatgccgataatgatgtcgtcgcgcaccaagccgccttcgtcaatgatttttttcgcttccaaacccaagggcgtgcctgccttaatcgcggcacggagcatgtcgccggtagagatttgcggaatgccgaacgctgcggtgatgaattgcgcctgagtgcctttgcccgcgcccggcgcgcctaaaagtaatgctttcatgaagtgatcctttgaaatgtgtttattggaatcaaacagatggtttacgattctacacggcttggcacaatagttcaaaaaccaactgcacaaactgccatttgcaagcaaatgttttgcatacctttgccgagtctgatattcacaagccggcaactttttgggacaatcccccaaaatttcaaaacatcacaccctaccaaaaaggaacatccgtgaaacgaatttttctgtttttggctaccaatatcgctgttttggtcgtaatcaacattgttttggcggttttgggcatcaacagccggggcggcacgggcagcctgttggcgtattccgccgtcgtcggcttcactggttcgattatttcgctgctgatgtccaaatttatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgatgcgggcgcggcaaaactggtcggcgcgccgaaaatgatttccgccctgcaaaggctcaaaggcaacccggtcgatttgcccgaagaaatgaacgcaatgggcatcgccggagatacgcgcgactccctgctcagcacccacccttcgctggacaaccgtatcgcccgcctcaaatcgctttaaaccgatttgaaacggcaaaaaccgtacgcgcaagcagtacggttttttgtatatgctgtctgaaaacatcaggtttccataccgacaccaaccgtatccatttccgcaccggatacgccgcattgatataccctgataaaccgtatccggacagaaaatatagtggattaacaaaaaccagtacggcgttgcctcgccttagctcaaagaaaacgattctctaaggtgctgaagcaccaagtgaatcggttccgtactatttatactgtctgcggcttcgtcgccttgtcctgatttttgttaatcccctatatcagataaaacagcggtaaaattgccgtctgaaaccaactctgcgccatacgggacacgctctgcacgtctatttgcctccgatatatcctccctactgtaggaacgtctgccgatttgcacgaaatcggcacctctagcacccttcaggatggcggacgttatccgttcttgggattctgcaagacggtcgacggcattatacagacgctcggtctgatacccttccgaagcaacctgcttcaggtattccaaataaccgtaacccaacgcccctccgacaagcagggtcgtcaacgctaccagcgttgccgaacggattttagggggcatatcttgaagcatatctctaccgaaccgaaccaaagtctctttaaagtcggactctacacgcgtagaaccctcggaaatcttgaagttcaactcatactgcttccgtttgtccgctgtcaaccgcttgaggttgtcatccccgtattggacggttgacacaaccctgtacagactgtcctgtatttcgaccagcgtctgtgcaaagttggcggtcataactggattcccaacccttgccgccgattctgatactcaaaacggtatccaggcgttccagcagggcttcgggagacagcagtgcgtattcttcaatattttccataggttgattatagcagaaccttatacctgttacagacaaggttgtcgggatttgaacgtccgtcgagcttggttcgtatagagccgtagggggtgtttagggctttggcggcagcttgtacgctggggaacgtgagtgtttcgcctgtggcggtgtcgaggatggagacaggtttttggttttggggaggcgtattttccttcattttaagtttcccgcactccggacacccatactttgactttatagctgtgtcgtaatacaaaagttggacaaccccgtgcgtaggacatctaacactggaaggtttataaatgccactgaactccaacaattctaaatgtggaaatttctcttgaaagcgtgatttggcggtatcgaaagtcattcgcttacccataatttgtctccataggttatgtgcaaatggattacacaaccaaaatatagaaattttcaaattttttgagacctacctgaaatcctgcgcaagcacaatgtaaagaaaaatggtatacgtctttactaaatctttacataaattaactctaaccgggatttgaacgtccgtcgagcttggttcgtaggatttagggtgttgtgaaccttacctatcgtacccaagcactttgtacctgtttgaaataaggttgtcgggcgacgttcgacccttgagcctgtgattgatttgttggaaatgtacacctaaagcagcacctgcggcagtaacgcttgggaacgtgagtgtttcgttggtcgttgtgtcgaggatgaggaggggcttccctacatttggaggtgtttgggtttttgacatcttagcacactcaggacacccgtactttgactttataagggcattaaatgtcgaataacgaacgttcccgtgcataggacaattaacggttactgggtaattcacaccgtcaaagccggttagagagatattagggaatatatcagtaagttcagaagctgcttggttgaaagatttggccatttgagactccaaaattgattgtcaaatggatttaatagcaaatttataaaaatgtcaaatttttcgagaagcacctgatagtggcgaggggtatacactgttaaaaagtgtatacgtcatttagtgcagatgtgaaccttatacctccctgcaagtaaagtctctgtgtgaacccgaccttttatacggtcagtgatagctgctgggtttatacccaatgaccttgcagcagatgctcttgaggggaatgtaagtgtttcgccagttacagtatcctccaatactgtatttttagataatttatctattgtatcttctggaattttgtgggaattgacaccataagatgcacattttggacacccacttttagagtccaacatacttttgaatgtagagcaagtaaccctcccgtgtataggacagacgattaccgtcgggtaacgaacgccattgaactccacaagattcaaatgtggaaatttagaggttagcttagaaactgcttgagtaaatgtaagtgccatagtggttgtgaacttactttaccaacctataacgatacctaatcaatcggtcaaacggagtgcgtccgcttaaacgtacagctaaagtgctgttggagcaaccgataaatttactggcagccagtgtacttgcaaactcgtagatttcccctgtctctgtgtcctccaacctaatggcaacggcgtttggagagggcttttcgggatttcgagtacattcaggacatcctgttgaggatttcatggcagcttgtagattcccgtaaacaaccgacccatgcaaagggcattggattgttaccggttcgtagtttttagtgaacttcaaaaccgtcttatcaggaaatttactggaaaaccttaactgaacatcttgtagcgagagtgattttggcattatagacctttctaaaatgaaagcattatacaaccaaaatatagaaattttcaaattttctctgaacgcactggtatccgatggagctaaatgtaaagaaaagggtatatgtccttactaaatatttacacattttaactgtatagtgtttgacaaaaaacaggcataggcgcataatgcacccgtagttagatagatagtaaggagataaccaatgacttagcacctgcccccctctctctcgcgcaccccgcccctcgcttgcggctaatgggctttgcgcgacatatacactttcatctcctgcatggcttaaccgcctatgcaatagtacacacatcaacaaatcaggctggcacgtcttggcattggctgacgtaccattgtagcccgaaatgttgataccctactatttatgaccaacggcggattagggcttcagacggcaattttactgcaaaaccttatgcgaacggatgatgcagcacaatcgtttcttctcggtcggggccggtggagacgatggcgaccggcgcgccgcagacttcttcaatccgtttcaaatatgctttggcgttttcgggcaatgcgccgtagtccttcacgccgaaagtggattcgcgccagccgggcatggtttcgtaaatcggcttgcaggtttccaccgcatcggaaccgcaaggcaggatgtcggttttgccgccgtcgggcaattcatagccgacgcagatattgatggtttcaacgccgtccattacatcgagtttagtaatacacataccggaaatgccgttgatttggatggagcgtttcagggcggcggcatcaaaccagccgcagcggcgtgcgcgtccggttaccgaaccgaattcgtgtccgcgttctgccaaacctacgcctacttcgtcgaacaattcggtcgggaacgggcccgaaccgacgcgcgtggtataggctttgacgatgcccaaaacataatccagcatttgaggacctacgcccgcgcctgccgaagctgcgcccgccagacagttggacgaggtaacgaagggataagtgccgtagtcgatgtccaacaacgcaccttgcgcgccttcaaacagcagtttttcgccgtttttgtttttctcgttcaacacgcgggacacgtcggtaatcatcggcgcaatgcgcggcgcgactttttcgataaccgccatcacgtcttccgctttaaccggctcggcattgtgcagatgttgcagttggacattgtaataggcaaggacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccaaactttcatgcaggatgccgctcggaatcaggcgcaaaatggtttttttgccgccgacaaccaaggtatggcccgcattgtggccgccttggaagcgcaccacgccgccggcttcttccgccagccagtcaacgattttacctttaccctcgtcgccccactgtgcgccgattactacaacatttttagccatagccatataacctatcgatattaaaaattattgcggaaatccccaaaccggtgcggctttgcgccccgccacgatttgcctttcatccgccatgaacgggtatttagcgtttcacgacctgccaaacgccgtccgtctttttcagacggcctgcaagctcttccgaaacattgtgtccgataccgtaatcgattacgacacactgcccttgttcacgcaaggcttcgaccgcttcgtgcgccgcttcggcatcttccgcatcgaccaacacggcgggctgccgttcgatggcgggcaaacgcccgataaagctgcgcaagtcgaaactgaatcccgttgccgggcgcgccctaccgaaatatccgcccaatccgtcataacgcccgccgcgcgcgaccgcgtcgtggaaatcggcggcataggcggcatacagcaagcccgtgtggtaattgtcgacacgcagctcggacaagtcgatatggatttcacaatcggggaatgcgtcgcacaccgcctgcaattcgcccaacgcgccgccgaccgccgacaaatccggcaaccgtccgcgcgcgtcggacaacacttcacgcccgccgtacaggcgcggcaacagcgagaatgcttttgcccacatgccgtccagcttccaagccttgacctgcgcttcgaccgccccggtatctttatcctgcatcaaggcaagcagcgttgcggactgccccgcatccaaatgtgccgcatcggacaaggcgcgaaatatgccgatatgccccagcgaaagcagcactttgcccatatcggcaattttcatgcttttcagcatcaggtctatcagctcgatgtcgccacggatgtcagcaaaaccgtacatttctgcccctgcctgcaagggttcgcgcatattcagcagaccgtcgggctgcgcgtgcaacaccggaccggcataacacaaccggttaatcccttggttggcggataaaagatgggcatcgatacgcgccacctgcggcgtgatgtcggcgcgtatgcccaactgcctgccgctgagcctgtccgttaccaaaatggttttcagggaaagccccgcatcgatatgcgtcagcagggaatgtgcgtactccatcagcggaggctgtaccagttcataaccgtgtacgcggaacagtgccaacaactgctccctcgcgctttcaagctgccgcgcgttcgtgggcagtacgtcggcgatatgttccggaagctgccatgtctgcatgagaatctgccttctattttatcctgtaaacacaaaagactgcccgatccgcaatcagacggcatctttgccgcaacgcatcacgccgctgtcaaaacggcggtgcttctttccgattcagaatccgaacagcccctgtccgacggctcaatgccgtcaagtcgttaaaaccaaactttaccataaaatacacacaatctgaatatacttttataccctgtatccgccgtctgacggcacggcatttttttacgatataatgtgcaccattatttctcatcacttcctgctgccgttttctgcttcagacggcatttttgttgattgaacacttatgctgctcgacctcaaccgcttttcctttcccgtcttcctgaaagaagtccgcctgctgaccactcttgccctgcccatgctgttggcgcaggtcgcgcaggtgggcatcggttttgtcgatactgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacggggcggcaggggatttggttcgggctgtttttgggcgtgttcggcatggtcttgatgtgggcggcgattacgccgttccgcaactggctgaccttgagcgattatgtggaaggcacgatggcgcagtatatgttgttcaccagcttggcgatgccggcggcaatggtacaccgcgcgctgcacgcctacacttccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgttaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggcctgctgccgggctatctgctcgcctaccgtttcaatatgggcatttacggcttctggacggcattgattgcctcgctcaccatcgccgccatcgccttggtgtggtgcttggaattgtgcagtagggagatggtcagatcgcataaggccgtctgaaaacgcagtacacttcaattcaaatacagttaaagttcaaaccatgcaacccatccgataccgaaccgaccttaccccctacaacaccttcggtcttcgcgcccaagcccgggcctttatcgcgctcgaacatgccgacgagttgcgcgacatcgtccgactgctggagttcgaccgcgatactgttttatggctgggcggcggcagcaacatccttttgatgcaggattacgccggactggtcgtacacatggaaaacaaaggcatacgcgagattgcgcgttcagacggcatggttctgattgaagcgcaggcgggcgaaatttggcacgattttgtcctgcacaccgttgcgctgggtttgagcggtttggaaaacctgagcctgattccgggtacggtcggcgcatcgcccgtgcagaacatcggcgcatacggcgtggaggcgaaagacgtgattcacagcgtgcgctgctttgatttggatacggagacctttgtcgagcttgccaatgccgactgccgcttcgcctaccgcgaaagcctgttcaagcaggagggtaaagggcgttatgtgattgtttcggtcgtatttgcattaaaaacgcattttgtgccgactttgggttacggcgatttggcggccgccgttgccgaactgagcgcgggcagggtcccgacggcgaaagatgtttccgatgcagtgtgtgcaatccgcaacagtaaacttcctaatcctaacgtgcttggcaatgtcggcagtttctttaaaaaccccgtcgtcagcgcagaaaaagccgccaccttgttgcagcggcatcctgatatgccgcgctatccgcagcccgacggttcggtcaaactcgccgccggctggctgatcgaccaatgccgtctgaaaggcttccaaatcggcggcgcggcggtacatgacaggcaggctttggtcttagtgaacaaaaacaacgcctcggcaaacgatgtccggcagttggcgcaacacatcaaatttacagtatttgctcggtttcaggtagaattgcacgccgaacctaattggctgcctgcttcgttcagcctgtaaatccaaggagtatgcccgtgacccgccccgccaaaatcaatacttacacacgcatcatcgacgccagccttgcgcttttcaacgaggaaggcgagcgcaacatcagcaccaaccatattgccgcccacttgggcatcagtccgggcaacctctattaccacttccgcaacaaagacgaaatcatcgtccaactgttcaaacgttacagcgaagccctgctggcatacctgaatgaagccgtgttgccgtctgatgtggaagactccatcaattatatggccggtatttatgatgtgatgtgggaataccgcttcctattcagcgacgtgaacaccctgcttgcacgcagtgccgaattgttgggcgaacacaataccttcacccaagccaaagtctccccgctcttggtcaacctgctcacccaactcaacggtctgaacatcatccaagccgaccaaaccgccatgaacgatctcgccgtcaatatgtggatggtcacgaaatactggttcgacttcgacagctccctgcgcggccgcaccaagctgaccgaagactccaaagcacgcggcatccgccgcaccttaagcctccttcgtccttatcttttgcccgaacaccgcaagaaatacgaccggaaaatcggcaacggcaacccgtaaacccacagcgtccgaatcagccttcagacggcacttacccgacggtatcagcgaatgcgcgcagtccccccgccccatatctccatcacaggcctaggttacctcggcctgccgctggcacaaaagttttaccaacacggcagccgcgttgccgccgtcaaacgcagcctgacttcggacgatatcaatctgcccatacacctcgataccatcgacctcaatcaagacagcgcgtttcaaagcgcgaaccttgcccgagatacaagcttttggcggcaccatgccaacaaacccgtttggttctgcctcttgccgccatcatcgctgacacattacgccgataccgtcaaacaatgggcagaacttgcccgggcgtgcaacgtgcaacacctgattttcacaagcagtaccagcgtttacggcgatacagcgcgcgaatgcgacgaaatcgccctacccgatccgcaaaccgagtccgcccgccaaatcctcgccgccgaacaacacctgctcgacagcggcgttccgaacatcgacatcctgcggctgggcgggctttattgcgccgaacgccatcccgtcggccgccttgttcaaaagcaaaacatcccgggcggcaaccgccccatcaacatcgtccaccgtaatatcgccgtcgaaagcctgtttcagacggcatttaaccccggcggcaggcggctgaaaaacattatcgaaccgcgccacccgacacgacgcgaattctatacggaagaagccgccaaactcggcttgcccgcgccggattttgcacccgacgacagcgtgggcaaaatcatccgtaccgtttgcgataacggcttaagcctgtaaaataagcggcaacagcaacaaacaggcattctccgccccgatcagaaaatatgtccgccctcctccccatcatcaaccgcctgattctgcaaagcccggacagccgctcggaacttgccgcctttgcaggcaaaacactgaccctgaacattgccgggctgaaactggcgggacgcatcacggaagacggtttgctctcggcgggaaacggctttgcagacaccgaaattaccttccgcaacagcgcggtacagaaaatcctccaaggaggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcggattttcccgcgaatccgagtccgcaaacatcggcaacgaagcccttgccgactgcctcgacgaaataagcagactgcgcgacggcgtggaacgcctcaacgaacgcctcgaccggctcgaacgcgacatttggatagactaaccttcagacggcatccgacatgaacagcccttttcacaacatcggcatcgtaacccgccccaacacgcccgacatccaagacaccgcacacacgctgattacctttttgaagcagcacggctttaccgtctatctcgacgaagtcggcataaaggaaggctgcatctatacccaagacaccgtcggctgccatatcgtcaacaagaccgaactggggcaatactgcgacctggtcgccgttttaggcggagacggcacctttctctccgtcgcccgcgaaatcgccctgcgcgccgttccgattatcggcatcaaccaagggcatttgggcttcctgacccaaattccccgcgaatatatgacggacaagctattgcccgttttagaagggaaataccttgccgaagagcgcatcctgattgaggccgcactcatccgcgaaggcaaaaccgccgaacgcgccatcgccctcaacgatgccgtcctctcccgtggcggtgccggacagatgattgagtttgaagtcttcgtcaatcgggaattcgtctatacccagcgttcggacgggctgattgtctccacccccaccggatcgaccgcctattcgcttgccgccggcggccccatcatgcaggcaggattacacgccttcacgctcgtccccatctgcccacaatccatgaccaaccgccccatcgccattccagacacgtccgaaatcgaaatcctcgttacccaaggcggcgacgcgcgcgtccatttcgacggtcaaacccatatcgacgtgcaaaacctcgaccgcatcaccatccgccgctaccgaaatcccttacgcattttgcacccgaccgactaccaatatttcaaaaccctgcgccaaaaactgcactggggcgagcaattagtctaagccggcctttacccgaaagtatccatgaatcccaaaatttcctccgaccatacagaagatgccgtgcgcctctccaaacgcatggcgcaactggggctttgttcacgccgcgaagccgacggctatatcgaacagggttgggtaacggtcaacggcaaaaccgccgtactcggtcagaaagtttcaccggcagaccgtatcgaactgaacaagaaagcccacgaacagcaggcggcacgcattaccatcctgttgaacaaacccgtcggctatgtcagcgcacaagcggaaaaaggctataaatccgccgccgaactgattacccctgaaaatcactgggaaggcgataccggccgcatccgtttcgatccgaaacacaaaatcggcctcgcccccgccggcaggctggacatcgactcggtcggattgctggtattgactcaggacggccgtatcgccaagcagcttatcggcgaaaacagcggcagtgaaaaagaatatttggtgcgcgtgcgcggcaaattggacgaaaaaggacttgccttactgaatcacggattgagtttggacggcgagaaactgcgtcccgcccaagtagaatggcaaaacgaagaccaactgcgcttcgtgttgaaacagggtaaaaagcggcaaatccgccgtatgtgcgaactggtcggactgcgcgtcgtcgggctgaaacgcatccgcatgggcaaggtcaaactcggcaggctgccgcccggcaaatggcgttatctcgctcccggcgaatcgttttaaataagcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtggctcatggcaatctttcttgcaggaaaggccgtatgctaccgcatactggcctttttctgttagggaaagttgcacttcaaatgcgaatccgccaagcattaaaaaatgccgtctgaaaatccttgcgttttcagacggcattgccttatgcccaaataacggtttcttccaagggcctacgcgctttcgtggcgatttcctgaacgcggtagccgaatgtcgcggcgacggacacgccccattctgccgcatcgaacaaaccaaactgcccggacaatatgcgctccatctcggcatagttgaaaccttccaccgggcaggaatcgatacctgccatcgccgcacccgtcatcatgttggctaacgcgatataggtctgacggcaacaccagtcaaacaaggcgcgagaatcgtccaaaatcttgatgtcgtcagcttgaaacgcctgataccttgccaaagattttgctacggcatccggttcggtaacgccgcgccgtttgaggctttccaacataaacgggctgtcggagcgggcatttttcttcgccaaaaacaccaccaaatgactggcggtatccaaagcatccgccataccccaagaaaacggcttgattgcctgtcggatttcagggttttgaaccacaataaactgccaaggctccgaaccgaccgaactgggcgacaaacgcccgagttctaaaataaactgaaaatcctcggcactgattttgcgtgccgcatcgtaatgccggcatgatttacggtttttaaatgcggatagaacctgctctttgcttaatactgtcatcgtgcatccttttattacttgtattgcaaattgatttccgatacggcggcagattcgccaataacgcccaaacgcctttcagacggcatttggttcatcgcaaacgcgcctacgggtaggcgatataggcataagccgaatggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccgtattgggaaatttctttggaacacgggcaaagcgaggttacgggaatcatgaccttcatactgtggccgtatgccccgtctttgatttcgcccgtgagacagacatcataatccagtaaggaccgaataccggaaaccggggcggttttcttgcggaaaaatgggaaagaaacgctgattttgccggcgcgggaatctaaaagcgcgaccatttcggtagtcagcttgcgcaattgtgcaaaatccaaggcttcggcatgttgctccatcaatgcgacaaaacgcgacatatgcgtccccttctgctcagcaggcaggtaaaccgtcatggtcagacgggcaatggtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccgccggggaatataccgtcaatctgcaaatgcgagattatatcactcgcttttagcagctgcattgattgtttctatttttcagatagtgataaaatcttcgattattcacatctacataggcagagaccaaatgaaattcgccacgaaagccattcattccagctacgattgcgacgaacacaaccgcgcgctgatgccgccgatttatcaaaacagtatgtttgcgttgcacgagattggcgaaaatgtgccttaccgttattcgcgcctgagcaacccgacccgtcagattttagaagacaccgttgccgatttggaacacggtgcggcaggttttgcgttttccagcggtatggcgggaattgatgccgtatggcgcactttcctgcgcccgggcgataccattgtcgccgtcgccgatatttacggcggcgcttatgatttattggtcgatgtttatcaaaaatggggggtgaacgttgtttttgccgatttaggcaatccggataatttggacgaactgcttaaagcgcacaaggtcaaactggtttggctggaaacgccgtccaatccacttttacgcttggtagacatcaaagtccttgccgcaaaagccaaagcagccggtgcgctggtcggtatcgacaacacttttgccacgccgtatctgcaacagccgttggatatgggttgcgattttgtattccattccgctaccaaatatttgtgcggccattccgacgtgttgatgggcatcgtcgttgccaaaaccaaagaactggcgcagcctttgcacgatatgatggtgcataccggcgcggttgccggcccgctggactgctggctggtgttgcgcggcatcaaaacactggctctgcgcatgaacgcccattgccaaaacgcactcgaaatcgcgcgccgtttggaagcccatcctgccattgaaaaagtgttccatcccggcctgccgtctcacgaacattacgaactggcgaaaacacaaatgcccaaaggcatcggcggcgtggttacggtttatctcaaaaacgacacgcgtgaagcggcaaacagcgtgattaaaaacatgaaactggtcaaaatggcttccagcctcggcggtgtggaaagtttggtcaaccattgctattcccagtcccacagcggcgtaccgcatgatgtgaaaatggaaatgggcatcaaagtcggtctgctgcgtttctccatcggcatcgaagacgcggacgatatttggaacgatatttccgccgcactcgatacaactttgtaaactgtaaaaatgccgtctgaaaccatggtttcagacggcatttcaattaacccggccgaaaatcaacgcttcaacatctttgccgcctcaatagcgtaataggtcaaaatcccgtccgcacccgcacgtttgaatgccagcaggctttccaaaaccactttgccgccgtccagccagccgttggcaatcgctgcctgcaacatcgcgtattctcccgaaacctgataggcataagtcggcacaccgaactcgtcctttacgcggcggacaacgtccaaatacggcaaaccgggcttgaccattaccatatccgcaccttcctgaatgtccaacgccacttcgtgcaacgcctcatcggtatttgccggatccatctggtaggtctttttatctgccttgcccaaattgcccgaactgcctaccgcatcacggaaagggccgtaaaatgcagaagcatatttggcggaatacgccataatccgcgtatggatatgcccggcatcctccaacgcctcgcgaatcgcaccgatacgcccgtccatcatatcggaaggggcaaccacctgcgcgcccgcttcagcgtggcacaaagcctgcttgaccaaaacctctacggtttcatcgttcatcacataaccgttttcgtccgtcagcccgtcctgaccgtgaaccgtataaggatcgagcgcgacatccgtcataatgcccagttcgggaaacctctcgcgcaaggcgcggacagttgacggcacgagtccttcgggattgtacgcctcctgcgcacgctcggttttgtttgccgtaaccacggggaacagtgccaacatcggaataccgagctttaccgcctcttccgccgtaaacagcagcctgtccaaactttgacgcttcacacccggcatagaaggcacatcctcctcgcgcgccgacccctccaatacgaacaccggataaatcaaatcatcggcggtcagcgtgtgttcgcgcatcaggcggcgtgaaaaatcgtccctgcgcatacggcgcatacgcgaagccggaacattgcggtaaggaaactgcataagccctccaatcatcctgtcaacaattcaaaccatacggaagccgccgcaacttgcagacagcatcgggcggcaatcaaaatccgttttcaccggaaagggtttcggcccgccgaaatgccgcgccgaaggacggcgtcccgcccgttaaagaacaatagcaaaacaactgcttcaggctgtcaggcttcgatattcttacgccacaataccaaaagttttccgatatgctgaaccagttgcgcatcaaccgcctcacataaggcagtgcagatttcgatacgttcggcacggtcgtcgccgaatacgcgcactttaatcagctcatgcgccgtcaatgccgcatcggtttccttgatgaccgcgtccgtcagaccctgctgaccgaccatcacaacaggatggagatggtgcgcgcgcgctttcagttccaaaatttctttggtgttcaatttggtatccgtcattttcctactgcttgaataaaaagaataatgcggcattgtacgcgatttggcacgacatcggcaaaattaacgtacaatacgcggtttccattccgacccgcgaaccactatggctgtacgttccaaatcctcaaaagcgtggctgcacgaacacgtcaacgaccactacgtccatatggcgcaaaaagacggctaccgcgcccgtgccgcatacaaacttttggaaatcaacgaaaaagacaaattaatcaaacccggcacggtacttgccgacttgggcagcgcgccgggaagctggtcgcaggttgccgccaagctgacgggtacttccggagcagttttcgccttggacatcctgcctatggaagccatagggggcgtctccttcattcagggcgacttccgcgagaacgacgtactggcacaattcgaaaccttgttggacaaccgcccgctcgaccttgtaatttgcgatatggcgcccaatatgtcgggaaacgccgtaagcgatcaggcacgcagcttttatctgtgcgaactggctttagacttcgcctcgcaacacctgaaaaccggcggcagctttttggtcaaagtctttcagggtgcaggctatcaggaatacatggcagccatgcgcgaaattttcggcacggtgcagacgcgcaaacccgaagcctcgcgcaatcgctccagtgagatttatttattgggcaaaaataaacgctgacaatacagacggcgtgctttacaatcatttccgttttacacctcaattatggagccttgctaagtggggaacacctttaaatcaatccttgtctgggtcgccttgggtatcggcctgatggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgattttgaagacgccaaagacaaaatctatatgggtccggaacgccgcagtatggtgatgcacgaagacgaaaaacgtgcgacggcgtatcacgaatccggacacgcgattgttgccgaaagcctgccctttaccgaccccgtccacaaagtaaccattatgccgcgcggacgtgcgctgggtctgacttggcagcttccggagcgcgaccgcatcagtatgtataaagatcagatgttgagccagctctccatcctgttcggcggacggattgccgaagacatcttcgtcggacgcatctccaccggcgcatcaaacgactttgaacgcgcaacccaaatggcgcgcgaaatggtaacgcgctacggcatgagcgacaaaatgggcgtgatggtttatgcggaaaacgaaggcgaagtcttcttgggacgcagcgtaacccgttcgcaaaacatttccgagaaaacccagcaggacatcgacgcggaaatccgccggattttggacgagcaatatcaggttgcctacaaaatcctcgatgaaaaccgcgacaagatggaaacgatgtgcaaagccctgatggaatgggaaaccatcgaccgcgatcaggtactggaaatcatggcgggcaaacaacccagcccgcccaaagattacagccacaacctgcgcgagaatgcggacgcggcggaagataacgcgccgcacgctccgactcgggaagaaaccgaagcacctgccccggcagacaccgcttcgacagagtccgagcagcagcctgaaaacaaggcttaacttcccgaacaaacggcagcccgcaagctgccgttttcccatcccgttttcagacggcattttccactcaatgccgtctgaaacgccaaagccgtatcggtttttacgaatctgcgatatggcggtttaaattgaaatcagaacggggcaaggctgtaccggtttaaaattaaaccgctataataccgcccttcgaatacacgcccgcattggtgatgcccgtgaaaaaagttgaaaaaaacatcttggtgctgcacggcgcggacaaaatgttcgagctggtcgacaaggttgaagactatccgcactttctgccgtggtacagcaagaccgaagtcatcgggcgtagcggcaacgaactgaaggcgcggctgtttatggattatatgcacgttcgccaatcgtttgccacgcacaaccgcaacattccgggcagggaaatccgtatggaactgctcgagggtccgttcaaaaccttacgtggaacgtggaaatttatcgatttgggcgacgatatgtgcaaaatcgaattcaatttggaatacgatttttccaatgccgttttgtccgccttaatttcccccgtcttcaaccacctttccaccacgctggtcgaagcgttcgtcaaagaggcagaccgccgttatgcttgaaattgagattgtgtacgggctgcccgaccgacaggttttgaaaaccatgcagcttgccgagggaacaaccgtccgcgccgccgcactgcaaagcggtttggacggcatatttgaagatttaaacctgcattccgcgcctttgggcattttcggcaaagccgtcaaagacgacacgccgctgcgcgacggcgaccgcatcgaagtgtaccgcccgctgttgatcgaccccaaagaagcgcgccgcaaacgcgttcaaaatcaagaagaataaccatgccgtctgaagccttcagacagcattcgacagaaacacggaaaatatcatgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgccgccctgcccgacggcgacgtttggctgctcaaacctgccacgttcatgaaccgttccggacaggcagttgccgcgcttgcacagttctacaaaatcaaacccgaagaaatcctcgtcgtccacgacgaactcgacattccctgcggacggatcaaattcaaactcggcggcggcaacggcggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgggaagaagcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctctacgaatgcagcatagacgatgccccctccgccgaagaaattgccgtttggcgcgatatgctggccgcacgcggcggaaaattcctgcgcctatccaaactatgccagacatggcttgaagaggaacaagcatgaatctgccacgcaaccgctttatcctgctctcggcattgtggtttgcaggcagcatttactcactgcttttcaaagctgccgaaaccgcgccaccgccttttccgcattttgacaaagtggcgcacctcgccctgtttttcgcacaaatctggcttctgaccaaagcattcagaaccgacaaccgccccatcccctatcgcagcctgatggtctttgccctctgtttcgccctcttcagcgaatgcgcgcaggcatggtttaccgcaacgagaaccggcagtttgggcgatgtccttgccgacctgacgggcgcagcccttgccctctttaccgcgcgagctgcctgccgcccggactaaatcggtttattttccccaaacaggatgcacctcttcccgatatatcctatttttccccttacatatcaatcccatctcataaacaaaaccgacaaatcgtttacaatatatttacactacatcagattacaaatatactcgaaccagttgcagaagcggcgattccacaaaccgtttcggattgcacgacacaaaagaaaaaccgattttgttgccttaaaggagtattcatgaacctgcatgcaaaggacaaaacccagcatcccgaaaacgtcgagctgctcagtgcgcagaagccgattaccgactttaagggcctgctgaccaccattatttccgccgtcgtctgtttcggcatttaccacatcctgccttacagccccgatgccaataaaggtatcgcgctgctgattttcgttgccgcactttggtttaccgaggccgtccacattaccgtaaccgcactgatggtgccgattctcgccgtcgtactcggtttccccgacatggacatcaaaaaggcgatggctgatttttccaacccgattatctacatttttttcggcggcttcgcgcttgccaccgccctgcatatgcagcggctggaccgtaaaatcgccgtcagcctgttgcgcctgtcgcgcggcaatatgaaagtggcggttttgatgttgttcctcgttaccgcctttctgtccatgtggatcagcaacaccgccaccgccgcgatgatgctgcctctagcaatgggtatgctgagccacctcgaccaggaaaaagaacacaaaacctacgtcttcctcctgctcggcatcgcctattgcgccagcatcggcggcttgggcacgctcgtcggctcgccgcccaacctgattgccgccaaagccctaaatctggacttcgtcggctggatgaagctcggcctgccgatgatgctgttgattctgcccttgatgctgctctccctgtacgtcatcctcaaacctaatttgaacgaacgcgtggaaatcaaagccgaatccatcccttggacgctgcaccgcgtgatcgcgctgttgattttccttgccacagccgccgcgtggatattcagctccaaaatcaaaaccgccttcggcatttccaatcccgacaccgttatcgccctgagtgccgccgtcgccgtcgtcgtcttcggcgtggcgcaatggaaggaagtcgcccgcaataccgactggggcgtgttgatgctcttcggcggcggcatcagcctgagcacgctgttgaaaacatccggcgcgtccgaagccttgggacagcaggttgccgccaccttttccggcgcgcccgcatttttggtgatactcatcgtcgccgccttcattatttttctgaccgagttcaccagcaacaccgcctccgccgcattgcttgtaccgattttctccggcatcgctatgcagatggggctgcccgaacaagtcttggtattcgtcatcggcatcggcgcatcttgtgccttcatgctgccggttgccacaccgcctaacgcgattgtgttcggcacgggcttaatcaagcaacgcgaaatgatgaatgtcggcatactgctgaacatcctctgcgtagtattggttgctctgtgggcttatgctgtactgatgtaaaccatcgacctaaacaacaagaccgtctgaaagaatatttttcagacgaccttgaagtttgtcgttcagacacaatttgtcgaatcattcaaaaccagattctaacgaaaggaaacccatgattatcctgcacaccaacaaaggcgacatcaaaatcgaactcgatttcgacaaagcccctgttaccgccaaaaacttcgagcaatacgtcaaagacggcttctacgacggcgtaatcttccaccgcgtcatcaaaggcttcatgattcaaggcggcggcatggatgaaaacatgaacgaaaaagaaacccgcgatccgattcaaaacgaagcgtccaacggcctgcccaacgataaatacaccatcgccatggcacgcacttccgacccccattccgccagcgcgcaattcttcatcaacactgccgacaacgctttcctgaacttccgttctaaagagctgtacggcaaaaccgtcgtccaagactggggctatgccgtattcggtaaagtcgttgacggttttgacgttgtcgatgccatcgaaggcgtttctaccaaacgtcatggttaccacgacgacgtaccgagcgaacctgtcgtcatcattaaagccgaagcggtataaaccgacaatccgaaagcagcctgcacaaaggctgcttttatttcagacggcatgttatttgatgtaaccgtgctatgccgtctgaaaaccggacgcaagccttcagacggcataccgctatgttaaaatatgcccgtttttcctaaacggacacaaaggaaaccttatggcaagcatcgcccgcgacatcttcaaagcctacgacatccggggtattgtcggcaaaaccctgaccgacgaagccgcctaccttatcggcaaagccatcgccgccaaagccgccgaaaaaggcattacccgcatcgcgctcggacgcgacggacgcttgagcggtcccgaactgatggaacacatccggcgcggctttaccgacagcggcatcaatgtcctcaatgtcggtatggttgccactcctatgctctacttcgccgccgtcaacgaatgcggcggcagcggcgtgatgattaccggcagccacaatccgcccgattacaacggctttaaaatgatgctcggcggcgacacgcttgccggcgaagccatccaagaacttttgtccatcattgaaaaagacggttttgctgccgccggcaaacaaggcagcgtcaccgaaaaagacatctccggcgaatacctcaaacacattaccggacacatcaggctcaaacgcccgatgaacatcgccattgacgcgggcaacggcgtgggcggcgcgtttgccggcaaactctacaaaggcttgggcaacaaagtaaccgagcttttctgcgacgtggacggcactttccccaaccaccatcccgacccatccaaaccgaaaaacctgcaagatttgattgccgcgctgaaaaacggtgatgccgaaatcggcttggcgtttgacggcgatgccgaccgcttgggtgtggttaccaaagacggcaacattatttatcccgaccgccaactgatgctgttcgcccaagacgttttgaaccgcaatcccggcgcgaaagtcattttcgacgtgaagtccacccgcctgcttgcgccttggattaaagaacacggcggcaaagccataatggaaaaaaccggccacagctttatcaaatccgccatgaaagaaaccggcgcgccggttgccggcgaaatgagcggacacatcttcttcaaagaacgctggttcggcttcgacgacggtctgtacgccggcgcacgcctcttggaaatcctgtctgcctccgataatccgtccgaagtgttaaacaacctgccgcaaagcatttccacgcccgaactcaacatcgccctgcccgaaggcagcaacggccatcaggttatcgacgaactcgccgccaaagccgaatttgaaggcgcaaccgaaatcatcaccatcgacggtctgcgcgttgaatttcccgacggcttcggtctgatgcgtgcttccaataccacgccgattctggtgttgcgttttgaggcggatacgcaagaagccatcgagcggattcaaaaccaattcaaagccgtcatcgaaagcaatccgaatctaatctggcctctgtaaacacaggaaaaatgcttaatcaaatcttggtagattggatttggcttaaaaatctccgcgtccgttcgtgtttggggtggtcgaacaaatcttgcgggctgccttgttcgacaataacgccgccgtccatcacgacgacggtggttgccacttctaaggcgaacttgatttcatgcgtaacgacaaccatggtccagccttcttgcgccaattccttcatggtatccaaaacatcttgcaccaattcaggatcgagcgcggaagtcggttcgtcaaacagcatcagttcaggctgaatcgccaatgcgcgggcaatgccgacgcgctgctgctgaccgccggaaagctggtagggatacaaatccactttgtcgcccaagccgactttttccagcagtttcagagcctcttcgcgcgcttgggcggcaggcttgccctgtacggcaaccggtccttccattacgttttccaaggcggttttgtgcggaaagaggttgtattgttgaaacaccatgcctgatttgcggcgcagtgccaaaatatcgtgtttgcttggttttttagaaaaatcgattttcagcggtcgctcgttgtcgaactcgatttgtccgtcttcgggcatttccaacgcgtttaggcatcgcagaaacgtcgttttgcctgagccggaaggcccgaggatgacgaccacctgccctttgcacacatccaaatcgatgccgcgcaaaatagtgttttcgccaaaggtcttatggatattgcggattttaatcatgacaactccttatttggcgacgtagcggtcgaaacgtttttccaaacgcgcctgaatcaggaacagcactttacaaaaacaccagtaaaccaaagcggcttcgatatagacgggcaaaaagtcataagtgcggtttgccgtttcctgcgcgacgcggaataattccgttaccgtcacgactgccgcgagcgaggtgtttttaaacaaaccgataaactcgttgctcaaaggcggcacggcaacgcggaatgcctgcggcgcgacaatgcggcggaacgtctgcatataggtcatgccgatggagaaacctgcttcccattggcctttaggtacggacaaaattgccgcgcgtatggtttcggaagcgtatgcgccgacattgagcgaaaagccgatgatggcggcaggaatcgggtcgatatagatgccgacggaaggcagcccgtaaaacacaatcacaagctgaaccaacagcggcgtaccgcgaatgacggaaatataaaattccaccaatttcagcaggattttccgcacgatgccgccggcgggcataatccgcaccaaagccacggctaccgcaatcatcataccgataacgaaagaagctgccgccaaaggcagagagaccgcgaagccggctttgaccataggcaaaaacgcgctgacaatcatatcggcgcgtgtttccgtcataaacggcagcgaagcaaggaaattattgaacactgatgtcttttccgaagaattgttcgcccagttttttcagcgtaccgtcggctttcagctcgttgattgccgtactgaatttcgccacggcttcgtcattgcccttgttgacaatcaggccggaaccgactttttcatcggcaggtgcggaccaaacgattttcacgcccgcattcgggtttttcttcagatagtccaaaaccgccaattcgtcgttcagggttgcatcggcacgtttttgttcaatcagggtcagcgattgcgccaaaccgtcaacagccaccaaatctgcgcctgcagctttggctttttcgccgtagttgctggtcagggattgtgcggttttcacgcctttgatgtcggctatagatttgatgttgctgtcgttacggacaaccaatacggcaccgctccagctgtaaggatcggatttgtcgaatgtcgcttggcgttcggggctggtcagaccgacttggtttgccaccacgtcgaaacgccccgccttcaaacccgccatcatcgaatcccattgcgtttctttaaactcgactttcacgcccagtttttccgccacggcgcgggttacttccacatcgtaaccggtcagtttgccgtccttgtcgtggtaggtaaacggtgcgtaagtgccttccgtgccgacggtaaccgtgcctttattgttgatgcgctcgattaaagaaccggaaactgccgattgtgcaggcgcggaagatg

SEQ ID NO: 37777 - DNA, 102634 bp, Neisseria meningitidis
  misc_feature (1)..(102634): N is any nucleotide
ccggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgcttggtttgcacttccgacagcgggcggttgcggcaggctttgctcataatgccgtccaacaactgatgttcttccagatgttgccggttttccgcactgtcatagcctttatcggcatagacggtcgtaccttcgggtaacccttccaacaacggcgacaggtgtttgcactcatgggcattggcgggggtgatgtgcagtttctcgatatagccttccgcatcggtacgggtatgttgtttgtaaccgagtttgtagaggccgtttttcttgatccaacgggcatcgctgtccttactcggtgtggtttggccgctgatttgtccttcttcatcgacttctatggcctgacgctgttcgctgccggcggtctgaataatggtggcgtcaatgacggcggcggatgctttctctacttttaagcctttttcggtcagttggcagttaatcagttccaacagttcggacagggtgtcgtcttgcgccagccagttgcggtagcggcataaggtgctgtaatcggggatgctcagttcgtcaaaacggcaaaacaggttgaaatcgatgcgggtgatgaggctgtgttcgagttcgggatcggagaggctgtgccattgtccgagcaggacggctttgaacatggatagcaggggataggcgggacggccgcggtggtctcggaggtaacgggttttttgacggttcaggtactgctcgatcggctgccaatcaatcacttggtccaacttcaatagcgggaaacggttgatgtgtttggcaatcatggcttgcgcggtttgccggaagaaggtgctcatgagaaatcccctaaatgtcttggtgggaatttaggggattttggggggattttgcaaaggtctcaggcggcaaatcgccacccttcccttcaaaccttccgcctgtcccaacagcagacaggcgaaaaagcccttaccactgataaccgacagatgcggaagcaccgaaatggccgcgcgaattgccggaagccgtgcctttgataatccaatttccgccgtcggaaatactggagtagccgatggcgtaaccggcttcgccgcgataagtgccgccgccgatcgccatcatactcttgccgggcaaatacgcctgaaccagacctgcggttgcaatcgcttgggcgatgcccgcacgcgcgttgccgtccacattgtcgatgcggttgttcaagttttgcgccacgcctttaagttgtgcgacgtttgtaacatccccctctttaacgcccggggcgacattggtaatgcggacgggtttgttgtccttcttgctgccgacattcaatgcgtccccatccacgctcaaagtgggcgcatccgcccccgcgccgagcgaaacgctggaaaactgcggggtcatcgaagtggcgatgtcgatatttttaccgttgcgggtaatctcgatgttgttgccggcattaatgttgacggtttcatccatctttcccttgctcggcgaaacattgccgctgatgactttgcccgaagaacctgcaaccgctttggaatccaaattccaaccgctgttttgcagctgattgacgtttagggcatcgccgacatttacatcatacataacagtgatgttgccttgatcatctttacttacagtcgcagttgtacctttaccactagcaaaggttacatttgtgcctgatgtaacggtttcaaacttgtcagcttgacctgtttgaccattagcggttgttgttttcattctccaaccagccttgtttactgcatcaatcacttcttttgcagtcactaagccttcgccttcgtctgtagaagaaccattctcgcctttgtctttaccagtaaccaacttaccgtctttttctttaataacagaagtcttcgcaccgattttaacttcggttttcttgccgttgtctttgctttccacattaacagtcgttgttttcgtatctgcgctcaagaactcgactgtgtcgtaagtgcggacgaaatcaacgttatcggaagctgttgtaccgggtttaacgcctttaatgttccagccagcgtttaatacgtctttaacgcttgccgcacgttttttctcgtcatcggtaacgttgtcgttggttacgtttgtggtcgctccggtattcagcagcgtatcggtcaaagtcgaaccaataccgttcagatgaaccgtggtgtcgccgttcgtcccagccgtttctttcgcaaaattcaagcctttggtgtcgcttgtgatgttgactttattgccgtttgcgctaaacgataatttttcagttccaacactggtcagatctgtgaggtcttttttcagcgagtaggtgaagtttgtgccgttttgtttgattttcaggttgtcgccggctttgagggtgatttctctggctgttagtactcctttctcgttgaaatatactgcccaatctgaattttcttctactttttctttttctcccgtgccttctttatcggaattgactatcaacacggcaacagtgcgttgtacggggtctaaatataaatcttcttcttgctcttcattgttagcacttgcctgaaccgttgcaaacaacagtgtcgccaatacggcggtcttcacggttgcggaggcgcgtttggtgtggttgcgtgtgagctcggatacgacgacccaggcattgagggcactattccaaatgatgcggtatattttgttcattttgttttttcttttggtttgtttgaatggttaaatcggggtttgggggcggatggtgcggcatccgcccggtttttgggggttgggggttttctgataaattcccccaacttaaaatctcgtcattcccgcgaaggcgggaatctgggacgtggaatctaaggaaactgttttattcggtaagtttccgtgccgacgggtctggattcccgcttttgcgggaatgacggcggtggggtttctgttttttctgatagattcctgtggtttttctatggattcaatcattcctgataaattcccataatctaaaatctcgtcattcccgcgaaagcgggaatctaggacgtggaatctaaggaaactgttttatccggtaagtttccgtgccgacgggtctggattcccgcttttgcgggaatgacggtcggtggggtttctgttttttccgataaagtcctgccgcgttgtgttgctggattcccgcctgcgcgggaatgacggcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgacggcggtggggtttctgttttttccgatagattcctgttgcgttgcgtttttggattcccgcttttgcgggaatgacgcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgatggcggtgggggtttctgttttttccgataaagtcctgccgcgttgtgtttctggattcccgcttttgcgggaatgacgcggtgggggtttctgtttttgctgatagattcctgtggtttttctatggattgaatcattcctgataaattcccataatctaaaatctcgtcattcccgcgaaggcgggaatctaggacgtggaatctaaggaaactgttttatccggtaagtttccgtgccgacgggtctggattcccgctttcgcgggaatgacggcggtggggtttctgtttttgctgatagattcctgtggtttttcggttgctggattcccgcttttgcgggaatgacggcggtggggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacggccgccggacggcaaacgaccatacacaattattgacaaccccatttattgcgaaagtcagcctaggagaatcgatctaattgtcaacattcccttatgatcaaagggattacactttattttacgcaaatgcgggggggggggtgatttttgacgttttttgccgaaaatttacattcggacgacgaaaaggaaaaagccgtgtcgcatctgtgcaacacggcttggcgggcgcaaacggatatagtggattaacaaaaaccagtacggcgttgcctcgccttagctcaaagagaacgattctttaacaagtgaattggttccgtactatttgtactgtctgcggcttcgtcgccttgtcatgatttttgttaatccactataaaacggtgttccctgccgccgcaggcggaacgccggatgacggggttttccctaagggtgcggctgccgctatatcacgaaatccaacaggtagaaatcttctttgcccacgccgcattcggggcatttccagtcgtcggggatgtcttcaaacttggttccgggggcgatgccgtgttcggggtcgccgtgttcttcatcgtaaatccagccgcaggggccgcacatatattgcgccatttgtgtttccttgttttttgtatagtgggttaacaaaaaccggtacggcgttgcctcgccttagctcgaagagaacgattctctaaagtactgaagcacccgtactatttgtactgtctgcggcttcgccgccttgccctgatttttgttcatccgctataaatcagggtttgggagaatggtgcggtatccgcccggtttttttggggttggtttttttcgatagattcctgtggtttttcgattactggattcccacttccgtgggaatgacggtttggaggtttcggttttttcgatgaattcctgttgcgttagggggggggctggattcccgcttttgcgggaatgacggtttgagggtttctgttttttccgatggattcctgttacgttgggggctggattcccgcttttgcgggaatgacggtttgagggtttctgttttttccgatggattcctgttacgttgggggctggattcccgcttttgcgggaatgacggtttgagggtttctgttttttccgatggattcctgttgcgttgggggctggattcccgcttttgcgggaatgacggtttgagggtttctgttttttccgatggattcctgttgcgttgggggctggattcccgctttcgcgggaatgacgcggtgggggtttcggtttttccgcctgtttattttgcggcttcgattgccgctatttctttgcgtaggtgtttgatagcgggggttacgatggcaacaaacattgcttcgcggacgcgcctttgggcgggactgcgcatcaggtagccttttgcgccggaatgcagggcggcggattgggcggcggcaagtgccagtacggcggcggcttcgcgcagcttgagggtagcaaggttgtcgggcgtgccgctccaagccaagccggcgagccgttcggtttctgcccacgcgccgtccagccttgttttgaggctgtcgtagccgtcgttgaggtagttgttgacttcggcgttgacgacgttggcgaggcggatgatgccgaggctgccgtcgattacgcccgcgccgatgccgatttgcaggaggataaagcctgctttgatgctttggatgtagtcggcaaactgttcgggcgcggcgatgatgtcttcgtcggggataaatacgtctttgaaattcaggctgaaggtgcgcgtaccttcgagggcgcaaaattcggggcagttttgcaggcttacgccttcccattgtccgcctgtgatgaacataacgtagccgtcgccgatttgggcggtattcgcccagatgtggtcttcaccgatgttggacacccacggcagcgcgccgttgactgtgtagccgccttccacgcgttcggcttggaggttgtgtttttcgatgtcggcaaggtgtttgacggtattggacatgcccgtacccgccaatactttgccttgcaggatgtcggcaaggtatttgtctttgacggcccggttgggcgtttggtgcagataccacgcgcaagccgcctgacaccacgcactgaaagaggttgcgccgcattctttgccgatttcgcgcaatacggcgatttgcgttgccaaacccaagccgttgccgccttcggcttctgtaccgactgcgccgaatccaccgattgcgccgagttcgcgcataaatgcttcggggtagtatcctttgcggtcgatgtcgtccactatgggtttgagcttggttttgacgaattcggcaacgttggcaatcagggtttgggcgttcatctttgttccttaaggtttgcggggaaatcgggggcgcgcctgatgcgcggctgcttccctgccgcttaggcggcttgtttttgtttgagggggtgtttttgaaaaaccgcccgatattcgggcggtttgccgtatcaggcgtaagcctgcaattcggggttgatttcggtttgtccgaggttgttgacgtagttgcacagggttgccaaggctacgcccatcacgacttcgactgcctgctgctggttgtagcccgcatcgaaaaatgctttgagttcctcgtcggataccgcgccttttttcgccattacggcttgggtgaaggcggcgagcgcgccgagtttggcatcgtcaaattcgcctgctgccaaagcgcgcgcggctttgacggattgttcggacaggagttttttcagggttgcgagtttggtgtgccctgccacgcaaaaaccgcattggttggtacgggcggcgatgatctggatgacttcgacttcgccggcggtcaggctgttggcggcgttgagcttgccgacttcttggtaaaacgccaaggcttcgggggcgtttgataatacgccgataaggttggggataaagccgttgttttgaagtaccgcctcgacgcgcgctttggcggcttcgggggcggtttcgagggtgtgtacggttaaacgtgccattttctttccttgttcgcaaatattgggtacgggcgcatggtatgcatttcggaacggaataggaaagactgattggttatgtgctgcaaacaaaaggttataagaaatgccgtctgaacatttttcagacggcatgatggaaaagaaaacgcgcttatcggcccccgcgcccgaaatattgcgccaatgcggcttggggattggctgcctcaaccgtttcgggcaattcggtatagccgcgcgataaaaggtggcgtgcataaaggctgttgccctttgcgccgaaccagacggaaaccgccaagcccaatacgttaaacgccgagtctgtggcgggcgtgtcgccgtaaaccagttgggcaaacacagccagcacgaatatcgcgcccgtcagccccagccccaaaccccacattcttttgaaacacgcccacagcgtgccgaacaagagccccggccatgaccagccttgtttgacggcttggggcggcagggcgggatgggtgtagattttgtatggtttcatcgtgtttccttttcggttgaaaccctgccctttgggaaggtaggatcagactttatagtggattaaatttaaaccagtacggcgttacctcgccttgccgtactatctgtactgtctgcggcttcgttgccttgtcctgatttaaatttaatccactatatttgggaggcgcgcgcgcctgtgccggcatacggcttgaaagcgattacccgatggggaacttcaaacccgacaatgccgtctgaacggtgtcttgccttcagacggcattgcctgccttcaaagcggacgcgcttattccgcccagtttttctttttgctggttttgcctacgcccgggttgaagctgttggtcgggtcaagtttgcggtaaaactgtttgagcgcgggcttggcttcgtacaaatggccgacgttgtgttcggctggatattgcgcgccgcgttgatccaagagatgcagcatttcgtgttccaatgccatgcagtcgttgccttttttgatgatgtaatcctgatggaaaacgtggcacatgaaatgtccgtagtagagcttgtggatgattttattgtcgatttccggcggcagtttttcaaaccagtcgcggtcgtcgcggcgcagggcgatgtcaagcgcgaccaagtcctccacttcgtcgtcgtgtacggcacggtagcggatggcggctgaggcgacggcgaaacggtgcagcatcgcggcttgggtttcttcggcgttgcactcgaaaaacgcgccgccgtgatgtgcaaaatactctttcaggaacgcgcgcgcctcatccacgccttttccgcccattttcagaatcaggtggtgttcgtatttgtcgcggtaatcgcgcatggatttgggcagatggtcaggcaggaatttgctgacgaactgcattgccttgtcggaaaaatgtttgggcaggaagctgacttttttgccgaacctgtccacgcgtgccttcaaatcaaataatttcggcagttggtgcgtaccgaattttttgatgacgtaaaacgtatctttgccgtacacgtcggcaatgtcgaaagcgtggcggtggatgtattcgccggaaacgggcaggctttcaaattcgcccaaggcggcgcggcggatgtcggtcagctcgttgatgtcgttcgtgccgatgtagaacacggccgtttgtttttcttgcggaaaggtatccaagcggacggcgaataccatcagcttgcccgcgcagcccgaggcttcgtaatggcgcgctgggtcggcattgaaacgcgcggcggtcggttcgtccacttggcggacatgttcgcaataggcgtggtcgtgtcctttgcccgcgtcttgcgtgatgtctttgttttgataatgatgaccttgaagattggtcaggatttcttcgggcgtgttgcccaagtctatgcccaagtggttgaccagttccaacctgccttcttcgttgatttgggcgaacaacgccatttcggtgtaggccgggccgcgctgtaccaacgcgccgccagagttgttgcacacgccgcccaagacggacgcgccgatacaggatgagccgataaccgaatgcggttcgcgccccaaaggtttcagcagcaattcgagctggttcagggtcgagccgggcaggcagacgacttgttcgttgttgttgatggtttggatgatgttcatccgcatggtgttcacaatcacgatgtcgcggtcgtaatcgttgccgtcgggggtcgagccgcccgtcaaaccggtattcgccgcctgcgtaatcacaatcacgtctgcttcgacgcacgcctgcagaattttccacatttccagaatgcttccggggcgaaccaccgccaacgccttaccctcgccgaagcggtaaccttggcggtattgttcggttttcgcggggtcggtgatgatgtatttttcgcctacggtttgggtcagtcttgacagtaattgtgatgcgctcatggcagtttccttaaaattgtcggcaggtgcattgcacattggaattgttttcacattgtagttatacgttatggcaaagtaaagaaaatgccgtctgaacggctttcagacggcatcggtgcgatacgggaacgccggaacatcgaagctccggcgtttcaaatagggcggcgggccaaacccccggcactggcgcattggagtgggctgctggcttccgcccctgacccggtgttccgatttgccatgcggggagacccgcctcagagaaacggcattataacgggttttctgaaaaactcaaccgttttgatacggtcatacgccggaaacaccacctaaaatttatatttgataatattgtcaacaatttctcaaagcgttattttgtttctataagggtatttcctgtttcggcattgaaaagtatcaaaaattgaactacattatcgccttttcaaactcgcctgaaaccgacttttcagacggcattcaaataaaaactgccaaacacggacacaccatgaccacgactaccgcccctcagcgtattcgggaaatcccctacaactatacttcctacaccgaccgcgaaatcgtcatccgattattgggcgacgaagcgtggcaaatcctgcaagacctgcgcggtcaacgcaaaaccgggcgttcggcgcggatgctgtttgaagtgttgggtgatatttgggtggtcgtgcgcaatccgtatctggtcgatgacttgctggagcacccaaaacgccgcgccgcgctggtacgtgaaatgcgccaccgcttaaatgaaatccgcaaacgccgcgacgataatcggcaagtggatgtgttggttgccgcagcagaaaaagcagtcgagcgttttgatagcagttttgatgaaaccagccaaaaacggcggcagattttggagcgtttgagcaaaatcaccaagccgcacaatattatgttcgacgggctggcgcgggtaacgcacgttaccgatgcaaccgactggcgcgtggagtatccgtttgtcgtcgtcaatcccgacacggaggctgaaatcgcgcctttggtgcgcgccttaatcgagctggatttggtcattattccgcgcggcggcggcacgggttataccggcggcgcgattcctttggacgcaaacagcgcagtcatcaataccgaaaaactcgacaagcatcgtggtgttgaatacgttgagctggcaggcttggacggcaagcatccgattatccggtgcggcgcgggcgtggttacgcggcgggtggaagaaaccgcgcatcaggcaggtttggtgttcgccgtcgatccgacttctgccgacgcgtcatgcgtgggcggtaatgtggcgatgaacgcgggcggcaaaaaagccgtgctgtgggggacggcgttggacaacctcgcctactggaacatggttaaccctcaaggcgaatggctgcgtatcgagcgcgtgcgccacaatttcggcaaaatccacgacgaagaaaccgccgtgttcgacgttcacacgctggattcagacggcatcaatatcgttaaaaccgaacgcttggaaatccccggccacaaattccgcaaagtcggtttgggcaaagacgttaccgacaaattcttgagcggcctgcccggcgtgcaaaaagaaggtacagacggcatcatcaccagcgttgccttcgtgttgcataaaatgccgaaatacacgcgcaccgtgtgtatggagtttttcggtacggtcgccaccgccacgccatctattgtcgaaatccgcgactttttgcttgcccatgaaagcgtgcggctggcgggtttggaacatttggactggcgttatgtccgcgccgtcggctacgccaccaaagcggcgggcaagggacgaccgaaaatggttttgctggcagacgtggtttcagacgacgaagccgccgtagaggcagccgccgaacacatctgtgaactcgcacgcgcccgcgacggcgaaggctttatcgccgtatcgcccgaagcccgcaaaaccttctggctcgaccgcagccgcaccgccgccatcgccaaacataccaacgcctttaaaatcaacgaagacgtggtcatcccgctcgaaaggctcggcgagtattcggacggcatcgaacgcatcaacattgagctttccatccaaaacaagctcaaactctgtgccgccttggagcaatatctttcgggcaaactccccatcgacaaaatgggcactgacctgccgaccgccgaactgttgggcgaacgcggcaaacacgccctggcccacgtttccgccgtcaaaacgcgttgggaatggctgctcgccaatcttgacacgccgcttgccgactacaaagcccgctacggcgcagccgtccacgccgcacccgaagccaaaaacaatgaaagctgctttattgccttccgcgatttccgcctgcgcgtgtctgtcaaagcggacgtaatgaaaccgctttctgaaatcttcagcggcaaaaccgacaccaaaattatccaaggcttgggaaaaatccacgcaaaaaccgtacgcagccgcgtctttgtcgccctgcatatgcacgccggcgacggtaacgttcacaccaatattccggttaactcagacgatgccgaaatgcttcagacggcataccgctcagtcgaacgcattatgaaaatcgcccgttcgcttaacggcgtgatttccggcgaacacggcatcggcattaccaagctcgaatttttaagcgacgaagaaatgcagccgttttgggactacaaaaaccaagtcgatccgaaacacaccttcaaccgtcacaaactgatgaaaggctcggacttacgcaacgcctacacgccgtccttcgagctgttgggcgcggaatcgctgattatggaaaaatcaaacctcggcacgattgccgattccgtcaaagactgcctgcgctgcggcaaatgcaaacccgtctgctctactcacgttccgcgtgccaacctgctgtacagcccccgcaacaaaatcctcggcgtgggcttattgatcgaagccttcttatacgaagaacaaacccgccgcggcgtttccatcaaacactttgaagaactcatggacatcggcgaccactgcaccgtgtgccaccgctgcgtcaaaccctgccccgtcaacatcgacttcggcgacgttaccgtagccgtccgcaactatcttgccgattccggccacaaacgatttgcgcctgccgcagctatgggtatggcgtttttgaacgccaccggcccgaaaaccatcaaagcccttcgcgccgccatgatacagatcggcttcccagcgcagaatttcgcctacaaaatcggcaaacttcttccaatcggcacgaaaaagcaaaaagccgaacccaaggcaaccgtcggcaaagccccgattaaagaacaggttatccatttcatcaaccgcccactgcccaaaaacgtacccgccaaaacaccgcgctccttattgggcatcgaagacggcaaaagcatccccatcatccgcaaccccgccgcgcccgaagatgccgaagccgtgttctacttcccgggttgcggctctgagcgtctgttcagccaaatcggacttgccgttcaagccatgctctggcacgtcggcgtacaaaccgtcctgccgcccggctatatgtgttgcggctatccgcaagacgcaggcggcaataaggcaaaagccgaagaaatgagcaccaacaaccgcgtggctttccaccgtatggcgaacaccctcaactacctcgacatcaaaaccgtcgtcgtcagttgcggcacttgttacgaccagctcgaaaaataccgctttgaagaaatcttccccggctgccgaatcatcgacatccacgaatacctgctcgaaaaaggcgtgaaactcgacggcgtaaaaggtcagcaatacctctaccacgacccctgccatacccccatcaaaaccatgaacgccacccaaatggccagcagcctgatggggcagaaagtcgttttaagcgaccgctgctgcggcgaatccggtatgtttgccgtcaaacggccagacatcgccactcaggtcaagttccgcaaacaagaggaaatcgagaaaaacctcaaagagctgccgcagggcgaacccgtcaaaatgctgacctcctgccccgcctgcctgcaaggcttgagccgctacgccgacgacaacaatatgcctgccgactacatcgtcatcgaaatggcgaaatacatcctcggcgaaaactggctggatgagtttgtaaaaaaagccaacaacggcggtgtagagaaagtgttgctgtaacaacggacacggaaatgccgtctgaacgccgaaagccttcagacggcattgtttgaaccaaatatagtggattaacaaaaatcagaacaaggcgacgaagccgcagacagtacaaatagtacggcaaggcgaggcaacgctgtactggtttaaatttaatccactatacctacccaaatcatgattgacagacaaacaaacgaacccaaacaaaaaacccgaatcatccttgcccctatgcagggtctggtcgatgacgtgatgcgcgacctgctgacgcgtattggcggctacgacgaatgcgtcagcgaatttgtacgcattacccataccgtgcattcccgatccatatggttaaaatatgtccccgaaatcgccaacggaaacaaaacgttttccggcacgccntgcaccgtccaacttttgggcagcgatgcggacaatatggcggcgaatgcgctggaagccgtccgcttcggtgcgaacaaaatcgatttgaacttcggctgccccgcgcccaccgtcaacaaacacaaaggcggcgcaatccttttaaaagagccggaactgatattccacatcgtcaaaacgctgcgcggacgtttgcccgcacatattccgctcaccgcaaaaatgcggctcggttacgaagacaaaagccgggctttggaatgcgcctgtgcgattgccgaagggggcgcatgcggactgaccgtacacgcgcgtaccaaagccgagggttacgaaccgccggcgcattgggaatggataaggaaaatccgagacagcgtcaatattcccgttaccgccaacggcgacgttttcagcctgcaagactatatcggcatcaaaacaatcagcggctgcaacagcgtgatgctcggtcgcggcgcggtcatccgccccgatttggcgcggcaaatcaagcaatacgagaacggcgggccggtcaaagacacggattttgccgaagtttccaaatggatacggcagtttttcgagctgtgcctgacaaaagaggcaaacaacaaatatccgctggcgcggctgaaacagtggctgggtatgatgaagaaagaatttgcagcagcacaaaatctgttcgaccgcgtccgaacggttaaggatgcggacgaagttcggaacatcttggctgaatttgagcgagaaatgaatacttgaatatgtatagtggattaacaaaaaccggtacggcgttgcctcgccttagctcaaagagaacgattctctaaggtgctgaagcaccaagtgaatcggttccgtactatttgtactgtctgcggcttcgtcgccgtgtcctgatttttgttaatccactatatccgctccaaagcaaatgccgtctgaaaacctttcagacggcatttgttgtctttattgccgtttttcgtccgtatccggatttttgtttttcagcttcgcacccaagcccaaacgcctttcataatccgattgcggagtatcgtcttcctgcataccgaacgcgccggcattgacccacagcgacagcagcgcgacgacaaaggcgcaaaagccaatcacataccaaaacattgcccctcccgatttgttaaaatcatatcaaatacagtgccgaatttatcacaaacgcacgggcaaatatagtgaattaaatttaaatcaggacaaggcggcgagccgaagacagtacaaatagagacctttgcaaaattccccaaaatcccctaaattcccaccaagacatttaggagcaccttcttccagcaaaccgcccaagccatgattgccaaacacatcgaccgtttcccactattgaagttggaccaggtgattgattggcagccgatcgagcagtacctgaaccgtcaaaaaacccgttacctccgagaccaccgcggtcgtcccgcctgtcccctgttgtccatgttcaaagccgtcctgctcggacaatggcacagcctctccgatcccgaactcgaacacagcctcatcacccgcatcgatttcaacctgttttgccgtttcgacgaactgagcagtatagtggattaacaaaaaccagtacggcgttgcctcgccttgccgtactatttgtactgtctgcggcttcgtcgctttgtcctgatttttgttaatccactatactttatgccgctaccgcaactggctggcgcaagacgacaccctgtccgaattgctcaaactgattaactgccaactgaccgaaaaaggtttaaaaatagagaaagcatccgccgccgtcgttgacgccaccattattcagaccgccggcagcaaacagcgccaggccatagaagttgacgaagaaggacaaatcagcagccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaaggtctgcccaaaggtacgaccgtctatgccgacaaaggctatgacagtkcggaaaaccggcaacatctgaaagaacatcggctgctggacggcattatgcgcaaagcctgccgcaaccgtccgctgacggaaacgcaaaccaaacgcaaccggtatttgtcgaagacccgttatgtggttgaacaaagcttcggtacgctgcaccgtaaattccgctacgctcgggcagcctatttcggactgatttgcgcccgctgccgcctaaaaggcagcccggatgcctgattatcgggtatccggggaggattaagggggtatttgggtaaaattaggaggtatttggggagaaaacagctgaaaacctgtgtttgggtttcggctgtcgggagggaaaggaattttgcaaaggtctcagagtgagtttattttggggcggcggcaggtcgggggcaagcggcgtggggcttggttgtggtttttaggtttttgggggtaaaaaatgccgtctgaacttttcagacggcgtttgttttttctatccaatcgaggaactgccgccatttttccagcggcatatcggcccgacgggtttcggtatcgggttcggcttcccagcggcctacctgtatgtagtgcttcaccccgacgatttgcgccaactcggcctgtgtcagtttgcagcggttgcgaagggtgcggaggttgtaaggcgtgtagccgagttccatgtcgttgcggtttattttgtttcgcatatttttttgactgcccggcggcaggtttcggtaaggatggcggcaaatcgggcttcgtctgccggtttgccgtcgaaaaaaataaaatcgtaaagggtgatgccgttttcggaatggcggtaatgcctgcccgggcattcgccgtctgtctgcctgtggattttggcaatcaggcggggatagcggcaatgggtaatgaaacggcttgcgccgtcttgcccgataatccattcggggtagcggttgaatagtgcggctctgttcattttgttcgtgggataaagcccctcgcggggcttgtggtcaggcaaatttgaatatcagtgccaacacggcggcgatggcggtaaccagcccggtggccgctatcatgggataccagcgggactcttgggctatttttacggattcggcgttgattttgtgcgcgtcggcaatgattttggcgatttcggcatctatttttctcagactggagtgtttcatttcttgttcgattatgttcatcgtacttcctttcgtttttggcggttgccgccgcttgtcggatggtaggatgtctgccatgtgtatatattgataccttttaggttttattgcaagtgttttgggcggcggcttcgtatgcttggcggtggcggcggctgtaccattcggcgagttcgcgccgctcttggaggcggtagctgtcggcggtcaggtagtggtgcaggcttgagaagccggcgcgttggagggcggcgcggctgatgtggccgagggcgaggtctgttgtgagggtgtcttttccggcggtcaggctgatgttggtgaagaggtggcggaatccgtgcattgtgtgtttggatttgccgggggtgctgccgtcatagcccagtcgtcggatggcgttgtgggcgaatttgatgctgatgtggtcgggatggggggcgggtttgcgccgtgggcggatgccggggaaaaggtggatgttgtcgccggtctgtgtgtgcagctctcggagtatttctaccgcccagtccgacagtaggacggtaaaggggtgtttggtcttcatgtcggcggcggggatgtgccataaccgggcggtgaggtcgatgtcttgccagcgggcggaaagcagtgcggacggacgggatgacttccccggtttccccatcaatccgcgccgcctcgatttttccgttggcgcgcagcatttccaccgcctgccgcaccgacatcaaccgcttgccgttgcgcctcatcgcctccaccaaaaccgccgaaatcaatttggcttcttccggtttaagctccgtcttgcccgcatcgctgcgccgtttgcgcgtcggcttgacgctgaccgcctccagcttgcggtatagcgtggcaaggctgatgcccaattcctgcgcctgctgcttaagatatgcagagcgtgcgccgcgttccattgcttccgcctgattctcgactgccttaagacgctcaatcattgccggattcatcgccttctcccgtttcaccgcccaaccattccggcacattgtctgtcggtgcttcagtcggcagggcatagctttcgcgcagttgctcgcagtccaaaataatttgattgagcgtgccgaccatctttgcctgatggctgatcccgtgtgcctcactgtgcgcattaagttggtcgaacaaatctttcagacggctcacttgactgcggataccgacctcaaggcttgttaactgcatcgccaactcgctgcctacgtcttccgccttcggctctctgacaacggtttgcttcttagccagcttctcggccagctcatcaattttggctgttttggttttcatcacttcgtctttggcggcgaggttttcgcggctttcgcgcagggcgacgcgcagctcgcgcaccgtcattcggtccacatcgtcaaaggtcatgccgttgacttcttccccttcggccaaacccaccagcgtaacgtcttcttcgaccagcagctcaagcagcttcgacttgcccaaatccatcagcttcggcgcggctttctgcatttgcggggtcgcaaagcggcgagtggctgacatcagacgtgatgtttctgcgatacccagcccaaattggcttttcacaatttccataaaccgtccgtgttccgtatgctcttttaaaataatcagcgcacgtcccagttcgaacatgccttccatcgtctgccgtactgcttgacgaccgcgttcaacccaacgctcttcgctataagtctcgccgttaccccactgctccatcaccagcacactgcgcatcgctgcctgattgcttactttgtcggttgcgataatttcaatttctgtattcattttttatctccaaagtttccgacgtcggaaactttcaaaatccgttaatccacatcgacccgcttgccgatttcggcaatcttgctttgcagccgttcatgctgctgcctgaaccgctctgcgatttgcagggttttgatgccgtaggcgtagttgccgttttcaagtttgatgaccaatcccgaggcaaccaaatcatcaatatccctgctgacttgcgatggcgtcagccccagtccgaccgataaatccttattgctcagaccgataatcggatgctcgtcaagcgcgataaagaccctcaatagccgttgtacccttttactttctgccatccgcatcctccttatttcagtcccagcttcttggcaatttcgtgccccttgccgtaattgcctttgcgctgtccgccgatcaccagatacacatcgcgcggcttaaagccgttctctcttgcccactgcgccagcgtctggccgtttttggcaaaattttctttcaattcgtctgccgtaagcatttctttggcctgtacgcgggaaaatttcagtatccgtccgtacggttggttaatacactcatgattaatcatcgcttttctccttcatccccagcaaaaccgccgcttcgtggcttttgccaaaattgcctttcagcttgccgcgcaagaggtgctccaccgtggtgcgctccagattgaaatatttcgcccaatgcgccttgcacaccccgttgcgcttaaaccacccggccgcgctctcgcgcgtttgcggataggaaataggcttgaaattcaaaggtttttccatattatttatgcctttcgtgtgatataatgtgtttgtttttaggtctctttgcacgataaacatccggtctgttgtgcagcagcagggtcttggcttgttttaaagtaaacaagctttttctcgtagctgggtgtatgtgatccatcatgagctgtcgcgcatgagccttcaaagtgttcattttttcgtcctttctcgtgatgatttagggtgtttgtgtttcgatgtggaaattataggaagaattcttcctattttgcaaggaatatttatgaataactcttccttttttggcaaccgattgaaagaagaaagaaaaaaattaaaaatgactcaagctgaaatcgctgaaaaatgtggggtttcaggaagaatgtggggggattatgaacgtggcatcagccagccaaaagcggaacttttcttccaatttgaaaaggtgggtatagacgttcaatacgtcatgcacggcagacgcggcgaaacagcggtcatgccgtctgaaaccctgaacgccgaagaacaagaactgctggtcttgttccgcgaggcggcagctgccgaccgtgaaatgattctgatggttgcgcgcagggcagagaaaaaagcccaaactgcgcttggtaaagtgagtaatggataaaatggatcaattcgaattgtgccaaaaagaacatgtcaatccatttgccttgtcaaagcaatatctattggttgtaacattcgtcaaatccagcagtaaaaattttcaggcagcattactttgggcaagaagtgccaaattatttgagaatcttgagattggaaaagaaaccatctattgctgcgctttcgataaaacagcagaacaggctgggatggccggggtatttttgaattatattgaaaattggaatggcaaacagatttacatcaatggccgaatccatagtggcagtatttatgatttgttaggggttttagactgctatcaaaaatcacagtcctgtcccaaccctaaaagccactgttgctttgtttcagacgacatttttctatggcatggatcaagaccaacgtttgaaatcagtcttgatctaactggaaagaaaaaagaaacatcctctgcaaagaaatttgtgatgccttgtattaatttccgtcaccataggattgaaaaagaaacctacttaggaaattggaatgaacaaattgccgcattggcagtaaaacaaaatatagattggtgtccaagttttgatattgagaattttagacagtatgaataattactatctatataggaattgcagcagcgatgtgttatgggtcaaacgtatccaacgccaaatcgacggcagcctactcttgatttctgacaattcaacctatccacccatgcccttggcactggcggaacaccccgatattcaaatcatcgggcaggtagtgcaggtatcaaaagacttgaactagacacaatcaaaaagggaaatagaatgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaaatctattaagtagaaaaaatagaaagggaaatgatgattgagaaaagtatttctattgtagatggaaaggaatactccgtttttgctgtatcacacgagtttcgttatacctttgatgagcctattttagtcgctgacttgattagttctctaaaagcttatgaaacactgacaagtagttatcttccagcaattttgaatcagctgtttgatgtcaaaatccaaaaaatcaaagtagctgtatctgaaattgaaagaggatctttccttgaaaaactgattttcaatttattcttcaaagatgaagatgcttataatgaattttgtcttaaaatacgaaaatttctaggaacagaaaatcaggacggaagtattaatatgtccaaaatcattatgtttgcaatgactacacttttaggggtaggtgctggttatctcttgtttaaaaacccgccacaagagaagcaggcaataaccaacaacatcgttaccgtcattaatgctgatagttctgtcgcactggatggtgaacatttggtttcagtggtaaaagaagtaacaggaagcagcaagcaaaaaactgcagaaaatgtggcaaaagtatatgctccagcaagtaaaaataatggcagtattacccttgggacagatgatgttcggattgaacctgttgcacaacaaactgtagcaactttgcctaaagatgtggacttacgtgatacgccattgactgaagattacaccgatattgatgtgcaaattcgtgctactgaccgtgataaaaattcagggtggtatgcagtcatagaccaaattgttccatcacgtgttcgattagaactgcctgaagatattgatttgaataggctggctaacaatgctactatccgtgcaaatgtaacagttgagtttgacttaaagcaaaatggctctcgtaagcctaaaaaaatcatcctcacatctctctctactgattaagttttaacccgtattaaaggcttagtcagacggcctttcctacaatccctgtattgatttttaattcaatacagggatttttccatgtcagacaagttcaaccaattcatcaaccgcgtcctctctcacgagggtggttacgccaaccatcccaaagaccccggcggcgaaaccaattggggcatcactaagcgcaccgcacaggcaaacggctacaacggctccatgcgtgccatgacgcgtgaacaggcaatcagcatttaccgtaaagcgttttgggagcgttaccgcgccgaccaaatgccggaagcggtcgcgttccaattttttgatgcctgcgtcaaccacggttacggcaatgccgcccgtatgctgcaacgcgccgcaggcgtaccggacgacggcgttatcggagcagtcagcctcaaagccatcaattcccttcccgaaaacgaccttttattgcggttcaacgccgagcgtctggtcttttataccaagctcggtacgttcacctctttcggcaagggctgggtacgccgtgtggcgcaaaacctgattcacgcgtctgcagataacactgattaaagggagataaaccatgtcaaaaaagtcactcatcgccctaatgaccgcagccatgcagcccgatttcagccacagcgacctaggcattcgctacgccatgccgactcagggatgttggacgcaagcccaccgcaagagcggggtagccgccgcgaaacgcgcagccaaaaaaaagcgtcacaaataaccgcctttttccgatggctgggcggcttggtctctaatccggccacaggaaaaatcagccataccaaactatgggcaaacgtcgccgcagccgccatgacttggaagttcgtgcaggcggcggacgcgcccgaatggctctagtgggcttatggcgcattggtcggcgggtatgcattaatcaaacgcggcatcgcggcgattccgcagttggcagaaatcaaaaaatccgcaaatcaggaaggggggcggcaatgattgaatttgtccgagccaaaaaacggctgctttgggcatttgtgcttttgcttgtgtggacgtgcggttaccgatacgccgccgacaaggccgaagcgaaacaaaccgccctgattgccacctatcggcattcttctatggttgcggcggaacaatatgccttgcagcttaaaaaagcgcaggacgaaaggcagcggtggtacgacttttcccaaaaacaaggaagaaagcccgtgaaaaaacagtatccgccgcaaacgaaaaaagccggctatctgaaaaccaaggaagaactgcttgcggaattggcttgccttaaagcggaaatggttgccctaaaaaagcccgatgccttaatccatgggaaagaagtgcggcagaaagaacgcaactcgtcgcagggttaaggcaatgccatccgttgaactgctgttggagattgtccttctattaccaattggccgtccaatcggcagaagacaaatatgccgatttgaaacggcatatccatgatatttatcgacgacataagggaagatacggctaccggaggattgcggcagccatccgtcacgcaggaacaccggtcaatcacaagaaagtcagccgtctgatggcgaagacggggctgaaggcagtgatacggcggcgcaaataccgctcgttcaaaggagaagtcggcaaaattgcgccgaatatcctgcgacgctgtttccatgcagaaaagccgaatgagaaatgggtaacggacgttaccgagttcaatgtaggcggagaaaagatatacctttctccgattatggatttgtttaacggggaaatcgtcagttaccgtattcaaatccgcccgactttcgatttggccggcgagatactgaaaggtgcgccggagaaaccgggatcgtctgaaaagccgatactgcattcggatcaaggttggcaatatcagatgttttttatcaaaagcagttgaaaggcaacggtctggttcagagtatgtcccgcaagggaaactgcttggacaatgcggcaatggaaagtttcttcggaacgttgaaatcggaatgtttccatacgtgcaaatatgattccgttaccgaatcgtaagcggcactgcacgaatatatccgttactacaacaacgatagaatcaagttgaaattaaaaggactgagccctgttcagtacagaactcagtccctgaaagccgcttgattaaactgtccgactttttggggtcagttcggcttcggcatttttttatccgttttgggggtaacttgtttggaaagctgcaagcttataaataaaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatgctgctgaaaatagggtatggtggaggcggggggaatcgaacccccgtccgaaagtcctctacaaagcgttctacatacttagttgtgtctatttgaaaatcttatttccatcatgccgaccaacaggccttttggaaaccagttaccttaagtcttatttcctgccaagtaacccggtaggaaaccagtcaatgtaagatgacgttgcggtggctttcgccacacagcccattgaccgactgctgcaacggctagccttaagcggctaaagcgtaagtttcgtcgtttgcgactatttgaattcagtgttttacgggaatctgagaccccggtatgcccgcatctgcttcgcaaccctcgtcgaaaccaaggtcgcccccagaaatggtttgcaaattatacggatattgtgcggtgctgccaagtctgtcggagaaatttgtcagtcttgctgccttaatttgcgtttgagcaggatgcggacgcagccgtcgttgccttcccggggttcggcgtaggcgagtacgtcggggtgttgcatcagccagtttcgggtcatatttttcagaacgggtttgtagcctttggaacctaatccgctgccgtggatgatttcgccgcatacgccgcgtttttgggtgaatgcgatgaattcgttgaggactttttgggcttcttcctgtgtgtagccgtgcaggtcgacatcggtaacgacgggatagtatccgtttttcaggcgttggatgtcgttttttccctgtccgtttttgctgaagctggcgggcgggtcgttgtatgtgctgccgatgtagaagtagttttcttcgtcggcgcggttgtctttgggacggactttgatgggggttttgtcgggcggcgcataatattgctgccggttttttaatggggagagttgtccgactgcttgtgaaaaatcgaaatcctgttcttgtttttgcttgtttttttcggctgcctgtttttctgccgcttctttttgggcttgtttgcccagttgtttgaggatgttttggaagtcggtattcatattttttcctgttatttgtccgatggctgtttcgggcggggttttaatttgccggaatgtttgccaatcgggggaggatgattttgttgcctgcgtatgttttttgaaagtgtgattgtatatcaaaaagaaatgcggcaaccgtcggcagtgttgattgccggaaatgcggaccggtcgaaccgatatgcccgaacgcctgataaagttttaaaaacctgccttgcgaagcaggctgacgtgttttgccaatcttgaattgccggaaacgcgaaacacggaaatctgatgttttatagtggattaacaaaaatcaggacaaggcgacgaagccgcagacagtacagatagtacggaaccgattcacttggtgcttcagcaccttagagaatcgttctctttgagctaaggcgagaacgctgtactggtttttgttaatccactataaatgttccgatacgaactgcaaaatattggttttgtttctgacaggcaaaagcactgtttatttggctgtcaaaaggatggttaaggaaagttatgcgcccctgaagcgggccccagataaggatggttgcgccgacggcttcagacggcattttggcggcggtgttgggttttgtatccggtttgccgttgtgttttgtgatgatgattttgggcgcggtttttctgttttgatgtgtgaaatgccgtctgaaaggcggttcagacggcatagcggtcatttttgtgcggtcaggcggtcgaatatgccgccgtcggcgaagtaggttttcatgatgttgtcccatccgccgaattttttttcgggagagaaggtgtctaagtctgggaagtcggctttgtgtcttgccaatacttcggggttgcgggggcgcaggtagagtgaggcggcgagttcttgcgccggttcgctccaaaggtattcgagataggcgcgggcggttttttgcgtgccttttttcgcgacgacgctgttgacgacggcgacggggctttcggcggaaatggtgtagctcggatagacgatttcaaactgtccttgggtcagttttttgctgacgtagttggcttcgttttcaaaagtgatgagtacgtcgccgatgttgcgttgtgtgaaggtggtggtggcggcgcgtccgccgttttcaaaaacgggggtgtttttgaggatggatgcgacgagtttttgggcttcctgttcgttgccgttggtggttttcagaccgtaaccgtatgcgccgaggaaggcgtagcgtccgttgcccgaggttttgggattggcgatgacgatgttaacgccgtctttggcaaggtcgttccaatcgcggatctgtttggggttgttttttcggacaaggaaaaccatagtgctggtgtagggcgcggcgtggtcggggagggcttgttgccagcctttttctaccagtccttttttttcgagcaggtcgatgtcggaggattggttcatggttacgacatcggcttgaaggccgttggctacggataatgcctgtttgctggagccgccgtgggactgttggatgctgacggatgtgccggggtgttcggattggtatgttttgataaataaggggttgtattctttgtaaaaatcccgtgccacatcgtatgaggcgttgagcagggtaatgttttttccgtcggattcggtattggccggggcattttgtccggacggatggtttgaatcggctgcggggctgcaggcggtgagcagggctgcggtatagagtgccggtgcgtaggttttcatatgcttgtcctgtcggttggtagatggggcaactttatacggctgtctgcgcttgtggaaataatgtttgatttgaagattatcagttttggttataaggacggatcagaggtgtttccgcatcagttcgcatttgattttgatgctggggtcaagctgcaatactgccgaaccgagcgattcgtagcggttgagaaggtaaaacgggacggagttgagcgatgcgtagagtttcagaaagctcaaaccggatttgtgggcgatggtttccgcctgatgaagtagggcagtgcccagtccgaggttgtggaacagggggtggacgtaaagtgcatcgagttgtgcttcttggcagtcgatttggaaaaatccctgtatgttgcctttgtattcggcaacccaaagtgctttgtcgggatcggaaatggtcggcaggtagctttctgtgtttagcaagccttcccatacttttagggcgtgttcgttgtagctgaggatgcaggtgtattggacggagtgcaggtggactttgaagatgtctttgcagtcttgcacggtggcggggcgtaacagtgtcagcaggctcatggcggtatgtcggcggcttcagacggcatctgtgccgttggtcggattatagggactgatgcagtttttttgcttcttgaaatgcggtgtccgaatcggtggttaaaacggtaaagtgtcccattttccgccctttgtgcgcggtttttttgccgtaaaggtgcaggtgtgcattcggatggctttgcaagggcagccaatccggttcgccgccgtcttcctgccaaacgtcgcccaaaatatttgccatacagcaagaactcagtaatttggtatcggcaggcggcaggttgcacataatgcgtacctgctgctggaactggtctgctgcgcaggcatctatcgtatggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaattgtccgccgccgaggatgccaagcatggcgggcggagaaagagatatgtttttcatgctgactcttcaaattgtacaagttgatagctataactaattcttgacggatgtcttgtatcgctggaattaccagtttcagaaatacagaatactttttccataaatttttctgcttttagaaattccagtattctgtttttttcatccttataagcaccgcggtctgtaccccatgcaagaataatcatatcagcatcttccaaacatcctttaaatttggaaaaatcggtttgggtgtttgccctaattcctgtttgctgtgtagagtaactggaaaaaatatttaacattttgaagttggtaaaaccgtacatatccaagaaacgtgcaagttgggtaagggttttgtcgcttctttcatcatttgctttacttggattaattcctatagcgacagctgagaaatttttaggattttctgtgttgccgctccatctaaccgttaggatttctcgatttttttcattatctgtatagagaccgtctttggtagtcggtctgagtgtttggcgaagctcataaagtttttcataagtcatttatccaacccttcctgtaccatttgcgcggcgtgtatgacggctcgggctttgttttgtgtttcctgccattcggaggccggatcggagtcggcaaccacgcccgcgccgctttggacgtatagcgtgttgttttttactacggcggtgcggatggcgattgccaaatccatgtcgttgttgaaaccccatacgccgacggcaccgccgtagatgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtagtaaaagagataaggcgaagggttgagcgtacgcagggcgcggtagagggcgagcgggctgtcggtgaattccatgctcatgcgctggctggggacaacctgcatgcagtcgcctgcgaagatgtagtctttgattttgttaacgcaggctttgaacggctcttcgccgaattcgctgacggcttcggtgtgtttgctgccgagcgagagcgggatggcgcagctttggcgcaactgggtgcggatgtcttcgaggcgttcgcgggcgcgttcgtagccgtcgggctgcgacggatcggcgtaaacgacgagatggattttgccgctcaaattgtcgatcaccgccaattcttgcgacagcatcagcaagatgtcgggcgtgccgagcgggtcggctttggtggtgtttttcaggcggtgggcgaagtgttcaaaattgtagatggtttcgtaaccgaagtagccgaccagtccgccggtaaagcgcggcaggcttgggatttcgggtgttttgaagcggttgtggaaggcttcgataaagggcagggggttgccgtcgtgttgctcgacaatttcgccgttttgataaacatcgacgtgtttgccgctggctttgagatagtggctgcaaggcaggccgataaaagaatagcggccgaaacgttcgccaccgacaacggattcgagcaggtaggtataggggcggttggcgagtttgagatagagggaaagcggcgtatccaaatcggcaaggagttcttgcacgagcgggatgcggttgtagccttgggcggcttgggcttggtattcttgtttgctgatcatttctgctttcccaaagggcggtttcggacggcgcggcaacgggcgcgagtatagcattttatcggaattgttgacagtctgaccggagatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacgccaaacgggcttcagacggcatttttgacggcggaggtctatgagccgcaggttttcggcttgttcgccagaatattgatgactttgcgttcggctttttgcggctcgattttgatttcgctctcgtcttcttcgctgccgtctgaaaaacgttcgggcattttttcgctgtcaaacgccaaatcgccgccgtgtttcaggctttgaccgcgttccaatccgacaaagtcgaagagttcggtatcggcaaggtgggaagggacgacgttttgcagggcggagaacatcgattcgatgcggccggggaagcgtttgtcccaatcgcgcagcatatcgccgatgacttggcgttgcaggttgggttgcgagccgcagaggttgcacgggatgatggggaattgttttaattcggcgtatttgattaagtctttttctttcacatacgccagcgggcggatgacgatgtgttcgccgttgtcgctcaccagcttgggcggcatggctttgagtttgccgccgtaaaacatatttaaaaacaaggtggcgaggatgtcgtcgcggtggtgtcccaaggcgattttggtgcagcccaattcttttgcagtgcggtagaggatgccgcggcgcaggcggctgcacagcgaacaagtcgttttgccttcgtctaatacgcgtttgacggtggagtaggtgtcttcttcaacgattttgtagggaacgccgatgctttcgagataggtcggcaatacttcttcggggaagcccggctgcttttggtcgagattgacggcaaccagttggaaatcaatcggcgcgctggcttggagctggcgcaggatgtctaacagggcatagctgtctttgccgccggagaggcagaccatgattttgtcgtccggctcgatcatattgaaatcgttaatcgcgtcgccgacggcgtggcgcaggcgtttgctgagtttgttgttttcgagttcttgtttggtttttttggacatggcggtttgggtttgaaaattagaaaggcggcattgtaaccgattggcggggcggcaatgccgtctgaagggcttcagacggcatcggcggcttattctgcattttcggttttaaagaagagatgaaccgctttgaagataccgccgtttgggacggtcagtgttttttgtgcggcggagaatttaatcacggtaagggcggtaaagttttccgaatcttgaacgctgtcgagtacgatgccggcctcttcgccgtccgccgtcagcagggttcctgcttcgacggccgaatttcccgacaataccgccaagccgcgtttgacctgcccccgatactgggcacgggcaatgatttcctgtcccggatagcagccttttttgaagtgtacgccgccgatgatgtgctggttgagcatttgggcgacggcggtttctttggtagccgcgcatatccacggataaccgctacggatttcgtgcagccgccacgcgttttcggcggcggcatcataaggcggcaaggcgtttttgggggcgatgtgcaaaatgccccgatgtggcaggacgacggaacagatgccgtctgaaccgcattcggcggtaaaggcgaggctgggttcttgcgcggcaagcggttcggcggatgcttctaattccgcgccgacggcgtaatcttcaaggatttcaaaaacggctttggcgcgtaacacaaacatccgcaaacgtttgaccgttgcttcaagcaggtcttgcgccataatcagcagcaaatcgccgcctcggttgacgacaatcatattggcgatgacgcggcctttgggcgtgttgtaagtcgcataacacgcctgcccggtctgaaggtggttgatgtcgttggaaagctgtccgtgcaggaaggtttggcggtcttcgccgctgacgcgcaccacgccgaaaaagggcagtaaggttttcatcatttgcgtactctgaaatataaaggaaatctgtttatgcagttgccgcgtctctcttcacggcggttattttgatttcgacgcgccactccggacgggcgagccgtgcttccacgcaggcgcgggcgggcgttctgccggcggcaacccaagcgtcccacacgccgttcatttccgcatagtcgcccatatcgcgcagatagatgaccgcatccaaaacgtgcgctttgtccgagccgcattccgccagccagcggtcgatttgggcaagcacgtcggcagtctgttcggcagccgtttcaccgttttcgggaaccatgccggagaggaaaatcaagccgtttgcgccgacggcttcggaatagcggggcgttgtgccgaaatatcggatatccatatcggtttccttcgataaaggggatatatggtaacattgcgcttgaccgatttccatgttttgcatgacgaaaaatgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttgacgggaaagtataaaggaacaatatggacaaagatttgtatgccgtattgggcgtgtcgccgcaggcgggagcggacgaaatcaaacgcgcctaccgcaagctggcgatgaaatatcatcccgaccgcaatccgggcaatccgaaggcggaagaaaagttcaaagaaatccaacgggcttacgatacgctttccgacctgtcgaaacggatgcaatacgacgcgtccttcagacggcatgaggaacgcgggcggcaggaagaggcattccgccgcgaacaggcgcgcagggagcagttttaccgcgaacagatgcgccgcgaacaggcgttcagacaggcgtttgaacggcaggcatcacgttcgtgccatacttacgaaccgtccggcggcggaagcgggcgcaactatgtcctcgccgcctacatcctgttcggtttgggtgcaatcatgctgttcatgcccatagtcggcgtgattttcgcctatatgcccatagtcggcgtgattctcgcctatatgaaacggaacagtttggacagcattgtctatgccgcacataccgaatacctgattaaaaccttttggcgcacattttggctttatattttgggtgcgctgactgcccttttgggtatcggcgtgctgattattattgcaacgaacgtctggtatttctaccgcatcatcgccggctttatccgcttcaacggcggcagggcggttgcacccgagaaatggatatagtatggcttacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgctggtattgaagccggatatcggcaatatcggcgcatttttgccgacgtggccgctgtttgccgctttgggcgtgctgctgccgtccgtattcgtgataatgggcaaatctgtggaagccgccggtatcgtcaaatccgacgcggcgcagcgtttgtcgctgtttttgccgattgttgccgccttgacgctgtttggcgaaaaactcagcgaaggcaaactaatcgggctgtgcctcgcatttgccgcactgttctgcctgctttggaaacacagcggtggcaaaaaatcaggaagcgcgtggcggcaggcggcattgctgctgggcgtgtgggcaggttacggcattatcgatatcctgttcaaacagcttgccaaaagcggaacggcatttgcgggcaacctgctggttgcatttgtgctggcgggtgtgctgatgtttgcctgcctgtttgccaaatcggtcagatggcgtgttgagagtgtggtcggcggcatattcttgggcggtttgaattttatgaatatcgtaacctacatcaccgcgcaccaaatgatgaaggataatccgaccttggtttttgccggtatgaatatcggcgtgattgttttgggtacgctttcgggcgcattgttctttaaggaaaaaatcaacacaatcaatacggcgggaatcgtgttggcactgtgttctatcgcctgcctgttttattggggggaagtcaaggtactgttcggcatataatccggctgattgatataacaaaatgccgtctgaagcagcatccctgcttcagacggcatttgtctgcaacgttacagatgggggttcatcaggttctcgggagagaggatgcggttgagttcttcttcgctcaacagcccgcgttccaagacaacctcgcgcacgcctttgccggtttgggcgcagattttgccgaccaaatcgccgttgtggtgtccgatatacggattcagataagtcaccaaaccgatggagttgaaaacgtaacgttcgcagatttcgcggttgaccgtaatgcctttgacgcatttgtcggacaggttgactgcggcattgcccaagagggaaatggtttcaaacatacattgggcgatgaccggctccatcacgtttaattgcagttgcccggcttcggcggcgaaggtaatcgtcgtgtcgttgccgatgactttgaagcagacttggttgaccacttcgggaatcacgggattgactttggcgggcattatggaagaaccggcctgcaattcgggcaggttgatttctttcaagccggcacgcgggccggaagagagcaggcgcaagtcgttgcagattttggagagtttgaccgccgtgcgcttcaatgcgccgtgtaccatcacatatgcgccgcagtcggaggtcgcctcaatcaggttttcggtcagtttgcaaggcaagccgctgacttcggagagttttttgaccaccagttcggcgtagcctttgggcgtgttcacgcccgtgccgattgccgttgcgcccaaattgacttccaacagcagttggcgggtgcggtcgaggttgaggatttcttcttccaacaacacttggaaagattggaattcttggccggcagtcatcggcacggcatcttgaagctgggtgcggcccattttcaaaacgtctttaaattcttcggctttggcggcaaaggcgtttttcaggacagtcagtttgtcgagcaattcgccgatgctgtaatacacggcaaggcggaagcccgtgggataggcatcgttggtcgattggctggcattgacgtgatccatcggattgacgatgtcgtagcggcctttttcgtatcccaagacttccaatgcgaggttggcgatgacttcgttggtgttcatattgaccgaagtacccgcaccgccctgatacacgtcggacgggaattggtcgaggcagcggttgttcagcagaacttcgtcgcaggctttttcaatggcggcggcgatttcgggcttgaccgcgcccaactcaccgtttgcctgtgccgtcgcctttttcaccatcaccatactgcggacaaactgcggcacgtcagaaattttttgtgtggagattttaaagttttcaatggcgcgcagggtgtggatgccccaatacacttcggcgggaatctcgcggtcgcccaataaatcgtgttcgatacggacagtcatgtttttacctttgtaagtcggataattaatattgaaaaaatgcgccatcggaaagatgccgccgcaggatgaacactataccggccggatgaaattgtccatatcgtatgccgtctgaaaacgggaaacgttgttttcgggtgttatagtggattaacaaaaatcaggacaaggcgacgaagccgcagacagtacaaatagtacggaaccgattcacttggtgcttcagcaccttagagaatcgttctctttgagctaaggcgagccaacgccgtactggtttttgttaatccactatactttccggactttccggcaagccctgcctgccgctgaaatatctttcggcggattgtgctccgccatatcggcttaccgttggcggggcggtttgatgaagacggcacaaatgccgtttgaaggacgttcagacggcatttgtgctgattcgcatcaagatttattgtttggctgcctcgatttggatgtcgatgcggacgcttttggtcataccaacgttaacgaggtagtccatgccccatttggtgcggtcgatggtggtgctgaagtcgccgccacaaacttcggttttctccatcgggctttggtagcagttgaatttttcggctttgagtttgacgggggcggttttgccgtgcatggtcaggttgccgtcaacggaaaccagttttttgccgttgaagttgaatttggtggaaacaaagcggatgtccggatattgggcggcatcgaagatgtcggctgatttcaggtggtcggtaaagtgttgcgaaccgctttgcaggttggcaatggggatggtgatgtcgattttaccgtcgcgttttgcttggtcgaactcgacggaaccggtcagaccgtaaaaaccgccgacgttggtgctggtgttgaaatggtcgatggcgaaacgggcgttggcgtgatattcgtccactttgtaggtggcggcggaggcagtactgatggcggcggctgcgagtgcggcgaagatgatttttttcatgatgataatcctttgtgtgggccggtaaaggcgtttatcctaacataggcagggatttatggcatttcctgccggtaaacggtgggtttgcaggcggttgacgaacggggcgggcggaaaagggcggatgaaaaagcgcggtgtgatccgcgctttgtttttttacaaggcggcgagtaccgcatcgcccatttcggagcaggaaacgagttttgtgccttcttcgtaaatgtcgctggtacgcaagccttgttgcagcactttttggacggcgttttcaacttgttgcgcgcgcgcttcgtcgttcaggctgtaacgcagcaacattgcgagcgagaggatggtggccagcgggttggctttgttttgtccggcgatgtcgggggcggagccgtgagacggttcgtacaggcctttgccgttttcgtccagcgaggcggaaggcagcataccgatggagccggtcagcatggaggcttcgtcggagagaatgtcgccgaagatgttgccggtggcaatgacgtcgaattgtttgggcgcacgcacgagctgcatggcggcgttgtcgacgtacatatgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggcttcagcgtggaggcgttggctaattcgggatataaaacagcaggacgcaaattggcaaacaggttcaaatccttacggattgccaacaggccgcgctcagggcgcaacggacggtcgaggttgtcgtattgaggagaaccgactgcaccaagcaggacggcatcggctttgcggcagaggttttgcgtaaattcgggataaggatgaccgtattcgtcataggcttcgccgcccaatggggcgtattcgtagccggcatccaaaccttgggcgatgagtttgtcgagtacgcggacggtttcggcgacgatttcgggaccgatgccgtcacctcggaggatggcgatatgtttggtcatttcaagtttccttatgggttgatggttgaagggttatttctttttgtatttgtgtgcaatttcgtgccaacgaggtatggaaatcgatcggttgtagtgttttttataggcttcctcaaatttctttttccataaggatgcgttatgccgtgttgccgggttttgataaacggtttcttcaattgcggaaacaaaatcttccaagcattcaaacataggcatattctttttatttatgctgtaccaaacacccgggcggattttatgcaccacgccttttttgacttgaagattaattgcccacccatccatgcttctcgtaatttgccatacttttttaagccataaatccttgatggttacattgccgttgtcgtccatatcgtaaccgaatattaaatagtctacatccagcatatagggtttatgaatgatttcatcagaatacattttaaaatctgcaatatcaaaacccggactggcatttcggttgaacgcctttacttccaacaattctctactgcggtcttttttatttaaaaagaaatcggggggcatttgggtattggttgaaacatcaaattcaatttccctttttctcaaccatccgccgagccattcctgaatgatgttgccgacgacatctttttgtttgacgataatatccacatcgcccaagaaaaatctaatttgaccattgaccgataagattttttcctcattcagcaacttatcaaatatttgttgtgcagtaagttttaccattttatccctatcggtttataaagtatgcagaagcctttcagataccgccttaatcacaggaacggcaacggtattgcccaataaatcgtatttgtcttttttaggaatatcaaacgaataatcgtccggatagccgaataagcgtaaaccttcttttccggtaagtgtgcgcaaaccgccgttgtcaacgacgaaaaggtgctccatatccattgcaactaaggttggcgcaacatcatttgggtctaatattttattgatttcaaatgatttttttcctgaaacaatattgtagcctttgggcagggattcatctttgattcttcgcccgccaattttttgtttcggatgctccaaaaccaaatagcctttatctgtcaggctgtccaaaatattttgaagattggggtgtttatagaaagttgaaatttgcgcttttgtcaaaggcatcccatccatccaatcgatgccgatttctgaagcccattttttcttcctccgttcttttagaagcatatttaataattgcttctcttcttcggttactgtgccttttaattcaatatcccaactgtggatattgtttttccctccccgtttgtcctttactgattttccgtacagttcggacgggggaaatttctttagcaattttttgatgaaaggactgctttcggtaggcagtcccgattccaaaatattttttaatttcggacttagggttgtttcaaaagataagtcgggtttggatttcaaactgcctgtcagataaatacgcttcctgttttggggaatgccgaaatcttttgcatttaaaactttccaagaaacatagtagcccaatgtttccaaggtttccaaaataacggtcagggtgcgtcctattttttgtgtcggatcttttctatcgtgcgtcaccaatccttccacattttccaaaataaaaccttttggtttttttgcctttaaaatccttgccacatcaaagaaaagcgttccccgcgtatcttcaaagcccaatctttttccggcgaaagaaaaagcctggcaagggaagcctgccaacaagatgtcaaaatcgggaatatctcccgtttcaattttcgttatatctccatacggcacttcatcagggtagttttgcttcaatacttccaaagctgccggtttgatttctgaggtaaaaacacattcgcaagcaaccgactgtttccgacaggcttgttcaaatcctttcctgataccgctcatcccggaaaataagtcaataaatttaatttgttgcatattaaaaatctaaaaatttatttgaaatggagagttgcattattgcattaatttagagtgtcgctaagcccgcttaaaagatgaaagcaatttatcgcccctctgtttacattagccgcaacaattatatgttatcaggaatgccgtctgaacggccttcagacggtataggttttaaccgttaaacagccaaggctggctttggcggcgtttttcttcaaaggcgtgaatttcgtcggcgtgttgcagggtcagaccgatttcgtccaagccgtttaagaggcagtgtttgcggtgttcggtaatgtcaaatgtgaacgtttcgccgcttggtgtggtcagggtttgttcggcaaggtcgatggagagctgatagccttcgttggcttcaacttctttgaaaagtcggtcaacccgttcttcggtcaacacgataggtaaaaggccgtttttgtagcagttgttaaagaagatgtcggcgaagctgggggcgatgacggcgcggaagccgtagtcgtccaatgcccaaggggcgtgttcgcgtgaagagccgcaaccgaagtttttacgcgtcaacaggatttgcgcgccttggtaacgcggctggttcagcgagaaatcagggttcaacgggcgtttgctgttgtccatgcctggttcgccgtggtcgaggtaacgccattcgtcaaaggcattggggccgaagccgctgcgtttgatggattttaaaaattgtttggggatgatggcgtcggtatcgacgttgctgcggtcgagcggggcgacgatggcggtaattttggtaaaggctttcatgggtttgcgtcttgtgctgacgatgccgtctgaagcggtttcagacggcatcgcgaatcggttattcggtggcgttttcgatttttccgccgagatgggaaatgccgcgtccgacggcattgccgccttttttgacggcttctttggttttgtcccagcctttttcgacggcgttgcctgtttgttcggcggcgcgttcggcggcggcctgtgttttgtcaaggttgcgggcggtgtcttgtttcgcgccctcccaagtgccggcgcaggcggacaaggcgagggcggacagggcggtaatgaaaagtttgttcatggttaaactccttggtttgaatattaaaggtgtttctgccttacgggacatatttcagacggccgcgtcaaattcttaaagaccgcctgaaaatacttacgccatcatgcggatgtcggtaaagcggccggtaacggcggcggctgctgccatagcggggctgacgaggtgggtacgtccgccgttgccttgacggccttcaaagttacggttggaggtggaggcgcagcgttgccccggggtcaggcggtcggcgttcatggcgagacacatcgaacagcccggttcgcgccattcaaaaccggcttcgatgaaaattttgtccaagccttctttttcggcttgttctttaaccaaaccggagccggggacgattaacacgcgctgtacgttggcggcttttttgcggtctttggcgatggcggcggcttcgcgcaagtcttcgatgcggctgttggtgcaagagccgatgaatacgatgtcgacggggatttcgtttaatggcgtaccggcttccaagcccatgtattcaagggcgcgttccataccgctgcgtttgaccggatcggtttcttcggcaggattcggcactttgctgctgatgtctaaaaccatttcaggcgaggtaccccaagtgacttgcggttcgatgtcttcggcgttgaaacggtattctttgtcgaataccgcaccttcgtcagacaccagcgtacgccagtactcgacggctttgtcccacgcttcgccttcgggtgcgaagggtttatcttttacgtagtcgatggtggtttggtcgacggcaaccatgcctgagcgcgcgcctgcctcaatcgccatattgcataaagtcatgcggctttccatagaaaggctgcggatggcttcgccgccaaactcgatggcgtagcctgtaccgcctgccgtgccgatttgcccgatgatgtagagcgccacgtctttggcggtaacgcccgcttttaatttgccgtcaacggaaatcagcatggatttggattttttcgcggtaatacattgggtcgccatggtgtgctcgacttcggaagtgccgatgccgtgcgccagtgcgccgaatgcgccgtgggtggaagtgtgcgagtcgccgcagacgacggtcataccgggcagggtcgcgccttgttcggggcccataacgtgtacgatgccctgacctttgtccataaacggaaaataggcgagtgcgccaaactctttaatgtttttgtccaaagtatcgacttgcagcttggaaatcgggtcttggatgcctttgtcccaatcgccggtcggggtgttgtggtcggcggtggagacgacgctgtcgatgcgccacagcttgcgccccgccattttcaagccttcaaatgcctgagggctggtaacttcgtgcaccaaatggcggtcgatgtagagcaggacggtgccgtcttcttcttcgcggacgacgtggctgttccaaagtttgtcgtasagggtttgtgctgtcatgatgttgttcttttggataaatggtaatgcggattgggcggattttagacgtattctttataccgcgcaacagattttgtctaatttttgagtcggtgttattttgtaaacaattttaacaaaaaaattagacatattgtccatttcagtaagcagttatatctaaagcatgattcgatacgaaagaatacttgtcgtcattctttcaaaggcattatcatctgcatcttgtcaaaaaacacacagaggtagacgaaagatgaaattaccggtgatgtcgcccgaacattcggcgcaacttcaggcgtttgaggcaaaaatcctgtccaatcacgccaaaatcgaggcgtggttccgcacgcagtggagcgtacaccgcccgccgttttacggttcggtcgatatacgcaatgccggttacaaaatttcgtctatcgatatgaatttgttccccggcggcttcaataatctgaatcccaactttatcccgctggcggcggttgccgcgcaagatgcggtgcaacgcgcctgcgaaacggcgaaatccgtattgattattcctgaaaaccacacgcgcaatacgttttacctgcaaaacgtttacgccctcggcgagattttgcgttcggcagggtatgaagtgcgcttgggcagcctgaatccggaagtaaccgaaccgaccgaatttgaaaccgcattgggcgacaaaatcctgttggaacctttattgcgtacccgcgatcgcgtccatcttgcagacggcttttcgccttgcgtggttttgttgaacaacgatttgtccgccggcattcccgacatcctcaaaggcatcagccaaaccgttttgccgccgttgcacggcggttggacgacgcgccgcaaaacaaatcatttcggcgcgtacaaccaagttaccgccgaatttgccaagttaatcggcatcgacgaatggcaaattaacccttattttgaaaaaatcggcggtttggacttccaagggcgtgaaggcgaagacgcgttggcggaagcggtagaacgtgtgctggcgaaaattcaagccaaatacgacgaatcgggcattaccgacaaacctttcgtcatcgtcaaagccgatgccggcacttacggcatgggcgtgatgagcgtcaaatccgccgacgaagtgcgcggattgaaccgtaaaaaccgcaataaaatggcgaaagtcaaagaaggcttggaagtcagcgaagtgattgtccaagaagggatttatacttatgaaaccttaaacggcgcggtgtgcgaacccgtcgtgtatatgatggaccgcttcgtcatcggcggctttttccgcgtacacgaagggcgcggtgcggacgaaaacctaaacgccggcggtatggtgtttgttccgctgtctaacagcattcctaccggtaacggcgataattcccaagaagcgcccgaagcctgcaagcgcgtattcgaacaatgggactcgctgggtatgccgcgctctgaaaaagactgcgacgtggacaacgaacacaaccgcctctacgtttacggcgtaatggcacgcctgtcgcttctggcggcttcaatcgagttggaagaaacggcgtaagactgttttgaaatacagatgccgtctgaagcggaaatccggttcagacggcatttcggatatttggcgtgtgggaacatctgtttcagacggcatctcagactatttaaaaaagggaaaacatgagcatcaagcaatggccggaaggcgaaagacccagggaaaagctgttggaacgcggggcggcggcgttgagtgatgccgaacttttggcaatcctgctgcgcgtcggcacgcgcggaatgagtgcggtcgatttggcgcgttatttgctgcaggagttcggcagtttggggaggctgatgagcgcggaggtcggcaaactgtcggcatacaaagggatggggacggcaagtttcacacagtttgccgtggtcagggaaatcgggcggcggatattggcggaagaattgcaggagagcatcgtcctgtccgatccggatacggtggccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattattgcgcacaaccatccgggcggctcgcccgaaccttcgcaggaagacatcatgttcacaaggcggctggcacaggcaatgtcgctggtcgatgtgtcgctgctcgaccattttatcgttacctcgcaaagcgtctgttcgttcagacagctcgggttgatgccctgacactctgttttacatgcggcggctctgataaaatagccgcttcaaccgtattcaacagatattgttaagttaatggaaacacaaaacaaacctaccgttaccgacattgaccgccctatactcgtcccgcccggtggacataaaaaagtcttgctgcattcctgctgcgccccgtgcagcggcgaagtgatggaagccatgctggccagcggcatcgactacaccatttatttttacaatcccaatatccatccgcacaaagagtatatgctccgaaaagaggaaaacgtgcgctttgcggaaaagttcggcattcctttcatcgataaagacgacgactacgaaaacgaccgcaaagaatggtttgccaaagccaaaggcatggagtttgagccggaacgcggcatccgctgcaccatgtgtttcgatatgcgttttgaaaaggcggcgcaatacgcgcatgaacacgggttccccgtctttaccagttcgctgggcatttcacgctggaaaaatatggcgcaaatcaacgactgcggacaccgcgccgccgcgccttacgatgatgtggtgtattgggatttcaactggcgcaaaggcggcggcagcgcgcgcatgattgaaatcagcaaacgtgaaaacttctaccagcaggaatattgcggttgtgcctattccctgagggattccaatgcccaccgcaaatcacagggcagaatccccatcaaactcggcgtgctgtattacggcgacgaatcgacacaatacgaacctgcccccatccgggtggacaaataaacacccgatgccgtctgaaggttcagacggcatcgggttcggcatcggcacggggaaaggtttgccggtttrgcaatctgcaatcggaaaccgcattggcaagtttgccgttttgataaaacaccccgttgccgcgtcgggaggacggcattatgaaatccctttttattcggctgctcctgttgggttcggcggcaggcgttttctaccatacccaaaaccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcagcggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgctttttccgctcaagcctttggaatacggcacgctttatacggcggtattcgactatgtccgcaacggacggcgagcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacgaggcgggcggcatcgtcttcagcgttgacggaatggcgggcagccgcatcacgcttgcaccggaaggagaaacggaacgaggcgtaaccctttatttacaggattgaatacatgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactgaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagcctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatgaaaaaaacctgtttccactgcggtctggatgttcccgaacacctccacctgactgtccgttacgaaaacgaagaccgcgaaacctgctgcgccggctgtcaggcggtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaagcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggtggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgaccgaccccttgaaagacagcgcggcggaggcggtgcggcagttggcaggcaaaaacctgaccctgcacatcctcagcggcgaccgcgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatgacggacggcgttgctttagacgtatagttgatgaaaacaaaaataagacgatgaagaattgcaaacttaaagtatgtattgttaccgctcaaacacgttggcgttcaaaatttgagatcgaattgctaggtatttgattttattaaataagagattgtattaatgaggaaaaaaattaaaaagtggatttatgcgataaatggaataatgatgtcaatatggattattttttttccaaataccggttctgtgtatgacggtggcagaacaaccattttcaatgaaaaccatccttttcattttattttctgcataacatttcttattgggacaatttttcttatatatcatgaatataatgataactaatttttaacatccttattgttatatcatgatgaaatgacaataaggatggttttctgctttggctactgcagaacaccgtcgtcagtctcgcgtaggggggaatccatatgcttggtttttcttttattttcaaatgctaattaacggataggtctggattcccgcctgcgcgtgaatgacggaaatgtgcatttctaatttttacccactatatagtgaattaaatttaaaccggtacagtgttggctcgccttgccgtactatttgtactgtctgcggttcgccgccttgtcctgatttaaatttaattcactataaaaaccccgaatcctgattggcaggattcggggtttttgattgctggtgccgttcagacgggattttcaaacagcttattgatctacaaacgcacgctcaatcaggtaatcgccgcgtacgcctgttttcggagagacggtcagtccgaaatcgtccaaaactttgcaggtatctttcagcatcgcggggctgccgcacagcatggcgcggtcgtcttgcgggttgattttgggcaggccgatgtcttcaaacagtttgccgctcaccatcaggtcggttaggcgaccgtggtgttcgaattcttcgcgcgaaacaatcgggtagtaaatcagtttttctttaaccaagtcaccgaggtattcgtgttcgggcaattctttggtaaagcggtcgtagtacgccaaatcttttttgtagcgcacgccgtgtacgaggatgattttttcaaattgctcgtaaatttcggggtctttggtgatgctcaagaaaggagcgatgccggtaccggtgctcaacaagtaaaggtgtttgcccggattcaggtcgccggcaaccagggttccggtcggttttttgctgattaacacgtcgtcgccgactttgaggtgttgcaggcggctggtcagcgggccgtcttggactttaatgctgaaaaattcgaggtgttcttcccagttggcggaggcgacgctgtatgcacgcatcagcggcttgccgtccaccatcaatccgaccataacgaactgtccgttttcaaagcgcaacgattcgtcgcgggtgcaggtaaaggtaaaatatgcgtctgtccagtggtgtacggacaatactttttgggtattgaatgctgccatttgggtttcctgtcagtaaaagaaatggatagtgcttgttcgggaggtgcggcagagtggaaatgtctgcccgattcgggataaagccaaaattctaaacgaaacggatggttgcgacaatgcttgatgcgcgttggttatatgccgtctgaagggcttcagacggcatcgcggggcaggcggcggcttacggcggcatatcggcaagggaaatcagggaaatcgaggctgccagcctgagtgcgtcccgtccccagcgggggtgttccagcctgcgtatcgggaggatcggtttgacggtggcggcaatcagcttttgtatttcggcaggctgatctgacaatacgccgccccatttttccgcagccgcttccagcagtccgccgtttttcaatatcagcgcggtcgaatggatgtagcagagccaatcgcgggcttggcattgcgctatggtcaggacttcggaagggtcgtcttcaaaatccaaaaagctgatgttttttccgtccgacatcatatttcgcgcaaacgcctgactgaggaactgccgttttttatgcacgcgtgcaatggcttccaaaccggcaagccaagcgtccgactttccagcctcggcttcttggcggatttgcgcatcgagcgggatgccttccaaattgccgaacataagggcatttttcctgacggcgagcaattcgggaacggctatccccgccgagcgcaattcgtacaggcgttttgattcggttgcaatggcaggctcgccgccgaggctgggaaccggcttcaacacccccagtttcaaatatcgggcaaccataccgagcagcgcgtaacgccatcgtgcattgtgcctgcctgctttgcgtatccataccttggttccgtcggcaagcaggtggggggcgatggctgcctcctgttttgccgccaattcgtctagcagtatggaaaaacgggtttcctgcataggtaaggtcattttctttcaatcttaagttcggacggaatgcccctgtacggaatatcaggcaagggtttgttcgatgatgccttttaccgcatccgcactgttcggcacggtttgcacgcgctgcggcaggttttccaaaccttccagcgcggcagggcgcggaatggcggcatcgccgacggcttcgcgtatggtcgcatcgaatttcgccgccaacgcggtttccaaacaaaccaccatttcaccttcttcgcgcacttcgcgggcgacttttacgccgtcggcagtgtgcgggtcgatgagttcttggtcttgctcgtaaacctgcttgatggtggcgaggcggtcggcgtgggtggatttgccagaggtaaaaccgtatttgccaccgactttgtccaaggcaaatcgcaggtcaaagcctttgcctgcagccacttccgcccacagcgtattgatttccgcaggatcgcgatccatcaggtcgaacacgaaacgctcgaagttggacgctttggaaatgtccatagacgggctggaggttacataagtatgcgcgctgttgcgcgggcggtatgcaccggttttgaaaaactcgtccaacacatcgttttcattggtcgcgacaatcaggcggcggataggcaggcccatttgtttggcaatgtgtcccgcgcaaacattgccgaagttgccgctcggtacgcagaagctgacggtttcgtcattgcttgaagtggcgttgaaatagcctgcaaagtaataaaccacttgcgcgacgatgcgtccccagttgatcgagttgaccgtaccgatatggtatttttccttgaacgccatcgttctgcaccgccttcacaatatcctgacagtcgtcaaacattcccttcacggcgatattgtggatattctcgtcttgcaggctgtacatttgcgcgcgttggaacgcgctcattttaccgtcgggcgacaacataaatacgttcacgccctttttgccgcgcaaggcatattccgcagccgaacccgtatcgccgctggtcgcgcccaagatattgagttttttgccttctttgtttaaaacatattcaaacgcattgcccaaaaactgcattgccatatctttgaacgccagcgtcgggccgttggacaaggcttggattttgatgccgtctgaaagcgtgcggacgggggtgatttccttagtaccgaacgccgcttccgtgtaagtacggttcagaatgtcgcgcaaatcgtcctccggaatatccgtaacaaacaggcgcataatttcaaacgccaattcgggataagctaaaccgcgccatttgtccaaggtttcgcgcccgatttgcggataatgttccggcagcatcaggccgccgtcgggggcaagccccatcaataaaacttcgctgaacggtttgtgtgcggtttcgccgcgcgtgctgatgtatttcatgatttttctcgtctgtcgaaattgcaggaaaacggcttcagacggcatctgcctcatgccgtctgaagaaggttagcggtacaggtgtttgaagcaggcggaaaccgttttggcggtcagggcggcaagtgcctgattgcgcgtggacggagccagcatctgcatcacatcgttgccggtcatccgttcgggtgcttcttgggcgacgcaagcgcaaatcttgttttcccactccgcctgtttttcggcactcatcgccagcgcggtcaaacgccattcgctgcgtttgtccaattccgcacggcattggctcccaaccgccattttgacgatgctgccgcccatgcctgtgccaccgtctaagctgccgaatgtgttaccgcctccggcggcgcagccgccgagtaagattgccaccggcaaaatagacaaggttttattcatctcaattccttttcggttgaaaccccgccttttatggcgatagaatctgattagccgccccgttcgggataacgcgaagggcggcgttttatgcgccgttccgagtgttggaacaaaccgttttgaatatccggttgaagcccggcaacattatacttcaatcgggaaaataaaaaatcccgccgccgtcattttgcctgtttgcaaaaatgccgtctgaaagcggttcagacggcatttccgatttcagcctagcccaaagatttgaagtgttccaaaaacggcgggataccgggcagcatcccgaccgcacccatcgccacacacaagatcaagaaacctactgcgggtatcaacacgcgtccggcgaaacctaattgcgcactgcgctctttgcagccgattaagcccaaattatccaacagcatcgtcaacgcccagccgaaaaccggattgaccaaggcggaagagaacaccacgatggcggcggattgggtggttttgcctttgcgcgtcatttccatgcccgcttccaaaagcggtaagtatacgcctacgaccaaggctacgctcaataccggctgccaaatcgccaagtccatcggatagccccataacccggcgataatacataaaaccgccgttaaaaccgcaccgcccggaatggggcgtttggcaatcgatgccggtacgatataagttccccaagaagaggtaaaatttgcaccccctaaaatagaacccactgcttgacggacagaacaacttgtcatggtgtcgtctatattcatcaataccttatcggttttttccggatagctgattttttggaacacttgatgtcctaaaaaatcgggcgaccacattgcaacagccaataccgcaaatggaaagacaaccaaaaaactttctgccgtcggcaaccccagatgccagccgctgttttcaccccaccaataagcaggactcattggaggcaggccgggggcggtgtgaaactcaaacggcgcacccaatgcaaatgccaccacaccggcaatcaagcatcccaaaggcacggctaaccagcgttttttccaatgctccaacaaagcgtacatcacaatcgttacaataatgacggtaaaagcgatgtagggcatattaaaaccgcctgcccacgaaaacaatttttttacctgccccgtcgtgccgataaagcccaaatagagtaataatccgccgcatacgccgttgcttgtcagcttcgccataatactgccgccgcgaaataaagccatcagcagacctaaaaccgcaatcgaaatgccgaacgccaaaggatgcccgcctgccgacacaacgatgggaatcatcggaatcagcggcccgtgcgtaccgggcaggttggcgccgggcagaaaaaagcccgataccaataagataaacgcggcggcgattaaaagctcatagcgcacattttccagtacaaagctgtcaggcagccccaaaggtgcggcaaacgccgccgccaccgcccccaccatcaccacttttccaatcgttcccgccatcgcaggaatcaaatcctcccactcgaagcggtaatcgcgaaagggcaggttgggccgccagcgttttggttgcataatctgcaattcatgttccaaatattcgtcccgcgtcgcaaattccgaagctggacggtgcaaatcccgataagtcccattatgtttttccataaccttcctccttatatatcgcgcctcgtaaaaggggcgcatgacttttctttttgatacgggctgcgttcggaagccgtaaccccatttaaagcccaaacaggcaataaaaccaatctttttttttgataaccatcatccggaaaactgatacaatttacaaaccacttgattaaaaagttaattttcagcaacaatccacctaaaagatttcgattgcacaaatatagaaaacatccgcacaaggagggatatatggatgccgtacaattaaaatcatttgtcgccgtcgcgcacgagggcaaccttacccaagccgccaaacgacttttcctttcccagcctgccgtttctgcccaaattaaagcccttgaagaatatgtcggcacgccgctgttcaggcgcacggggaaaggcatggtattgacgcgggcgggcgaaatactgttgcccgaagcggaatccctgctgcaatacanacacaagctggagcattttgccaaaacgctggcaggcgattattcggaagagacagtttgggcattatccaccccatcgattcggcaaaactcgtcgcgctgacggacaatatcggtcaaacagcccccaatacgcgcctgcacatccaatacggaatgagcggcgaaatcctctcgcgcatccaacacaaaaccctgcacggcggctttatactcggcaacgccgcccaacgcggcatccgcagcgtattcctgcaaaacctgacctacgcgctgatttgcccgcaaagccaatatccccatctgacccgctcccttccgcagagcctgcaagaatgcgtatggatagaaatgtcgggcgtgtccggaagtaggaagcacctgcaccagttttggcgcagcaaccggctctcacccaaaaaacagatcttgtgcgactacccccaaaccattatcgatttggttgcaggcggtataggtgtggcaatggtgccgggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcattgaaaaagtatggggagtgcaggcggtgcagccgcccgttgtctcggacaactgaaataaatcctgctttgctgattgttttaaaatagaaatttgaattttatcacgctgaaaacactgaaaacgccatccgcattctctcaaatacggcttaaaatgccctttggaaatgccgttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaactgacgcaaataccgttttgcacaattccaaaagttttcaattccgttaatgcgattttgccgtttggcgaaatgcgtactgttccagtcgtggattgaacccccaccctgtatagttctttcgaagcattggggtattgttttttcaaagcatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgtcgtttgaacatttttttcttcctgtttgatttcagacggcattgccgttccgtttggtttccagcagctcccagcgttccagcttttccaaaagcagcatttcgatttcttcggcgcggttttgcaatgcacctgctttttcgtaatctttgaaaatttcaggataggaaagttgggtattgatttcagcctgctcggcttccaaagcggcgatttcgtcgggcagggcatcgagttcgcgctgctctttgtaggacagtttgaccgtgcggttggctttgggtttttctttggcgggttcggcatcggatgctttgggtgcggatgccgtctgaattttatcttcccgcgattttgcgtcgatatagtcctgatagccgccgatgtattctttcagacggccttgtccttcgaaaacaatgctttgggtaattacgttatcaaggaacatacggtcgtgcgagacaaggaatactgtgccttgataatcgcgcaacaggtcttcgagcagctcttgggtgtcgatgtctaagtcgttggtcggttcgtccaagaccaggatattggcaggacgggtaaagagttttgccagcaaaaggcggttgcgttctccgccggagagcgatgaaacagggctttgcgcacgggctggatggaacaggaaatcttccaaatagctcatgacgtgttttttcttaccgccgacttcaacgtaatcgtttccctgtccgagggtgtaaaacacggtgtcgttttcattcaacgcgctgcggaactggtcgaaataggcgacttcctgcttactgccgatacggattctgccgtaggtcggctgcaattcgcccaaaatcagcttaaggaaggtggttttgccgatgccgttggggccgattaggccgattttgtcgccgcgctgcaagatagcggagaatttgtccataatgactttgccgccataggcaaacgaagcgtgttccaattcggcgatgattttgccacttttctcaccgctatcgagcttgaagttgacttgtccctgtacgttgcggcgttctgcacgctggcggcgcagctcttccaaacggcgcacgcggccttcgttgcgggtacggcgcgcttcgatgcctttgcgtatccatgcttcttcctgtgcgtggaatttgtcaaagaggcggttgtgttccgcttcgactgccaactcttgcgcttttttctcgctgtatttagagaacgagccgggataggaacgcaaaataccgcgatcgagttcgacaatccgcgtggcgatattgtccaaaaaacggcggtcgtgggtaatcacaaccaagctgccttcaaacgctttgagcagattttccagccaaataatcgcgtcgatatccaaatggttggtcggctcgtccagcagcaatacgtcgggcttttgcacccaagcctgagccaaggcgacgcgctttttctgaccgccggaaaggttgccgattttttcattttccggcaaaccgagttcccccaaagtctgcttgactgccgcatccagtttccagccgtccttcgcttcgatttcaagttgcaattcgttgagttctttcaacaaagcctcactcgaaccattttccaactcatggctgacatgatgataacggcgcaataaatcacgaatttcgcccaaaccttcggcaacggtatcaaatacggttgcgtccttatcaaaaaaggattcctgcggtacataaacgattttgaggttgttttgaacaataatctgcccgtcgtcgagcttttgcaaaccggcgaggatttttaaaaacgaagacttgcctgcgccgttgcgtccgattaagccgactttttcgccgctgtcgagttgaaaagaagttttgtcgagcaaggcaacgtggccgatggcaaaagaagcgttttctacagataatatattcatgatacaaattctcaacagttaccgtttggattttaccgcaagtttggcgcgggcaatttcaaccgcacccggcaggacggaaacaataatgatgccgcccatcaccaagcccagattgttttttacgacggggaagttggcaaagaaatagcccgcgtaagaaaacaggataacccacaacaagccaccgatgatgttgtagcggataaatttggcatagtgcattttccccataccggcgacgaagggggcgaaggtgcggacgatgggcataaaacgggcaatgatgatggttttgccgccgtgtttttcgtaaaaacggtgggttttatcgagatattcacgtcggaagattttagaatcggggttggcgaacagcctgccgccgaaatatttgccgacggtaaaattgagcgcgtcgccgagtatggcggcaaggcttaataatgcaaccatcaaatgaatatccataccgcccagcgcggcaatcccgccggcggcaaacagcagcgaatcgccgggcagtaagggcgtaacaatcaggccggtttcgcaaaaaacaatcaaaaacagaatcgcataaatccacacaccgtattgcgccgacagcgcgagcaggtgttggtcgatatggaggatgaagtcgatggcggaggcaagcacggcgcgttcctaaaaaaacaaaccgcgtattttaaccgattggaaaaatgccgtctgaaaagtttcagacggcatcggctattcaaattcatttcacgtaaaaaccgcaaaccaaaatagtttgcggtttggcatttaaagtgacaatgatgatttcaaatcatcagaattttatgccgacgcgcaagccgtattcacgaatactggttttcgggatggtgagcgatacgtcgccactcttggttgttacactaaactcgccggattctttgtaagtgcgttgtttgtagaacggccccgcctcgatgctggcggattcgcccagttttttaccaatatttgcacccaatccaaagccccagccgttggttttttgattgatgtcttttttgagattggtaacgccggtgtttaatttatagcgggaattgaggtcaaatttcacttcagaccaagggttgatataccagccgttacccagttgggaaagcaaatccgcgtgaactttggctaaccacgactgacggctgctgtgaagcgtatgcttggtggttttaatgctgtcttttgaagattcaaaacccaagccggcacccacacggaaatttaaagaatcacttaacgtttgggtgtaggtgtagcctgtgtaaagatcgatacggttttcaggaacgccggtgggcagttttacatttttagtcttacccagcttgttctcatctgtttccaaattaataatattttttttgctgcgcccgaaaccggcttccaagcggatgccttggttggcatcaaaaggaatatcagcacgcacgctgatgtgtttggcagctttgtgtttttctttcaggaaagcacgagttgaagaaatggaagagaggtcggtgtggacggtaaactcattagcggtttgaagctcttgtgcagcggcggcagtaccggtcagggcaatcatggcacatgtaaaaactgtttttttcatagttaaaacctctaaaatttggattgtagtcggatatggtaacataacgtaaataatcgttacgcttacaattatattcttaagctttcggggggggggggattttacatatattaataaaaattaacaaatagttatttgtttacaacgaattgttattctcacttggttttctgttttttatgggaatgacgaaattttagtttgtgtgtatttatcggaaaaacagaaacccgccgccgtcattcccgcgcaggcgggaatctagaacccaacgcgacaaaaatttatccgaagcgacaacaatcttttcatcgtcattcccgcgcaggcgggaatctagaacgtaaaatctaaagaaaccgttttacccgataagtttccgtgccgacaaacctagattcccgcctgcgcgggaatgacgggattttaggtttctgatttcggttttctgttttaagggaatgacgagacttgagatggcggcatttatcgggagcaactgaaaccaccctgccgtcattcccgcgaaagcgggaatctaggttcgtccggtttcggttatttccgatagattcctgccgcgttgggggtctggattcccgcctgcgcgggaatgacgggactttaggtttctgtttttgtttgagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgtttggtttgcgtttccgtcagcggacggttgcggcaggctttgcgcataatgccgtccaacaactgatgttcttccagatgttgccggttttccgcactgtcatagcctttgtcggcatagacggtcgtacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttcttgatccaacgggcatcgctgtccttactcggtgtggtttggccgttgatttgtccttcttcatcgacttctatgacctgacgctgtgtgctgccggcggtctgaataatggtggcatcaatgacggcggcggatgctttctctacttttaagcctttttcggtcagttggcggttgatcagttccaataattcggacagggtgttgtcttgcgccaaccagttgcggtagcggcataaggtgctgtaatcgggaatgctcagttcgtcaaaacggcaaaacaggttgaagtcgatgcgggtgatgaggctgtgttcgagttcgggatcggagaggctgtgccattgtccgagcaggacggctttgaacatggacaacaggggataggcgggacggccgcggtaatctctgaggtaacgggtttttgacggttcaggtatggttcgatcggctgccaatcaatcacccggtccaacttcaatagcgggaaacggtcgatgtgtttggcaattatggcttgtgcggtttgccggaagaaggtgctcatgagaaatcccctaaatgtcttggtgggaatttaggggattttggggatttttgcaaaggtttccgcctgaaacattatgagatttcaggcggcattggattgcttggcggaatatttttaaaaaggcttacgcgccgtaaacggggtatttattgcacaaagcagttacttgtttgcggactttggcgaggttggcttcgtcttcggggttagacaatacgtcggcaaccaagttcgccaatacgcgcgcgtcggcttcgttaaaaccgcgtgtggtcatggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatagtgcgccatatcgacaaagaggtatgcgccgactttatcggcgatttcgcggaattttgcccagtcgatttgtaacgcgtaggcagacgcacccgccacaatcattttgggtttgtgttcgagcgcgaggcgttcgacttcggcataatcgagcacttcgttttcatccaaaccataagtaacggcgttgtagagtttgcctgagatattaacgctcgcgccgtgggtcaggtggccgccgtgcgctagagacatacccaaaatggtgtcgcctggttttaaaacggaagcgtacacggcttggttggcttgcgagccggagtgcggttggacgttggcataggctgcgccaaacagttcttttacgcggtcaatcgccaattgttcgacaatatcgacgtattcgcagccgccgtagtagcgtttgccggggtagccttcggcgtatttgttggtcagctgggaaccttgcgcgtccattacggcgcagctgacgtagttttcggaagcaatcagctcgacgtggtcttgctggcgttggtcttcttgggcaatggctgctgccaaatcggggtcgtattgtgcgagggtaacgctttttgaaaacatgttctcggctcctttgtgtaatcagggtatcatgagtgttttttgtataaaaaaatatttcaaaacctaaggcagatagcccataatgcgtaaattttctttggcattatcaggtaatttatttaacatgctggtttttagcgtctcattacctttatttagtacaagactaatcaaaagcaatacattaaatggtaaattttcggcagtttgtgcaaaatcaatcaaataaccagcaccaaccacatctttatcagccataacccgctgatacaccacttgctaagacaactctcctgccccaccatgtcttaaaatcagatgaatggcttgtaatgctgtgtttggtgtctcacaaattgccaagatctgctcagaagcttgcttgatggcttgtatttttgtttgattactcacaatttccccctattttaataattaacttaaatgcggtcaaattcacaaaatacaagctttacctctaatcacccatcactcgaccttctcggcgtggatcggcaccaccaaccagcctgcttggctcgataataatggcttgaacacctgaatttagctcacgcacatcagtcttatagcccaaatcatttaatgcttgttgccactggacggcggttgtacccgtttctagttcatagctaccaaagcgatttaataaattgggtgcactgatggcattttggatatccatattccagtcactatgtgccacaatcgtcttagcgacatagccaatgatacggctaccacctggggagccgattgccatataaggcttgcctgctttaaatacgatggttggtgccattgaggagcgtggtctcttgccgggctcgacacgattggcgacctgtttgccctgctttattggctcaaaactaaagtctgtcagctcattattcagcaggtagccatttgccatcaaagttgagccaaacgcattttcaatggaagtcgtcattgatagcacattgcccgccttatccacaattgatatatgactggtagaaggtaactcaatcgcttgtgaggacacccactcatgaataaaatcgcctgcagatacgctaggcaatgccttatccgactgctcaagcagctggctgcgatgttttaggtagtctttagaaatcaactggcgaatgggtactggtacaaaatcagggtcgcccaaatatacatcacgatccgcaaacgcaagcctagaagcgtcgcccaagagacgtaaaccttcagcatcataccccacctgattgggtgaaaattcatttaaaatccccaaaatctgacccacagcaatcccacctgagcttggtgcacccataccgcatacttcataaatacgataagtcacacaaacaggcgggcgttccaccacttgataatcagataaatcttgtaaggataattgaccggggttatccttagcattttggacaactgaaacgatattttgggcatatttaccagtatgcagagcttttgcaccttgagctgctaacgcctgaacactgtcagcaaattctaaatttttcagcaagctgcctgcttgtagcggcacaccattcggcaaaaaataagcggctgtttttggatagcgtgccaaatgctgctgattttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccgaccaccgcttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaatcacctgcttttgttcggtcagtcccgttgcatgttcaggcgtgtgagcgtctgcacctgtgatgacagcagaatgagtattaaccttaccttgattggcatggatgacttgacatccagagattgtcatagacattatcaatgcagtcaataaatatgttttagccacaagcactccttcgcctgagtttgattgatgattcatacaaggcatgctgattattgtatttaatatggctaaataattcaatccaaactatcaatcttgaccatcaaaaaaagaccgctaatgtcatcagcagtcttttttgatatttattttaagatattaagtaatcagacctttgggctatgctcttcaatgagtggttttagctcacctgattggtacatttgtaggataatatcactaccaccgattaactcaccattaacccaaagctgtggaaaggttggccgactggcgatgagtggtagagtactgcgaatttctgggttttctaggatattaacaaaagcaaagggtctgccaattgggtcagcacctctactgcacgcgctgaaaatccacattggggaaactggggcgtgcctttcatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacagtaggaaaggctgaaaatttatgcgtaaagcgtgatattgtcaacgtttttatcaaccggacggcggtgttaaaagaaaattttgccgtatccgataaaacactggataaaaatattatctttgttataattaatgtaaagattcaatttgactttttaaccgtaaaccaagagaggaaagcgatatgttcccagaataccgtgatttgatttccaaattgaaacaggaaaattcccgcttcgcccgtctgttcgacgaacacaacgagctggacgataaaattaccggtctggtcaacaatccggttaccagcggtgcggaaaccatcgatgagctgaaaaaagccaaattgaaactgaaagacgagttgtacgccatcctgcaaaaagcagcgggaaaataattcgggtttgagtttttgaaatgccgtctgaaatgtgttcagacggcatttttgtcatttgaccggaaggcttgtgctgtttgaaataacggcggcggtatcggattgccgccgccgtgtacttgtgtgaacggctgtctgtctattttgcgtgcaggcggtcgagataggcgacttcttcgctgctgcccatgaagacggcgacgcgttagtgcaggttttcgggctgtatgtcgagcatggcttgatatgcgttgcttgccgatgcgcccgcctgttcgagtatcaggctcatagggttggcttcgtacatcaggcgcagtttgccgggtttagcggggtcgcgtttgtcttgcggatacatgaacacgccgccgcgcatcaggatgcggtggatttcggcaaccatactggctacccagcgcatattgtagtttttgccgcgcgtaccggtttcgcccgccaagagctcgtcgatgtattgttggacggggggcagccagtggcggcggttggacatattgatggcaaattctttggtactttcgggtactttcgggttttctttggtcagcacaaattcgttttcggcattgagcgtgaacatatatacgccatgtccgaatgtgaatacgagctgggtttgaggcccgtaaagaacgtaaccagcggcaagctgctgtctgcccgtttgaaggaatgattcggttgccaatgcgccttcgggtttttcaaggatggagaaaatcgtaccgacggaaatgttgacatcaatattggacgatccgtctaaagggtcgaataggacgagatagcgtccgttttcaccggcatttacgaaagtgtcttcttcctcgctcgccagcccggcaacggcagaattggctttgagtgtgtcaatcatgatgttgttggcgataacatccagttttttttggtcttcgccctgaatattgcccgtgcccgccatacccaatacgccggccagtgcgccgaggcggactttggcgttgatttcggtgcaggcggaaacaacggacagtaaaacgccgccgagtgcttcgggcagctggttttgttgcaggtgttcggggaggaatcgggtcagtgtgtccatagtttgctcgtttcggaaaggtttgtgccgtctgaaaggcggcaggttattgtggcgtattcctttggtgcgttttgcaggatagtctaggggattgtagtgtaaaaaaacggcatggggcaagtcggaacgcggcaggcggatgaggggatatttattcttaaaagtgccgactgccggtatatcgtccggttttgtttatttgacgggagatgttgtctgaagggtttcagacggcatcggggtcagcggattttgctgtccaaaaggtagcgcgagccttcgtcttgcgccagcagccgcgtcagggcggggaggtttgccgccaattgttccgccaacagatagggcggattgatgacgaacattccgctgccgtgcataccgaaaccgtcggctttcggcgcgtggacgtgaagttcggcgtgaaggtagttgtcgggcaggagttttttcaattcttcgggcagcttgcggctttcttcgcggctgaggcagggataccaaatgagataacagccggactcaaaccgttttaaagcggctttcagcgtttccgttacacgccggtagtcctgtttttcctcatagggcgggtcgatgaggacggtggcgcggcgcggcgggggcggcagcagggaaatcagccctttgtaaccgtcttcgcgtaatacttgtccgcgtttgcccaatcctgcttcgcccatattgttttgcagatggacaaagtcggtggggtgcagctcaaacaggcgtaatttgtcgccgacgcgggtcagcgattgcgccagccacggagaaccgcagtaaagtttgggcgagggcaggattttttgtatgtgcgcggcaaagtcagagagttcggcaggcaggttttgcgcctgtcggagcagggcgatgccttgtcggtattcgccgactttctgcgcctcgctgccttcgagattgtacacacccgcgccgccgtgcgtgtcgatgtaccagtagggcttgtctttgcggttgaaatattgcagcactaaaaacaaggtgaaatgtttgagcatatcggcgtggttgccggcgtggaatgcgtgtctgtaactgagcatagtcggtaaaacggcgggatattcggatgccgtctgaagcggggttcagacggcataaacagggatggatgggaaatcagcggctgccgccgattttgctttctctgccttcgagcagcttgacgatattacttttgtggcggaacaacaccagcaaagcaatggcgacggtcgcccaaacccacgagacgtgcggcataaagaaggatgcggcgaccggtgcggcgattgtggcggttaatgcggcaagggaggacaccttgaagccgaatgccataacaagccaaatcaacgcgcagaccaaggcagttgcgggagagagtgccagaagcacgcccaatgccgttgccacgcctttgccgcctttaaatccgaaaaacaccggccacatatgcccgaccagcgcggcgagtgcgacggccgcgattgcgctgtcggataaaccgagcggttcttgaagcacgcgtgcaagcaaaacggcaactaaacctttggcggcatcgcccaagagcgtcagcgcggccgccttttttttgccgctgcgtaaaacattggttgcccccggattgcccgatccgtaggtgcgcgggtcgtccatgccgtaatacttggacacgatgacggcgaaagaaagtgagccgatcagataggaaacagcaacagccggtatgttgaacatttgcggtactttacttagaatggtgcggttattttagcaaaaaacggggcggattatggataaaatctttttgcacggcatgaaggcagatacgcttatcggcgtgtacggctgggaacgcgaacggttgcagaccctgattgtcgatttggacatcggtgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcgcgtgaaaatcgtcaagccgggtattttggaaggcgtgcgcgaggttggcgtggaaatcgagcgcggcaagcgtgaagattgaacggcagaataggaaacggaaaggagatatgaagtggatttgagggaagtaaaattaggcggcgaaaccatttacgagggcggtttcgtcagtatcagcagggataaggtcaggttgcccaacggcaatgaagggcagcgtatcgtcatccgccatccgggtgcggcatgcgtgttggcggttacggacgaagggaaagtggttttggtgcggcagtggcgttatgcggcaaatcaggcgacattggaacttcctgcgggcaagctggatgtggcgggcgaggatatggcagcgtgtgcgctgcgagaattggcggaggaaacaccttataccgccgacagcgtacgcctgctttacagtttttatacggcggtcggtttttgcaacgaaaaaatgtatctgttcgaagcggaaggcgtgcgtttgggcagtacgcttgccaatgacgaagacgagattacggaaaccgtattgatgtcgaaagaagaagtccgtcaggcattggcaaacgatgaaattaaagacggcaagacattaatcggtttgcaatactggttgatgaaggattgacaggatgttggacttgcccgccggattggatcggcgggcggtttgtttggcggatgggatatgccttttcggcttgtatctgggcgcgtcctttaaagtcattcgtgctttagtaataagagagaaaaggggatgataattacctaaaagaacgtgataatttttaaaatggttaataatgaatatctttgttactaatttttgttattggtttattagtttattggctatttcttatataccatctattaatgcatggcatgatgaattaatagatgatattaattttggcaaaagggttatgatggttactttttttgcatttttaggcacggtaatagagcgtttttttaagaaaaagccttggtggttttatcctgccaaggctttttctttgttacagacctaaaagctcaatttgaatttgagaacggtaattggcacagccagtatttaaacaagcgaagctaatttatagattatgtcaaaacaaagggaggcaatttgttgcggttatttgactgccgcccctatcttcagcccgagccaggtcagcagcagcgaacctgccgtgtgcaggaaaatattggcaagtgctgaagcgggacggttcaattggagcagggttacggtttccagcgaaaatccggaaagcgtggtcaggctgccgagaaaaccggtaatcagcagcagcttccattgcgggtggttgacggtttcggcaaagattccgataagaaaagcgcctatccagttggcaaacaggttgcctgtggcgggaggtattgatgcgggaacggcgaggttgagcagccaacgcgccgttgcaccgagtgccgcaccgatggaaagggggatgatgttggaaagcatggttttgcctgtctatgccgtctgaaggctaccgccatatgccgcggtcggacttaagatagcggttgtcgtcgaaagtgttaatccaatggggcttcagtgcaacaaatatggcagttgaaatgccgctgaggaaggcttccgcccacgccagcagaataaagacgggcagggcggtcgtccacaatatttcggacggaaaagcgtttgcggcatccaaaataccggtcagcaccagcccggtcagcagaatgccggcggcggaagcgagaaagccgttgacgaaaataaagatgaaaatattgggcggcaggcggttgaccagcatacgcgacaggcggttgacggtcagcgcgggcagtatcagcaccaaagcgttcggcggatatgcgccgacagaaccggcaaacagcaggcagtagggcagcatcagcagcgcggcaagccaaagggcggcggaagtgcccatcatcagtgcaaccaaattgacggcgagcaggtggtagttcatctgggcaagctgtccgccgccggcagaggcgttcagacaccatgctgcggaaaaaattacggtacacaggggaagggcggaacggtagcgggcaagcgagcggaatgccgacggcgcggaagctgccagtatcaggataaggacaatccacgaaaccgacagtaccatatctgaaaaccagactgtttggaaaatcatggcaatgccgcaaagattaagggaagggacggctattatactgtcggcgggggcaaaccgaaagccgaatcggtttcggcagaattgccggccggttgttttttttgggatggaaacacgttaaaataaacccgtttaatcgtttgtcttgcgggaaacggcatatgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttgattttttgcaaatggaaatgccgtctgaagactgtttcagacggcatttttatagtggattaacaaaaatcaggacaaggcgacgaagccgcagacagtacaaatagtacggaaccgattcacttggtgcctcagcaccttagagaatcgttctctttgagctaaggcgaggcaacgccgtaccggtttaaagttaatccactatatcagacatttgaattcggattattccctgacctgtcccgtgccttgtacgatgtatttgtaactcgtcagctctttcaaacccatcgggccccgggcgtggagtttttgcgtggagatgcccatttcgcaacccaagccgaattcgccgccgtcggtaaagcgcgtggacgcgttgacatacacggcggcagaatcgatatgagtcgtgaaatagtccgcagcgtggcggttttcggtaacgatgccgtctgaatggtgtgtgctgtgggtttcgatgtgccagaccgcctcttcgaccgaagcgacggttttcacagcgaggatgtagtctaaaaactcggtatcgaaatcgtctgcacccgccgcttcgccgccgatatgccgcgccgcctgcggatccaaacggaagcggatgggcggcagtccggcttctatgcggtcgcgaaccaacagccgttcgagcttgggcaggaagtcggcagcaatgtcttcatgtaccagcagcacttccatcgagttgcacacggacggacggctggttttggcgttgtacacgatacggagcgccttgtcccaatccgcgtccttgtcgatataaatgtggacaatgcccgttcccgtttcaatgaccggcacgacggcattttcaaccaccgcccgtatcagccccgccccgccgcgcggaatcagcaggtctagataatctttcgccctcatcatttcgtaactgctttcgcgcccggtgtcttcaatcagttggagcgcgtcggggtcgatgcgggtttgcgccaaccccgttttcagggcggcaacgatggcgcgtgcggattggaatgcatctttgccgctgcggagtacgaccgcgctgccgcttttcagtgccaaagccgccgcatcggaagtaacgttcgggcggctttcgtaaataatgccgataacgcccatcgccacgcgctttttgacgatttccaagccgttgggcaaagtcgaggtttccagtatttcgcccacggggttgggcagcgcggcaaccgccctgatgccgtccgccatcgcgcaaatgcgtttgccgtccaacaaaaggcggtcggtcatgctttcgggaatgttgcctgccgcggcttccaagtcttgacggtttgccgccaaaatatctgccgtcgccgcttccaagctgtccgccatcgcaagcagcgcgcggtttttttcttccgtatccgccgtgttgacggatttttttgccgctttggcaagggcaagctgtttttgtgtgtttgacatgggtttccttttctaaaattcggtcagaagcaggcgtatttcgggcgtgatggaaatccagtcgtcccgatggatgaacacgcctttcgccttacgcgatttgagcaggtcttcggcggcggcagagccgaacaggacgcgccctttgcccaggggctgtttggttgccttgctgtacacggttacggtgtccatacgggaaaaatgcccttcgattccggcaatgcccgacatcagcaggcttttcccctgttcggacaaagcgtgttccgcaccttcgtccacataaacgctgccccggctttcggaatagaacgccagccattgcttctgcgtccgcaaacctttggcacgggggacgaaaaacgagccgtccgcctgatgttcggcagcttcggcaagtgcatcgggtttgagcgaggaacagatatacaccggtacgccggattcggcggcgatggttgccgctttgattttggtcagcataccgcccgtgccgtttgccgaacccgagccgcccgccatttcgatgatttcatggttgatgtgttcgattttgtccagccgtacggcatcgggattgctgttcgggttgcccgtgtaaagaccgtctatgtcggtcagcagcaccaagaggtctgcctgtatcatcgccgccacttgcgcactcaatgtgtcgttgtcgccgattttcaattcctcaaccgaaaccgtatcgttttcattgatgatggggacggcgcggcgttgcagcagcacggaaagtgcgccgccggcattttggtagcggcgtttgtcggcaaagtcggcgcggctgagcaggatttgcgcggacacgatgccgtctgaagacaggtttgccgtatattcttccatcagcagcccctgcccgacggcggcggaagcctgtttgtcggcgattttgaccggacgttttttgaaacccagcgcaccgaaccctgccgcaaccgcgccggaagacaccaagaccagctcgtgtcccgcatgatgcaatgcggcaagctggcaggtgatggtttggattttgccgcgcgagagactgccgtccgaatgggtaatcgaagatgtgccgactttaaatacgattcttttgtatttcattgtttccgtccttgttggtttgtcctgtctcgttgccaccttgtgccgccgaatttgccctgttctgccgcaattgtcaacaatcacgccgcgtctgcaataaaatggacaaaatgtataaaattaataaaatctatggcggcttattgagatttttcaaatttatattgccgttttgtccaaaatgcgtataatcctgtccatatttctgctgtaggctgatttattttagacaaggactaccatgcaattagatatagaccgcttggttgcttatttcggcggcgtgaacgcgcttgccgaagcgttgaaacagcacgatcccgaaaatgccgcgacgaccgccgccatctataaatggcgcacgcgcggctcgctgcctctggcgcaactgcaaaagctgaccgcgttggcggaagcgcaaggcaggccgctggatttgaatgcttttttacaaaaaaacgaatctctggagagaacagaaatgacacagaccaaccgcgttatcattttcgacaccaccctgcgcgacggcgaacaatcgcccggcgccgctatgaccaaagaggaaaaaatccgcgtcgcccgccagctggaaaaattgggtgtggacatcatcgaagcgggttttgccgctgccagcccgggcgatttcgaggcggtcaatgcgattgcgaaaaccattaccaaatcaacggtctgttcattgtcccgcgccatcgagcgggacatccgtcaggcgggtgaggccgttgcgcccgcgccgaaaaaacgcatccacaccttcatcgccaccagccccatccatatggagtacaaattgaagatgaagccgaagcaggtgattgaggcggcggtcaaagcggtgaaaatcgctcgtgaatacaccgacgatgtggaattttcctgcgaagacgcgttgcgttcggaaatcgatttccttgccgaaatctgcggcgcggtgattgaagcgggcgcgaccaccatcaatattcccgataccgtcggctattccatcccgtataaaaccgaagaatttttccgcgaactgattgccaaaacgcccaacggcggcaaagtcgtttggtcggcacactgccacaacgatttgggcttggcggttgccaattcgcttgccgcattaaaaggcggcgcgcgtcaggtggaatgtactgtcaacggcttgggcgaacgtgcaggcaatgcttcggttgaagaaatcgtgatggcgttgaaagtgcgccacgacttgttcggcttggaaaccggcatcgataccacgcaaatcgtgccttcgtccaaactggtgtccaccattacgggctatcccgtgcagcccaacaaagccattgtcggtgccaatgccttttcgcatgaatcgggcatccatcaggacggggtgctgaaacaccgcgaaacttacgagattatgtccgccgaatcggtcggctgggcaacaaaccgtttgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcactggtatccgacgaaatgggcagcatgaatgccgagagctacaaattcatctcccaaaaaatcagcaccgaaaccggagaagaaccgcgcgccgacatcgtgttcagcatcaaaggtgaagaaaaacgcgcttccgcaaccggttccggccccgtggatgcgattttcaaagcgattgaaagcgtggcgcaaagcggcgcggctttgcagatttattccgtcaacgccgtcacgcaaggtacggaaagccagggcgaaaccagcgtccgtctggcgcgcggcaaccgcgtcgtcaacggtcagggcgcggataccgacgttttggtcgccaccgccaaagcctacctttccgctttgagcaagctggaatttagtgccgccaaaccgaaagcgcagggcagcggtacgatttgagcgtgaaaacagacgatgccgtctgaagcataaaaaggcttcagacggcattgcggcgataatagggcgcaaaacccatttgaaaaggaaaatgatggattcccgaaaatttaccgaagcatccaaacggcggttgagcgaattgttggatgccaaaagcgaacaaggcaacacgatgcgttgcgacgaggttcaaggttttatgacggcgctgttgagcgggccggacaaattgacaccgctcgactggctgcccgaagtgttgggcgacgaatcgcaatttaccgccgccgaacgttccgaaatcgaacggctggttttggcaatggcgatggaaacaaccgccgcgatgtcggataaaaaactgcccgatttgtggctgtatgaaaacgaagacggcggcagcgatttttacacatggtgcaatgcttatctttacggtttggatattgtgccgaccgattggtttgaagccgtcgatgatgaagcgtttgaagagttgttttatcccatcatggcattgggcggtatttacgacgaagaggaaaacggcgctatccgtctgcaattcacagaaggcgagctggcggaactggaatccgagttgccttatgcattggcggatatctaccgctactggcaggcagtcatcaacaaaccgcaaaccgtccgcagggaaggcgaaaaaacaggcaggaacgatccctgtccgtgcggcagcggcagaaaatacaaggcgtgttgcggtaagaattgaagcgtttgtttccatgaaccaaacgtaaaaataccgtctgaaaccggatttccatgtttcagacggtatttttcacaggcggtcagtgctgttttttcatgccgaaccggacaaagccgacgatacccaaaacaatcatcgggacgctcaaccattgccccatcgacagccccaaggtcagcagcccgagatagtcgtcgggttggcgtgcgaattcggcaatgaagcggaatatgccgtagccgccgaggaagagcgaggcgacttgtccggtcgaccgctgttttttagagaacagccaaatgacggtgaacaggcagatgccttcaagtgcaaactgataaagctgcgagggatgacgcggcagcataccgtattgttgcagccattctgcccaaagcggattgtgcgcggcggcttcggcatcttcgtaacgcgcctgcgggaagcccattgcccaaaatgcgttgatgtcggtaacgcgtccccaaagttcgccgttgatgaagttgccgatacgtcccgaagcgagacccagcggaacgagcggtgcgaccgtatccatcagtttgaggaagccgatgccgtgtttgcggccgaacaaccgtatggcaataactacacccaaaaagccgccgtggaacgacattccgccttcccataccttgaaaatatcaagcggatgggcgaggtagtcggaaaacttgtaaaacaggacgtaacccaaacgcccgcccaaaattacgcccaaaatgccccatgtcaggaagtcgtcgagcgattctttggtaaaaacggacaagccttgcgcgatgcgccttctgccgagaaaggtaaaaagaataaatccgaggatgtagcttagggcataccagcggacggcaagcgggccgatactgataaggacgggatcgaattggggatgggtaatcataacgggctttcgttttcaaatgccgtctgaaaggcatgatgcttcagacggcatttctgcaataagggtttcagcgcaaatcgccgatgacgttgaggatagcggacaacgcggcttcgcccagccgtaaagaacgctgaccgttccagccgaagtcgtcgtcgggcagattggcattgtctttgaacggcatttccagcgtataggcaaggcagttgaaacggttgccgacccagttggtcgccaaggtcatattcgcttcgcccggcgcatctttttcgtaaccgtattcgtcttggaaatcggggctggcgtttaaaagggcatttttaaactgcgcttccaacgcggcgatgcgcggattgtagttcggcacgccttccgtacctgcgacaaagacaaagggcagcccttcgtcgccgtggatgtccaaaaacaaatccactccggtttccagcattttttcgcgcacgaagaacacttccgggcttttttctaccgtcgggttttcccactcgcggttgaggttcgcgccggcggcgttggtacgaaggttgcccagtgccgaaccgtcggggttcatattggggacgatatagaacgtggcgcggtcgagcaaggcgcgggcggtagggtcttgcgggtcgagtaatctgccgagcagcccctcgataaaccattccgccatggtttctcccggatgctggcgggcggtaatccagattttcaaatcgctttcgacctgattgcctatggtcagcagattgatgtcgcgcccttgcacggtgctgcccaagtcgtcgatgcggcacaggccgctgccttgcgcgtcgccgaggaggtttaaatgctgttcttcggagtaaggttcgaaataggcgtaatacacgctgttggacagcggagtatgattgacggtcagtacgccgttttcgtaggaagtcggtacgcggaaccagttgcggcggtcgtatgaggcacacgcctgatagccttcccagcctttcgggtaggcggcttctgccgcgttttcaaaatgcatgatgcagttttgatatgccgcgccttgcagccggaagtagaaccattgtgcaaaatcggaggcgttgtcgggacgcagggcgaggcggatgttggaaggatcggtcaggtctttgacgacgaccgagccggcatcgaagcgggtgctgattttaatcatgggaaagtccttgctgtcgccggtttctcgaaccggataaaccgcgattttaccgcccgtatcgcaaggcttcaacctgcccgaaagtctgccggatgccgtctgaagattgtttcagacggcgtttggcgttaacataagccgaaattgtcaacaatagggagccgttatggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctgaagcaaagtcggaaaatgccggctttggcggaaaacctgtttgtctggtttctgtttttggggtttcgggcaatttccaaaccgtcattcctgaaaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatagaaacaaaaacagaagcctaagatccgtcattcccgccgggcatctggttttttgaaatccggttgtttgggataaattctccggctttgattttttgtttttccgataacgccataactttgaaatttcgtcattcccgcgcaggcgggaatctagacctgtcggcacggaaacttatcgggaaaaaaggtttctttagattttatagtggattaacaaaaaccagtacggcgttgcctcgccttagctcaaagagaacgattctctaaggtgctgaagcaccaagtgaatcggttccgtactatttgtactgtctgcggcttggtcgccttgtcctgatttttgttaatccactatacgtcctagattcccactttcgtgggaatgacgggatgtgggtttttgtgcggatttgaaccggtaagggtggtgtgggattggtggtttgcttaggatcttttggattgtattttgtatatacatttacttgttgataaaagataaaataaaattagaaactaaaagtgagaaaaaattaataataatagggatgtataaatgtaaaggctccgtttcatagctaaggttatctgaatatatggaaaaaaagtaaaagtccataaaactaaaatatatagataatgctaatgataatagaattatcactttcctagagtaaggataatatttttttatcgtaaaaaaatataaaataggataaataattgccatatagatagattttgtaacaaaattaaaaataaataataaaaataatgtaataaagtatattttttggctatgaaataaaattgtacataattgaacgagcagatcaaaaaatgaactacatataacaataaataataacgtatttaccatactaaatttaataggtctcattatcatatttaataaccacttcatagtatagtggattaaatttaaaccagtacagcgttgcctcgccttgccgtactatctgtactgtctgcggctttgtcgccttgtcctgatttaaatttaatccactataaatgcagagtgggtggaaacactcactttatggtttgctacgctctgctcaattagcaacccgataacccaatatggataatagggtaattaatccaatctaatttgtcagcatccgttaatttattgcaaaataaagtattgaattatgtcgggtgcaaatgacgaaatataagtttccgtgcggacggatcaagattcccactttcgtgggaatgacggtggaaagattgttgtttttcccgatgaattcctgtgttttttgtttttccggataaattcctgtggctttgagttttttggatttcagcctcaatgccgtctgaacgccgaatcgggcttcagacggcattgcgtcatttgaaattcaaaaccggccagcctttttctttggcttctttttccagctcggcatcggggttgacggcgacgggttcgctgacaaggcgcagcagcggcaggtcgtttttggagtcgctgtaaaaataggttttgccgtagctttggagcgtttcgccgcgttcggcaagccattggttcaggcgggtgattttgccttctttgaggctgggcgtgccgatgtaattgccggtgtagcggccgtcagaaccggtttcgagttgtgtgccgatgatgttggtgatgccgaaaaggtggcagacgggggtgatgatgaactcgttggttgaggaaatcacaagggtttcgtcgcctgccatttggtggctctgcaccagcatacgctgcataggcgagatgtgggggatgatgtattccgccataaattcgcggtgaaactctgccagctcttctttgctgtaacgagcgagcggggcaaggtggaatttgaggaatgcgtcgatgtcgaggcagccgttttggtagtcgcggtagaatttttcgttttgcgcttcggtttcggcagcgtcaaccaagccttttttgatgaggtattgcggccaggcgtggtcggaatcggtgttgatgagggtgttgtcgaggtcgaagatggcgaggtttttcattgggtttcctgttgtttcaaaagctggcgcaaaagcggcagggtgatgcgtttgcccatcgtgacggcgtagttgtccagcgtgtcgagcatcatcatcaggctgtccatatcgcgccgccagtgtttgagcaggtattcgaaaatttcggaatcgacggttacttggcgtgccgccgccatactggcgagcgcgtcgattttttcttggtcggttaagggtttgacttcgtaaacgaggcagtacgccatacgcgtccgcaaatcttcgcggatgacaagctgctggggcgtgtattccgaaccgagcagcaaaaagcctttgccgctgttgcggaagcggttgaagatggaaaaaagcagggcttgttcttcgttgcccagtttttcgacttgatcgacggcgaggtattccgcctcgaacgcggcatcggtcagcggcatggaggcggcatcgatataggcggcgtttttgccggcttcgagcgcctgtgcgacccacgcctgcaaaagatggcttttgcccgcgccttcttcaccccagacatagataaactgtccgtgtttgtgtcggaggacatagaccagttccgcgttttccgtgccgaggaatttgtcgaaactcggatagtcgtgtgcggcaaagtcgaaaataagctggttcacggttcggcattccgaggggtggtaaacgggtttattgtacgttgttttcgcgcgcctttccaatttgaacgatgccgtctgaaaacggcttcagacggcatcgttcaaccgcaggcaacgttgccgacatcgaggcgcatattgtggaacgcgttgagcgtgctgcggtggccgatgctgatgatgatgctgtcgggcagtttttgtttcagtgcgcggtagagcagggcctcggtcggttcgtccaaagcggcggtggcttcgtcgagcaggacgattttgggcttggaaagcagggcgcggacgaaggcgacgcgttgcagttcgcccggggagagtttgtgttgccagtcgtcggttttatctaatttatcaaccagataacccaagcggcaggtgttcatggcttcggctaactcgggatgctgcttgtcaatgtcggggtaacaaaccgcgtcgcgcaggctgccctgtgccgtgtacgggcgttgcggcaggaagaggatgtcttgatgcggcggacggctgactttgccgctgctgccgaacggccaaagccccgccagcgcgcgcaacagcgaggttttgccgcaaccgctcgggccgcgtatcagcagggaatcgccgtttttgaggtttatgttgatgccgctcaacaggatttcgccgttgtggcggaacagagcgacgttttcctgtgggggactgttagtttttgcacaaggaacaaatagagtaaaaaaacgctgaaatcttcggaagacgtggatttcggcgtttttttgtatccggaaaagttacgccagctttttcacaaaaccgcgccggaatgcgcggttttctgtttaaagctgacgagattagggaatttttaaaactgttttaagaggtttttaaaatggatttaatcaatactccggccataccattcaacacggcctatgatggcgatgtcgtcttgggcattgctcaaatctatttcaaacggtgcgtaacgtggattttcagacgttacaagcagtttgcccggtatacgttgcacacgtttgacaaagaggtcattgcctatacgcaagacatataggccgtcacgcgggtcagtttcggcgtggttgatgagaatggaatcctcatgattgagcacgccctccattgaatcgcctttaacggtaattacagacagtttttccggctgtttggtcacatagttgtcaatccaatatttccggaaagccaagcagaataaaggttcttcgccgaagactggtgcgccataccctgctgctgcggctacgttgtagcgcggcacgaatacaaactcggacaggtcgacaggattgcccatagtgtcggtgattccatcagaatttctacttacagagaatgctccggcgttttccggcctggctttatcgagatacggcaagccttttccggtcagcagccagtttaaatcacaactgaatttttactaggtaatcggctgttgggatagctccctctttccaaactctattaaatccagaagccgacatttctattttgttatagatgtcagatggcttagccccatgaggccaaagaaatttgagcctatctaaaaaagtatccatagtaatcctaatttaactcatttaagcaaaacattaagcaaaaaaagaaactcttttgcttaaataagattactcaaataatcaatattttgtaaaaataattacgtttttgagaaaatattttagcaaaagagtttcatgaagctgttttgctaaatgtaattcactcatttgctaaatgacggcggttaataaacctacttaattaaggaattgcgagaatgaaaaaaagcaagaaagcatgactgattggcatcgtgctgacattgtggctcgtcttaaaaaggcaggctggtctgtgagagcgttatctatcgaggctaatttagcaccaaatacattagggaaagctttagatgctccttatctgaaaggcgaaagaatcattgcagcagcgattggagtacccgcagaagaaatctggccatctcgttttgagaaacgaaaccataagccaaccttcccaagatctataaatagataactgttttgctaaatagttccaaaagagtaccgcatttaagcaaaaatagaaagcggaaaaaatgaaaatatctgcatctgatattgcgaaattaggaattccgagcctaccaactgatagacaagggattgaataccatgccaagaaaaataattggcaacactgttttgagcaaaaaggaagaggccgtcctaaaaaactgtatgaaatcgcttccctccctgccgaaatccgagcagccatcatgaaacggcagtcggacgagctggcggagaagatgccgaaaatgctgcccaaagtcagaccggggacggcgatgtcggctcaagcactggctgaagcggccaagctgttgaacgagaaacaacggtcggtggcggatgcgcgatgtgcggtggtagcggcggtattggggattaaatacgaatacgattgctctgccaaggctgcggtggctcagtttttgggcttgctggcagaaggtaaattggacgcggtcacgcttgggaacttggaaaaggccaatgaccgcagccggacggcgaaggtcggcgaacgtactttagacggctggatttctgcttatttgaaagcggaaaacgcgacggagcggttggttgctttggctccgaagacgacgaaggcggtcaagccgattgaaagttacggatggttgccgatgtttatgcagtttcacaatattccgtccgcgccaaagctggcgcacagctaccgctggtttgtgcagtgggcggaagcggaaaatatgccggtcaatgatgtgcctaacttgagtatggtgcggcgcgtttgggaaaagctcccgttgattatgcaggagcgcggcaggaaaacgggggcggcttataaatcgctgctgccttatgtgaaacgtgattggggggctttgaagccgaacgatgtttggatcggcgacggccatagctttaaggcaaaggtggcgcatccggtacatggcagaccatttaagccggaagtgacggtgattattgatggttgtacgcggtttgtggtcgggttttcggtctctcttgctgaaagttgtgtggcggtatcggacgctatgcgtatcggggtcaagcattttggtttgccgattatctattactcggataacggcggcggccaaaccggcaagacgatagaccatgaaatcacgggtattacgtcccgaccgggtatccgccatgaaacgggtatcgcgggcaacccgcaagggcgcggcatcattgagcgatggtggaaagacaatctgattgagatggcgcgccagtatgagacgtttgcgggtgcagggatggacagcagcacgaagaacctgatgtaccgcaagatggaaagtgcgtttaacgctttggaaaaaggcaaggatttgacggaggaacaacagaaatatttgaaaaaactgccgagctggtcgcgttttatagcggatgtggtcaagtgtatcgacgaatacaacaaccgcccgcacggcgagctgccccgacatcctgacggcgggcattatacgcctaaggcttatcgggaaatgaggctggaacaggacggtatcgcgccggatatgttgtcggcgcaagagctggcgacgatgtttatgccgcaagaggtgcgaaaggtacagcgcggttggctggatttgtttaacaactcttatttctcaaccgagctggcggagtatcacaaagacgaggtacgggtcagctacgatttgagcgatgcgtcggcggtcaatgtgtttgatatggacggcaagtttattactaaggcgcaggccaacggcaatacccgcgaggctttcccgacggctcgtatcgaccaactggcggaaaaacgtcgaaaaggcaaaataaagcgggcggaaaatgcaatcaagctcgcaaacgcggaagtcaatcctgctctggaacaggctgcggtttgggacgagctgggacatttgggcggaaacgacatcgaggcggagtatgcggtattgccgaaaacgggcacagacgattttgtgttgtttgaggcggatagataaaggaaaacatgatggacaaacagcaaaatgcagcgttttcggccgagcttgttgaaaaattgaaactcaagcgagctcttgggcggattcaacgagctcaagcaaagattcaaggtgttcccgctgaacggaatcaggctcaaacgtttttgcctgcgcttgaaggaaactgcgaacctgctcaatcgaagtcggctcttgacgggtaatccgctggagcagccaggaaagtacgaaagaatcggcaagtgacctgtcttccaagtcttgaacggcgacttccagcatgatcaggcgtttttctaaatcgggaaactctttcatttcagacggcctttaaaggttgtttaaaactcaaggatattaaaaatgaaacaaattaatcaagcattgcaacaaaaactggttgaatttaaagaaaaatcaggcatgaaccaaacccaactggcacgcggtatcggtacttcgccggcatccatcagtatgtatctgaacggcacttatgcggaaaaaggcggcaattatgaaaccatcgagccgaaaatcgaggcgtttttggagatgcaggacagtaaagcgcaacgcgaagagctggtgttgggttttgtatcgactaagacgacccgccgtattgcagaagtgatgcgcgatgcgcacgaaggcggcgaaacagtggtgatctacggtcaggcgggattgggcaagactcaggcggtcaaaaactactgcgagaaaaaccctgcggccatcttgattgaggctaatccgagctttacggctttggtcttgatgcgcaagttggcgactgcggcgaaggtatcggcgatgggcagcctgaatgatttgtttgagtctgtatctgaccgcctgcgcgattcgggccgtctgattgtggtcgatgaagcggaaaacctgcctttacgcgcccttgaaattgtacgccgtctgcacgacgagactggctgcggcttggtgttgagcggtatgccccgactggtggccaacctgcgcggtaagcatggcgaactggtacagctttacagccgcgtgtctgttgcgctgaatttgggcgaatctttgccggatgacgaactctttgagattgcgaaagcggctttgcctgatgcggtcaagcatctgctccctgatagtgtacaagcgttgattacggtcatcgggtttaatgaaacgctggagctggtgcgcctgatgggcggtacgacttatcctttgcggcagggttatacgaaaaacagtcaatcccgtgttgcatacttggaagagattatcggcagtgaggcggccggtcggctggtggaggcaatggctccgtgcaatctgtttataccccgttgcgagacggccttgtatgagttgcgaaaccgtaaaatccgcagtcagtttgaccggcagacggcaggcggtacccctgcttatgaggccgttaacgatttggccttggcacaccgcctaagcgaccgccatgtgtggcgaattttaaagcaggcggataaggaagcggagcaggagaatttgttttagaatggaatgccatgcagatgtatggcattttattttggagaaaaatatgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataaaataaacgattctaaggccgtctgaacaacaggcggcttttttgttgcctactgacactgtttcgcccgctgcaaaagccatgccgtttgaaaatgtaagcctctgaaagtgcattttaatctgattttgagggaggctttaatgagcaaaattatttgtctgactgccggacacagtaacaccgacccgggcgcagtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgccctat

SEQ ID NO: 37778 - DNA, 47475 bp, Neisseria meningitidis
gaacgctcgaccaacggattaaaagtccgctgctctacccccgggagctaacgacccgataagccgtgcattatacagcaccatcctacctcgtcaagcaaattttacaggcttaattgcagaccactgtttgcacgggatattttgacaacggattttcacaatccgccgcataccgtgtaaaagttcgcacaaggaaaagcaaaccgcccgaaatcaatgtacactttccgcccgtttcccttcccaacctgcacacagaaacacacattatgaacatacaaaacatccgcaccctcctcgacaccgtcgccgttccgaatacggcacgcacgctcggcggcgaaaaggccgtccgttcggtcgaacagcgttcagacggcatccatatcgccctgcatttcggcttccccgtcgcgcacattgcctcagaaacagccgaccgcatacaggaaatcctgatgcccgaaacaggcgacacacacatccatctgtccatggacactgaaatcggcacacacaaagtccagcccggcgttaccaccatcaaaggcgtgaaaaacatcatcgccgtcgcatcgggaaaaggcggcgtgggcaaatcgacaaccaccgccaaccttgccgccgcaatggcgcgcatgggcgcgcgcgtcggcgtgctcgatgccgacctttacggcccgagccaaccgaccatgttgggtgtggacgaccgcaaacccgatcagaaaaaccaaaaactcattcccgtcgaatcttcagacggcatacaggtcatgtctatcggctttctcgtcgataccgaccaagccgtcgtctggcgcgggccgatggtcagccaagccttgcagcagctgatgttccaaagcgagtgggacgaagtggactacctgtttatcgacctgccccccggcacgggcgacatccagctcacgctgtcccagcgcatccccgtaaccggttccgtcatcgtaaccacgccgcaggacatcgccctgatagacgcgcgcaaagccgtggatatgttccgcaaagtcaacattcccattttgggcgtattggaaaatatgtccgtccacatctgcaccaactgcggacacagcgaagcactgttcggcacggacggcggcaaagatttcgccgcacgcctcaacgtccccctgctcggacagcttcccctaagcctgcccgtgcgcgaagccatggacggcggcacaccggcgcaactgttcgacgaacaccccgccatcgcccgaatctacaccgatgccgcattccaaatcgccctgagcattgccgacaaaggcaaagacttcagcagccgcttccccaaaatcgtcgtcgaataaagccgcgtccgaaaccgcaacagcaatgccgtcccaagccccgcgcctgccggcgggcaaacttgccggataaaacggtttttttgagattttacgttccggattcccgcctgcgcgggaatgacgaattttaggtttctgattttggttttctgttttgtaggaatgatgaaattttgagttttaggaatttattggaaaaaacagaaaccgctccgccgtcattcccgcgcaggcgggaatctagaccttagaacaacagcaatattcaaaggttagctgaagctttagagattctagattcccactttcgtgggaatgacgggatgtaggttcgtgggaatgacgcggtgcaggtttccgtgcggatggattcgtcattcccgcgtaggcgggaatctagaccattggacagcggcaatattcaaagattatctgaaagtccgagattctagattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagattataaaagacccgtcattcccgcgcaggcgggaatccagaccttagaacaacagtaatattcaaagattataaaagactcgtcattcccgcgcaggcgggaatccagactgtcgggcatctgcagcggtttgctaaaaaacgctttaccgtgatcagtgtgcaaagttaaaatggggaggtaagcttttcaatcagcaatccggcgggcgcgggatcgggcggtttaccgaaccccggtgttcgcggcgcgcctgccgccgacggtatcccgcgaagcaagatttaagggataaaatatgttccaacacgcagggcggcacataaggcgccgccctgattcggaagggcttgcacccctcccggacaaagcctgatcctgccgccccgaaggacggatgcccgaagggcggggggtttgaccgaaaaggaaatacgatgaataaaactttaaaaaggcgggttttccgccataccgcgctttatgccgccatcttgatgttttcccataccggcggggggggggggggcgatggcgcaaacccataaatacgctattatcatgaacgagcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatcaaaccatcgtctctacgacagaaggctcccctatttcccttggcgaccagcagcgcgaacataccgccgtggtctattatctgaacgccaaactgcacctgctggacaaaaaagggattaaagatatcaccggcaaaacagtgcggttgggtgtcttgaagccgagcatcgatgtgaagacacaaaatacggggcttggcggcattctagcttattgggctaggtgggacattaaagataccgggcagattccagtcaagctcggcctgcagcaagtcaaagcaggccgctgcatcaataaaccgaaccccaatcccaacaaaaaagacctttcgccggccctgactgcccccgcgctgtggttcggacctgtgaaagatggtaaggcggagatgtattccgcttcggtttctacctaccccgacagttcgagcagccaaattttcctgcaaaacctttcccgcaaggatgacacaagcaaaccgggccgctattccctcaaacccttgagtacgtcggagattaaaagtaaagagccgagtttcacggggcggcaaaccgtcatccgattggatggcggcgtacggcatatccaactggatagaaacaatgaggccaccggtttaaatggaaatgacggcaaaaacgacactttcggcattattagagaagggagcttcatgcctgatgccagcgagtggaaaaaagtattgctgccttggacggttcggggttttgctgatgacagtaaatttaaagcattcaacaaagaagaaaacaacgacaacaagccaaaatacagccaaagataccgcatccgcgaaaacggcaagcgcgatttgggcgacatcgtcaacagcccgattgtcgcggtcggcgagtatttggctacttccgccaacgacgggatggtgcatatcttcaaaaaaggcaacggggacgcgcgcgactatagtctgaagctcagttatatcccgggcacgatgccgcgcaaggatattcaaaacaccgaatccacccttgccaaagagctgcgcacctttgccgaaaaaggctatgtgggcgaccgctatggcgtggacggcggctttgtcttgcgccgcattacagatgaccaagacaagcaaaaacacttctttatgttcggcgcaatgggctttggcggcagaggcgcatacgccttggatttaagcaaaatcgacaacagcaacccggccggcgtttccatgtttgatgtcaaaaacgacaatggcgtgaaattaggctacaccgtcggtacgccgcaaatcggcaaaacccacaacggcaaatacgccgccttcctcgcctccggttatgcgactaaagacattaacaacggcgagaataaaaccgcgctgtatgtgtatgatttggaaaacaacaacggtacgccgattgcaacaatcaacgtacccgacggcaagggcgggctttcgtcccccacgttggtggataaagatttggacggcacggtcgatatcgcctatgccggcgaccgcggcgggaatatgtaccgctttgatttgagcaacaacgatccgaccaaatggtctgtacgtactatttttaaaggcacgctggataagccgattacctccgcgcccgccgtttccaaactgaaagacaaacgcgtggttatcttcggtacgggcagtgatttgagtgaggatgatgttgataaaaaggatatacaatctatttacggtatttttgacaatgacacaggcacggatgtggcagaagaaggacagggcaaagggttgctcgagcaacaccttactcaggaagataaaaccttattcctgaccgattacaagcgatccgacggctcgggcgacaagggctgggtagtgaaattggaagccggacagcgcgttaccgtcaaaccgaccgtggtattgcgtaccgcctttgtaaccatccgcaaatataacgacggcggctgcggcgcggaaaccgccattttgggcatcaatactgccgacggcggcaagctgaccaagaaaagcgcgcgcccgattgtgccggaagccaatacggctgtcgcgcaatattccggtcataagcaaaccgccaaaggcaaatccatccctataggttgtatgtggaaaaacaatgaaaccgtctgcccgaacggatatgtttacgacaaaccggttaatgtgcgttatctggatgaaaagaaaacagacggattttcaacaacggcagacggcgatgcgggcggcagcggaacattcaaagagggtaaaaaacccgcccgcaataaccggtgcttctccggaaaaggtgtgcgcaccctgctgatgaacgatttggacagcttggatattaccggcccgatgtgcggtatgaaacgaatcagctggcgtgaagtcttcttctgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagacattcaatgctaaggcaatttatcgggaatgactgaaactcaagaaactggattcccactttcgtgggaatgacgggatgcaggttcgtgggaatgacgtggtgcaggttcgtaggaatgacgtggtgcaggtttccgtgcggatggattcgtcattcccgcgcaggcgggaatccagacattcaatgctaaggcaatttatcgggaatgactgaaactcaaaaaactggattcccactttcgtgggaatgacgggattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgatgggattagagtttcaaaatttattctaaatagctgaaacccaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgcaggcgggaatctaggacgtaaaatctcaagaaaccgttgtacccgataagtttctgcgccgacaaacctagattcccgcctgcgcgggaatgacggttcagttgcgtaggactggattgtgaaaaggggcggattcggtgaaaacggcggaaatgtgggattgatggaatcggtgggctgaagccctccctacagagctttcagacggtattgtttgcgttttcgggatgggggcaaatgaaacaccgacaaaccgataccgtcattcccgcgcaggcgggaatctagacattcaatgctaaggcaatttatcggaaatgactgaaactcaaaaaactggattcccactttcgtgggaatgacgattcggacattccttaaactacccgtgtatcgctgtaaatcttagagatggaggaataaagaccgttgggcatctgcagccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgatggttcgggtattcctgacgattcgggtattcctgacgattcgggtattcctgacgattcgggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcgggtattcccatagtttcgccgggcggacgtggggaaatgcgtaacgggcatagtgggcgcggagcgggcggttttatgccccggatttccgttttcgcgcgaacatatcagcccgcctgccgcgtttgcgcttgaaatcgggtatgtttcgtcttaaaatatgctgctttcagggtataggcacttgcccgaaaagcacgttacgcgtctatcttgcgcggcgtgtttttttttgaccggatttttccgaccggatgccccctgccgaagtcccttcagacggcattgtcaagaattttattaaaaacaggattcccatcatgagcacccccgccctcctcgtcctcgctgacggcagcgtatttcacggcacatcaatcggttacgaaggttcgacttccggcgaagtcgtgttcaatacttcgatgaccggctatcaggaaatcctgaccgacccgtcctactgcaaacaaatcgttaccctcacctacccacacatcggcaacaccggcaccaacgccgaagatgaagaaagccgcagcgtttatgccgccggcctgattatccgcgacctgccgctcttgcacagcaacttccgcgcctccgaaagcctgcacgactatctggtacgcaacaaaaccgtcgccatcgccgacatcgacacccgccgcctgaccacgctgttgcgcgaaaaaggcgcgcaaggcggtgcgattctgaccggtgcggatgccacaatcgaaaaagcgcaagaactcatcgccgcgttcggcagcatggtcggaaaagatttggcaaaagaagtttcctgcacggaaacttacgaatggacggaaggcgaatgggcattgggcaagggtttcgttacccctgacgaacagccttaccacgtcgtcgcctacgatttcggcgtgaaaaccaacatcctgcgtatgctcgcctcgcgcggctgccgcctgaccgtcgtccccgcccaaacgagcgcggaagacgtgttggcactcaaccctgacggcgtattcctatccaacggccccggcgaccccgagccttgcacctacgccatcaaagccgtacaaaaactgatagaaagcggcaaaccgatttttggcatttgcttgggacaccagctcatcagcctcgccatcggcgcgaaaaccctgaaaatgcgcttcagccaccacggtgcgaaccaccctgtgcaagatttggacagcggcaaagtcgtcatcaccagccaaaaccacggttttgccgttgatgccgacaccctgcccgctaacgcacgcattacccacaaatccttgtttgacaacactttgcaaggcatcgagctgaccgacaaacctgtgttctgcttccaaggccaccccgaagccagccccggtccgcaagatgtcggctatttgtttgacaaattcattggcaatatgaaagcggcaaaacgggcataatggttttcagacggcaacagtatgctgctgccgtctgaaaaacaaagctggaaatgaagattagcgcactcgaccatctagtactaactgttgccgacattgaccgaaccatcgcgttttatagtgaattaaatttaaaccggtacagcgttggctcgccttgccgtactatttgtactgtctgcggctcgccgccttgtcctgatttttgttaattcactatacacacaagttttgggcatggaagaagtttcatttggcagcgaccgtaaagctttgttgtttggcagtcagaaaatcaacctacacgggcgcggtgcggaaattcagcctaacgcgcaacacgccgcctgcggcacagcggatttatgcctgctgaccgatacgccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttattgattttcagacggcttatgcaaaataaaaaacagcctgcacaagctgttttccttgcagcctctttaaccccaacagccgccccgtcctctctccctgtgggaaagcgttagagagagggcaacaagccgcaaggcttgtgtttgggcggttagggtgttggggaaggttgccgaaattcggggaatgccctctccccggccctcccccacgggggagggagaaggttgcagcagattttgcggttgcaggcggtttgaaaggcaacttagatttgcagctgttgtttcaggtcatctgaaaaataaaaagcagcctgcacaacctgttttccttgcaaaacccttaatcccaaccgccaccacgtcctctctcccatgggagagagtcagagagagggcaacaaactgtaaggcttacacaaacagtaacccgacaacagaatgagcacgcacgagaaacttttaaccgccgacaaccccgtcctgcatcaacgcgccaaagccatgcgccaagaaatgagcgaggcggaagcaaaattgtggcagcacctgcgggcaggccgtctgaacggctataaattccgccgccagcagccgatggggaattatattgttgattttatgtgcgtaacgcccaagctgattgtcgaagcagacggcgggcagcacgcggaacaagccgtatacgaccacgcgcggacggcatatctcaacagcctgggctttaccgtgctgcgtttttggaatcacgaaattttgcagcagacaaacgatgtactggcggaaatcctgcgcgtattgcaggaattggaaaagcagtatgcgcaataacaaacggttaattttgattagagttttgaaaattataggatacaggtagggtacaggctgcttgaattgagcgtttagaagaccgtctgaaaaacaaaaaacagcccgcacaacctgtttttcctgcagaacccttaattccaacagccgccccgtcctctctccctgtgggaaagcgttagagagagggcaacaagccgcaaggcttgtatttaggcggtgaaggcattggggaaggttgccgaaattcggagaattccatctccccagccctcccccacgggggagggggcaggttgcagcggattttgcggttgcaggcggtttgagaaagaatgcccgaaatatcaacagcgggaatttttcaggcagcctttatcgcaaggcaggtggaacaaacgccgcgaacgttttttcagacgacctttgaactcatcggcagagagtgtgccgcaaggcacgcacgcggtgggttggggttgcagggaaaatggagaacgcgtgcatacgtaccgcacataccctacatacgggctacggcttgctacgatacgggggtttcgatatacaagttaggttttagcaaacccaacattttagacaattaagcggtttgtgttgggttttcaacccaacctacgcttgctacgtttattgcaacatattcgcaggagtttaaatatgtcaatacctattaatttcaataatttaaagtatttgcttaatgatatgagaaacaaaaatagaataattgaagcatttccttttaattataatcaaaggcaatacgccgttattttgactaggtataaacctgatgaacctagaccagatgattatgcacaagcaaaattagagttttttaatttgaatagtgaaaattcaatatttgcgtatgctgatttttatgaagttcattttaaaagtgctactgattttattaatttttttaaaattaatgttcaggctggtgctgcgaaaatcagagaaatttttcagagttttagtaatctttttgcagatttcattccaacacaaactaaaaaagatttagacataatttataaaaagattgtagctactcgtttagaacctaattctcctaacactatttattgctatgatgtccgtagaaatgggaaagataaggctggcaagcctaatcgcaggagcgtggaaaatagtgaaaaagcaaaaattttgcgcccagagctatacgaaaaatttaaagccgatagtaattacagttttttcttttcagataatccaagcgatgaaaaaacagatgcagaaataattagagaagttaccaatcgtcaataatccaaattcttcaaaagaaagacccaccatgcccaaacgtaccgacctaaaatccatccttatcatcggcgccggccctatcgttatcggtcaggcctgcgaatttgactattcgggcgcacaggcctgcaaagccttgcgtgaagaaggctataaagtcattttggtgaattccaaccccgccacgattatgaccgaccccgaaatggcggatgttacctacatcgagccgattatgtggcagacggtggaaaaaattattgccaaagagcgtcctgacgcgattctgcctaccatgggtggtcagactgcgctgaactgtgcgctggatttggcgcgcaacggcgtgctggcgaaatacaatgtcgagctgatcggcgcgaccgaagacgccatcgacaaagcagaagaccgtggccgctttaaggaggcgatggagaaaatcggcctctcctgcccgaaatcttttgtctgccacacgatgaacgaagctttggcggcgcaagaacaggtcggcttccctaccctgattcgtccttctttcaccatgggcggttcgggcggcggcattgcctacaataaagacgagtttttggcgatttgcgaacgcggtttcgatgcgtcgcccacgcacgagctgttgattgagcagtccgttctcggctggaaagagtacgagatggaagtggtgcgcgataagaacgacaactgcatcatcatctgctcgattgaaaacttcgacccgatgggcgtgcatacaggcgactcgattacggttgcgccggcgcaaacgctgacggacaaggaatatcaaattatgcgtaatgcttcgctggcggtattgcgcgaaatcggcgtggacacgggcggctcgaacgtgcagtttgcggtgaaccctgcaaacggcgagatgattgtgattgagatgaacccgcgcgtgagccgttcttccgcgttggcttccaaagcaacgggtttcccgattgcgaaggtggcggcgaagctggcggtcggctttacgctggacgagttgcgcaacgacatcaccggcggcaaaacccccgcgtcgttcgagccttccatcgactatgtggttaccaaaatcccgcgtttcgcgtttgaaaaattccctgccgcagacgaccgcctgaccacgcagatgaaatcggtgggcgaagtgatggcgatgggccgcacgattcaagaaagtttccaaaaagccctgcgcggcttggaaacaggcttgtgcggcttcaatccgcgcagtgaagacaaagcggaaatccgccgcgaactggcgaaccccggccccgaacgtatgctgtttgtggcagacgcgttccgcgcgggcttcacgctggaagaaatccacgaaatctgcgccatcgacccttggttcttggcgcaaatcgaagacttgatgaaggaagaaaaagcggtttcagacggcattttgagtgatttggatttcgccgccctacgtcgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatctcgtccttccgaccgcaaaaaagtgatgattctcggtggcggcccgaaccgcatcggtcagggcatcgagtttgactactgctgcgttcacgccgcgctcgccctgcgcgaatcgggctttgaaaccatcatggtcaactgcaaccccgaaactgtgtccaccgacttcgacaccagcgaccgcctgtatttcgagccgctgacgctggaagacgtgttggaaatcgtccgcaccgaaaacccgtggggcgtgattgtgcattacggcggccaaaccccgctcaaactcgccaacgcgctggttgaaaacggcgtgaacatcatcggcacgtccgccgacagcatcgacgccgccgaagaccgcgaacgcttccaaaaagtgttgaacgacttaggcctgcgccaaccgcccaaccgcatcgcccacaacgaagaagaagcgctcgtcaaagccgaagaaatcggctatccgctggtcgtgcgcccgtcttacgtcctcggcggccgcgccatgcaggtcgtccattccgccgaagagctgcaaaaatacatgcgcgaagccgtgcaggtttccgaagacagccccgtgttgctcgacttcttcctgaacaacgcgattgaagtggatgtggactgcgtttcagacggcaaagacgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtacaagacggcgtagtgttcgtattggaagtgaacccgcgcgccagccgcaccgtgcccttcgtctccaaagccaccggcgtgccgctcgccaaagtcggcgcgcgctgcatggcaggcatttccctgaaagaacaaggcgtggaaaaagaagttgtccccgatttctatgccgttaaagaagccgtgttcccattcatcaaattcccgggcgtggatacgattttgggaccggaaatgcgctccaccggcgaagtcatgggcgtgggcgcaagctttggcgaagcctactacaaagcccaactcggcgcgggcgaacgcctcaacccgaccggcaaaatcttcctctccgtgcgcgaagaagacaaagaacgcgtcattaaaaccgctaaaaacttccaagttttaggctacggcatctgcgccacgcgcggcacggcgcaatacctgaccgaacacgggctgattgtgcagaccatcaacaaagtacccgaaggccgcccgcacatcggcgacgcgctgaaaaacggcgaaatcgcactggtcgtgaacaccgtttccagcgatccgcaatccgtgtccgacagccacatcatccgccaaagcgcattgcagcaacgtgtgccgcaatacaccaccaccgccggcggcgaagcgatgagcgaaggcgcgaaaagccgagaccatctgggcgtgtacagcgttcaagaactgcacgggcgtttgaaaaaccgcaactgatgcctgaatcaggttgaaaatgccgtctgaagccgttttgcggtttcagacggcattttgtcatttggaaagccgatgttgccacacacaagccgtacataaggaacagccctatcacgctccccatatagattgccattgccgccgactatacattatcttatttattttttctcaaagttattaagtgagtaaaaacagttttatgacaggtttttatagaattatccacagagattgtttcccagttcctccactaaaaaatccaaaaatacgcgtaagcggagattgacggctttatcgctgtaataaacagcattaaaggggtgtgttttatcggaggtttgttcggcgagcaggggaattaactttccttcagcgatgtcgttgtcaaccaaaaaatctgataagcaaacaataccgcaacctgaaaggcacaacgagcgtaagatttcaccgctgctggcggtaaagtgcggtgaaatcttatagggatttccctgcgcatctaaaaccgcccatgtatttagagaaccgggttcggtgaagcctaaacattggtggccggcaagctcttctgtagattgcggcgtgccgtgttttgccaggtattcaggactggcgattacgcggaagcggctgtcaaacagatggcgtgcacgcagcccggaatcgtccaattctccggcccgtaaggcaatatcgactttgcgttcaatcagattgatatagccttcggaagaaacgagcgaaagtcggatatgcggatagcgttcgttgaattttgctgccagcggcgccagcagatgcagcaccatcggcatcgcggaatccacgctcaacacgccttgcggtatttcgtgcactgccagcatttcggtttccgccgctgccatttcttgcaggattctctgcgcgcggcggaaatattgcgcgccttcttccgtcagactgagttgccgcgtggtgcggttgagcaggttcacacccaacttttcctccagccgtttgacgatgcggcttacggcagaatttgccatcgccaactgctccgccgcacggctgaagctgccgctttccaccacttgaacaaatacggtcagttcttctgaattggttttcatcgtgtttccttttcggttggaaccccgccctttagggcggcaggatcagactttatttgggaggggtgtaaccccttccgaatcaggacggcacacagggcggtgctttatgtgccatcccgtgtgttggaacatctgattatttcatttgacgcaaaagtgttttcttatttttgcacttttaaattataaagtaaaacggcacaatacattcatcaattcacaaacgaggtaacaaatgaatattttattattagacggcggcaaggcgttcggacattctcacggcgggttaaaccgtacgcttcacaaaaaagcgaaagaagttttgaccgcgctcggacacaatgttcaagaaaccgtgattgatgccggctatgatgttgaggcagaaatcgaaaagttcgtttggatggatgctgtgatttggcagatgccgggctggtggatgcacgagccttggacagtgaaaaaatacatagacgaagtattaaccgctggacacggcaaactctaccaaagcgacggcagacacagcgtcaatccgactgagggctacggcacaggcggcttgttgcaaggcaaaaaacatatgatttcactgacttggaatgcgccgattgaagcctttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaaaaatttatcttataaacaaacaaaggcagcctgaaagattgaatggtctgcacccctaaggttggactaaccaaccgactaaggtgcagattattttttgttgctttttcagcttttcgttgggttagatattcttgcccactgttttcaggcagccttgaatacaaaaaaatggcgtatgtaatatgtttatacgaccaaaacggaatgaattttaacgtattgcgcgtcatcaacaatgactgagtttctcgcctctcgcgcctgaatctatagtggattaacaaaaaccagtacagcgttgcctcgccttgccgtactatttgtactgtctgcggcttcgttgccttgtcctgatttaaatttaatccactatatgtcatgcagttcctttcattcaaatcaacaaaagaatgccgtccgaacgtccgttcagacggcacttgtcttcccacaatagacttgaggctgttctaacgtaccaccccttcgttccgccccaaaaccatcgcatcgccgtagctgaagaaacggtattcgcgttcgaccgcatgacgatacgcggcgcggatatgacccatacccgaaaacgcgctgaccaacatcagcagcgtcgatttcggcaaatgaaaattggtaaccagtctgtcgacaacattaaaacggtagcccggcgtgatgaaaatatcggtgtcgccctgccccgctttcagacgacccgtcgcacgcgcggcagattcgagggcgcgcatggaagtcgtgccgaccgcccagactttgttcccccgggcttttgccgcctcaacggcggcggcggtttcagacggcacttcaaaccattcgctgtgcattttgtgctcttcgattttgtccacacgcacgggttggaacgttccggcaccgacgtgcagggttacttctgcggttaccgcgcctttgtctttcagacggtgcaaaagttcttccgtaaaatgcaggcccgccgtcggcgcggcgaccgcgccctgatatttggcataaacggtttgataacggctgtcgtcatccgcatcggcggcgcgttcgatataaggcggcaggggcaggtgtccgttctgttccaaaagttcgtaaacggtctctccgccttcaaaacgcaggcagaacagttcgccctcacgcccgaccgtcacggcgcggatgccgccttcaaacaccagccccataccgggcttgggcgatttggacgaacggatgtgcgccagtgcggtatggttgtccaacacgcgctcaatcagggcttcgatcctgccgccgctgtctttctgcccaaacagccgcgccttcatgactttggtgttgttgaacaccaaaacgtcgcccgcctcgacataatccggcaaatcgccgaacacccggtcttgcagcggcatatcgggcaacgcaaccaaaaggcggctgctgccgcgcacttcgggcggatgctgggcaatcagcttttcgggcagggtaaaatcaaaatctgaaatatccatttttacactctcgttcgggcaagccgccattatacgcactttagccctttttcagacggcatctttgtccgaaaaaccaacagattagaataaacactcttaacctggaacatcttgtgcgcaaaatcaaacttcctgcacatttcccccaaaaaccgccgttttttgatattttactggacatttaccgacaacttcgggaaaataaacacattctcacggtcgttttccaccacaggaaaaccgtatccgaacaccattccgcccggtttgcgccgttgccgcaagccggctgttttctgaaaaaccaacgcaacaacccgccggaacaccggcagcctttaaaggaacagaaatggatttgcgcaaattaaaaaaactgattgatttggttgaagaatcgggtatcgccgaaatcgaagtaaccgaaggcgaggaaaaagtccgcatcacccgaaccatcgccgccgcacccgtttacgccgcgcccgtacctgccgccgcgccggccgtaacgcctgccgccgcacccgttgcggcatccgcgcccgccgccgcacctgccgcccgcgatttgtccgacgcgcaaaaatcgcctatggtcggcacgttctaccgcgcacccggcccgaatgccgcgccttttgtcgaagtcggccaacaagttaaagccggcgacacgctgtgcatcatcgaagcgatgaagctgatgaacgaaatcgaagccgaaaaatccggcacggtcaaagaaattttggtcgaaaacggtacgcccgtcgaattcggcgaaccgctcttcattatcggataatcctgttttcagacggcataaacttccgatgccgtctgaaatgctttcccccttcagcgttcccgcacccttttttacggacgggttgccggaaccgcaggaaaggtcatcatgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcttccgcgcaaagctaccttaacgtccccgccattatcgccgccgccgaagtaagctgcgcggacgctgtccatccgggttacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaagtcggttatcccgtcattatcaaagcctctggcggcggcggcggccgcggtatgcgcgtggtcgagaaaaaagaagacctcctccaatctgtcgaaatgaccaaagccgaagcaggcgcggcattcggcaacccgatggtttacatggaacgctatttgcaacgtccgcgccacgtcgaaatccaagtgattgccgacgaacacggcaacgccatctaccttgccgagcgcgactgttcgctgcaacgccgccaccaaaaagtcatcgaggaagcaccggctccgttcatcactgaaaaagaacgcgccaaaatcggcaacgcctgtgccgatgcctgcaaacgcatcggctaccggggcgcgggtacgtttgagtttttatacgaagacggcgaatttttctttatcgagatgaacacgcgcgttcaggtcgagcatccggttaccgagctcatcaccggcgtggacatcgtgcaggagcaactccgcatcgccgccggcctgcctttgcaatacaaacaaaaggatattcaagtcgaaggccacgcgtttgagtgccgtatcaacgccgaagacccgtacaacttcattccaagcccgggcctgattgaaagctgccacctgcccggcggcttcggtatccgcgtggacagccacatttaccaaggctaccgcatcccaccgtactacgacagcctgatcggcaaaatctgcgtacacggcaaaacgcgtgaacaggcaatggcgaaaatgcgcgtcgcactcgccgagctggcggtaaccggcatcaaaaccaatacgccgcttcaccgcgacctgttcgccgatgcgggtttccaaaaaggcggcgtcagcatccactatttggaacactggctggaagatcgcaaagccaaacaggacaagtaaaccgccgccgatatgccgtctgaagccgcccgtccgcgttcagacggcatttcccttgccccgcgccgtctgaaaccgatttcgatatagtggattaactttaaaccagtacggcgttgcctcgccttagctcaaagagaaagattctctaaggtgctgaagcaccaagtgaatcggttccgtactatttgtactgtctgcggcttcgtcgccttgtcctgatttaaattcaatccactatatttccaagaaagcccgttatgccctaccaacaaatcaccgtcaacgtcaacgatgccgtcgccgaacgcctcgccgacgcgctgatggaacacggcgcactctccgccgccatcgaagatgcctacgccggcacgcaaaacgaacaggcgattttcggcgaacccggtatgcccgccgaacaaatctggcagcagagcaaagtcatcgccctgttcggcgaacacgacgaagccgccgccatcatccaaaccgccacacaagaatgcgggttaaaagacttggcatacaccggcgaaaccatcgaagaccaagactgggtgcgtctcacgcaatcgcaattcgaccccatccggatttccgaccgcctgtggattaccccctcttggcacgaagtccccgaaggcagtgccgtcaacctccgcctcgaccccggactcgccttcggcaccggcagccacccgaccacgcgcctctgcctcaaatggttggatacgcaactcaaaaacggcgaaagcgtcctcgactacggctgcggttcgggcatcctgaccatcgccgccctcaaactcggtgcaggtttcgccgtcggcgtggatattgacgaacaggccgtccgcgccggcaaggacaacgccgcgcaaaacaacgtcgatgcacaattcttcctgcccgacggtctgcctcaagggcaattcgacgtagttgtcgccaacatcctcgccaaccctttgcgtatgcttggcgaaatgctcgccgcccgcaccaaacagggcggacgcatcgtgttgtccggtttgttggacgaacaggccgaagaactcggcggcatttacagccaatggttcgacctcgacccggcggaaaccgaggaaggatgggcgcgattgagcggcgtaaaacgctgaaacggaaaggaaacaccgtgcaggataaaaacaacctctgctggctcgatatggaaatgacggggctgaatcccgaaaccgaccgcattatcgaagtcgcgatgattattaccgactcggatttgaatgtgttggcgcaatccgaagtttacgccgtccaccaaagcgacgacgtgctgaacaaaatggacgaatggaacaccgccacacacggcaggacggggctgacacagcgcgtacgcgaatcgtcgcataccgaagccgaagtcgaacagaaactgctggactttatgtcggaatgggtacccggacgcgccacgccgatgtgcggcaactccatccaccaagaccggcgttttatggtcaaatatatgccgaaactggaaaactacttccactaccgcaacctcgacgtttccacgctgaaagaactcgccaaacgctggaatccgcccgttgccaaaagcgtcgtcaaacgcggttcgcacaaggcattggacgacattttggagagcatcgaagaaatgcgccactaccgcgaacactttctgatttccgccccgagagccgaagcgcaataagaaacaaacaatgccgtctgaaacgcagtttgcatttcagacggcatttttacagcagattgaaatcaaaaatatacacgcccgtcattcccgcacaggcgggaatccggaaggtcgggcctgccgttattttcaatcattacagaaactgaaaggtctggattcccgcctgcgcgggaatgacgggcgtgtgcattcttatagtggattaacaaaaatcaggacaaggcgacgaagccgcaaacagtacaaatagtacgaaaccgattcacttggtgcttcagcaccttagagaatcgttctctttgagctaaggcgaggcaacgccgtactggtttttgttaatccactatacttcaatctgccaaacagatcgaacagagaaaccctgtccgtcaaaacatcattcagccatcgccttgaacacttcaaccgcaaccgcaaccgtttcgtcaatcagctcgggcgtatgcgcggcggaaacgaaacctgcttcataagcggacgggccgaaggcgacattgcggtcgagcatcccgtggaaaaactgtttgaagccttcaatattggaacgcgccatatcggcatagtttcgcggcgcgtgtgcggcgaaatacagaccgaacataccgcccacgctgtcggcggtgaactcgatgcccgccgcatccgctgccgtccgaaaaccttgaaccaactgttcggtacgcgccgtcaggttttcatagaagccttcgcgctggatgatttccagcgttttcaagcctgcggcgacagcaatcgggttgcccgacaaggtgcctgcctgatacacgccgcccagcggggaaatacattccataatgtctttgcgcccgccaaacgcggcaagcggcataccgccgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaggttcatattgccgacgaagggttcgacaatcacgcaggcgatttcattgccgctttgagcaaaggcttcttcgagttgggcgatattgttgtactcgagtaccaaagtgtgtttggtaaagtcggcaggcacaccggcggaagacgggttgccaaacgtcagcagaccgctgccggctttcaccagcaggctgtcggaatgcccgtggtagcagccttcaaacttgatgattttgtcacgcccggtaaaaccgcgtgccagacggatggcggtcatggtcgcttcggtaccggagctgacgaggcgcagccgttcgacggacggcatgattttggcgatttcttcggcaatgacgatttcgccttcggtaggcgcgccgaacgacaaaccgcccaatgcggcttcgcatacggtttcgacgacttcggggtgcgcgtgtccgacaatcgcaggtccccacgagccgacgtaatcggtatagcgcgtgccgttttcgtcccaaacatacgcgccttcggcttttttgataaagcgcggtacgccgccgacgctgccgaatgcgcggacgggggaattcacgccgccggggatgatggctttggcgcggtcgaataaaatttcgttacggttcatatatatcctcaaatgccgtctgaacggcaggtttcgggcttggaagcagaaagccccattttatcatttttcaggttgcgacaaggatttgcccgcttctttgcggatcacgccaaccgcatcccggatgacggaacgctcgtctttttccactttatgtgtaaagcggtagtctcggacgactccctccccgtcgtaatccacacaccactcccaatgtcggcgttctgatttcatataaatgaaattggtcggcaaaaaattataaatcggcaggstgacttcatgataggcataacaaccgaaagggttgcgcttcccgaaacgtgcctctacacctccgcccgggtcgttttgcctttaacaaccgtttgtgcgattccctcttccgtctgatatagtggattaacaaaaatcaggacaaggcgacgaagccgcagacagtacagatagtacggcaaggcgaggcaacgctgtactggtttttgttaatccactataacgcaggaactgatgttccctgtcgccgaaattgctggtacacgcacacagcagcaatgccgcccatacagccggtttcatacacatctcccattaaagccaaacattatacagccgtcccgaccgattaaattcatattttaaaacaatatcctgcctccaaaacccacatcgtgctataatccgcaccgattttcagacggcatcgtcgtgccgtctgaaattttttcattccaacaacaatcagccccgcgattacggctgcctgagaaagacacaaaccatgaaaaaagtatttatccgcaccttcggctgccagatgaacgaatacgacagcgacaaaatgctcgccgtcctcgccgaagaacacggcggcatcgaacaggttacccaagccgacgaagccgacatcatcttgttcaacacctgctccgtgcgcgaaaaagcgcaagaaaaagtcttctccgatttggggcgcgtgcgtccgctcaaagaaaaaaaccccggcctcatcatcggcgttgccggctgcgtcgcctcgcaagaaggcgaaaacatcatcaaacgcgcgccttatgtggacgtggttttcggcccgcaaacgctgcaccgcctgccaaaaatgattgtggacaaagaaaccagcgggctgtcgcaagtcgatatttccttccccgaaatcgaaaaattcgaccacctgccgcccgcccgcgtcgaaggcggcgcggcatttgtatcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaacgcctatcgcggcgaaatggacgacggcgaaatctgcgacttcgccaccctgctgcgcatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcaatgaaacgcggctacaccgctttggaatacaaatccatcatccgcaaactgcgcgccatccgtcctgatttgtgcctgagcagcgatttcatcgtcggcttccccggcgagaccgaacgcgagttcgagcaaaccttgaaactggtgaaagacatcgccttcgacttgagcttcgtgtttatttacagtccgcgccccggcacgcctgccgccaacctgccggacgacacgccgcacgaagaaaaagtgcgccgcctcgaagccttgaacgaagtcatcgaagccgaaaccgcgcgcatcaaccaaaccatggtcggcacggtacaacgctgcctggtcgaaggcatctccaaaaaagaccccgaccaactgcaagcccgtaccgccaacaaccgcgtcgtcaacttcaccggcacgcccgacatgattaaccaaatgatcgatttggaaatcaccgaggcctacaccttctccctgcgcggcaaagttgtcgaagcctaaaccctcacgccgaaaaaatgccgtctgaagcgtttcagacggcattttgccttgtatcggcagacgacggcgcggccgggcggcttaatttgccgcatcccgatccgacagccacgcgcgcacacgccgttccaccgcttcggcactcaagcccaaatcgtctaaaagttttttcggatcgccgtgtccggttacggtatcggcaacgcccaaaagcaaaacgggtttgcagatgccgtgtttcgccaatacttccagcaccgcgccgcctgcgccgccctgttcggcgttttcttcaagggtaacgatgcggtcgtggcttcgggcaaggcggacaatcaactcttcgtctatcggtttgacgaagcgcatatcggcgacggtggcgttcagtttttcggcaaccgccaatgcgggggcgaccatactgccgaaggcaatgaatgcggttttctcaccttcgcggcggataatgcccttgccgatttccacggtttccatgccgtctgaaaccggcgcgcccgtacccgtgccgcgcggatagcggacggcggcgggcgcgtctgcctgatagcaggtcgaaagcaacaggcggcattcgttttcatcgctcggcgcggcgacaatcatgttcggcacgcagcgcaaaaagctcaaatcgtacagaccggcatgggtcgggccgtccgcgccgacgatgcccgcgcggtcgacggcaaacaaaacgggtaggttttgcagggcgatgtcgtgcaccagttggtcgtaggcgcgttgtaaaaaggtggaataaatcgccacgacgggcttcatcccttcgcaagccaaaccgccggcaaaggtaacggcgtgctgctcggcgatgccgacatcgaaatagcggtcggggaatcgttgttcaaactcaaccaagccgctgccctcgcgcatggcgggggtaatcgcaaccagtcgggaatctgccgccgcccggtcgcacagccatttgccgaacacttgggtataggtcggtttggcggcgggcttgggttctttttcagacggcatttgcgccgcgctttctttaggcaggttggcgacggcgtggtatttgacggggtcgttttcggcgagtttgtagccgttgccctttttggtgatgacgtgcagcaactgagggcctttgcggctgcgcaagtctttcaatacgtccaccagattttcgacgttgtgtccgtccacggggccggtgtagcggaagccgaagttttcaaacaaagacagcgactgtttggcgtgttcggcttcttcggcaagggttttgattttgtgttcgactttttgggcaaactccatcgcgccgggtattttgtctaataccttgcccgtttgcgctttgacggtactcaacaggccgtgcatatcgcgcacgacgttgctggcaaggtatttcggcagcgcgccgacgttgggggaaatcgacatttcgttgtcgttgaggacgaccagcaaatccacatccatatcgcctgcgcaattcaaggcttcaaacgcctgccccgccgtcatcgcgccgtcgccgatgatggcgacgctgcggcggtcgctgcccaagagtttgtctgccgccgccatgcccaacgccgcgccgatggaggtggaggaatgccccacgccgaacgcgtcgtactcggactcgcaacgtttcggaaaacccgccaaaccgccatattggcgcatggtgtgcatctggtttttcctgcctgtcaggattttgtgcggatagctttggtgtccgacatcccacaccagcttgtcttcgggcgtgtcgtacacatagtgcagggcgatggtcagttcgaccgcgcccaaattgctggcgaaatgcccgccggtctgcccgacagattccagcagaaaggtgcgcaactcgccggcaaggcgcggcagctgttttttgtccagacggcgcaaatcttgcgggctgtcaatcaggtcgagtagggggcttgggttcatggtgtgtcttttttatgtgtcgtccgggtgcaacggtcaattatatatcaagagcgtgcggctgacggctgattttgccgtatgtcattcgtcctgccgcttggcgcgcgggtgggcttcgtcatacaggcgggcgatgtggtcgaaatcgagcttggtataaatctgcgtggtcgaaaggctgctgtgcccgagcagctcctgcaccgccctgatgtcgcgcgaagcctgcaataggtgtccggcgtagctgtggcgcatcatatgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgcttgcgccctttgccgataacgtgtacccacgcctcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcggccggacagccggcgtaatgcctgtacgaagtcgccgcgagtgcaatttgaagggtttgcagacggcatttcttccagaagggcaagcagttcctgcaagtcgcgccggtatgcggcaaccgtgtgctccgatttaccctcgcgcacgatattttccaaataagcgtccaagtatgccgcaagtccgtccaaacccattcccacacctaaaataacattagaaacattatcataaatcggaatatccgaatcccgaaacgtcaaaacccgacaaacctgcatactggcatcgttaatataaaatcaatgagctgtttatggttttttgctgtaaaaaacattataatccgccttatttacctattgcccaaggagacacaaatggcactcgtatccatgcgccaactgcttgatcatgctgccgaaaacagctacggcctgccggcgttcaacgtcaacaacctcgaacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagaatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgaagcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacttgcgccttgcttctaccggcgcggtacgccgctaccttgccgaaaatccgtccgactttgacccgcgcaaatacctgagcaaaaccattgaggccatgaagcaaatctgcctcgaccgttatcttgcgtttggctgcgaaggtcaggcaggcaaaatcaaacctgtttcgttggaaaaaatggcaagccgttatgccaagggcgaattgaaccaaatcgtcaaataacaggttgcctgtaaacaaaatgccgtctgaaccgccgttcggacgacatttgatttttgcttctttgacctgcctcattgatgcggtatgcaaaaaaagataccataaccaaaatgtttatatattatctattctgcgtatgactaggagtaaacctgtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataaccattgtgaaaatgccgtccgaacacgataatttaccgttcggacggcattttgtattgcaccgtccgacggcatgcccaaggggggaaatccctattttcaggccaaccgctatataatgccgtctgaaccaacgagagaatgccatgcaagctgattttaaccgtcccgtcctggccgtcgataccggtacttcccgtttgtcgctcgcgctgcgtgccgacggcgaaacccgtctgttccatcaggaagtcggcagccgccagtccgaactgattctgccggaaatccgcaccctattccgcgatgcaggcattaccgccgccgatttgggtgcggtcgtgtacgcacagggtcccggcgcgtttaccggactgcgtatcggcatcggtgtagctcagggtttggcaacgccgtttgatacccccttaatcggcgtaccctcgctcgatgccgccgcctcgctgccgccgccgcaaagctgcatccttgccgctacggacgctcgtatgggcgaagtgttttatgcatggttcgatacgctgaactgccaccgtttgagcgattatcaggtcgggcgggcggcagacatccggctgccggagggatgcgccttttcagacggcataggcagcgcgttcgcgctggaagaagctccgccgttctcaggcagaccggatatgccgactgccgccgactttctcgcattggcagccaagggcggttatcctgccgtccatgccgcacacgccggtttgctctacgtccgcaacaaaatcgccctgactgccaaagaacaggccgaacggagagcgcgcccgtgaacatccgccgtgccgtttgtgccgattgtgaggagctggccgcactcgatgccgtctgcaacccgtccgcatggacgcaacgccaatttgagtccgcactggtttcgccgtccgaacaggttttccttgcggaaaaagacggcgggattgccgcctttatcgtttggcagaacctgcccgacgaatccgaactgcacctgattgccaccgcgcccgaatgccgccgccaaggaattgcgtccgccctgctcgaatattggttcacacatctgcccgaagacacgcaacgcctgctgctcgaagtccgtgcaggcaacaccgccgcacaggcactgtacacggcgcacggcttcagcattacgggcaggcggaaaaactattaccgtacagccgacggtaaaaccgaagatgccgtcttaatggagaaaatatgttaagcgcgcgctacctccacctgcacgaagctttgggtttgggtccgatgtggctgaaacaggccgccgccgtcctgccgcccaaaaacacacccgcaccctcggcacaggcacgtccccaaaccgtccgcgccgccccgatccgcccttcccaaccccataacggtcaggcgcggctcgaaacgatgaaagcgttggaaaccgccgccgtacctacgcgcaaacccgcgcctgaaaccgaaacgcctctgcccggcctttcagacggcatcgcccccgttcccgccgcttcgggcatcaccaagcttgccgtcgtcagcctttgcccaccgatcgaggatgcggtttacgggcaactgttccacggcaaagcaggcatcctgctcgacaacatactcaaagccgtaggactggatgccgcctatgtccacaaaacctgttgggtgaaaaccgccgccgtcggcaacccgatgccgtctgaacaggccgtcgcgaatgcgctgggtcaaatcgcccgcgaactcgacggctgccgcgccccggctgtccttttcctcgggcaggcttttgtccagcctgaacggcaaacgatgattgaaactttgtgcggcagccgtcccttcttcatcatcgaccatcccgcccggcttttacgccaacccgaactcaaagcccgcgcctggcaggtgttgaaacagttgaaacgcgccttgcggcaaggcggcggcagttgaagcgcgccgcacggggcggtagaatcgcaactgcgtcccaatatctgacagaaagcacaaaatgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaaaaacaatacggtctgcccgtcgcccccatcgccagcctgaacgatttgtttattctgttgcaaaacaaccccgaattcggacagttcctcgaacccgtccgagcctaccgtcggcagtacggcgtagaataaaaacaaagcatatgccgtccgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggactgtttaaagccaaagaccatctggcaagcacgaaagaacccatattcaacgatttgcccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctgaccgcaacggaaagccgccgcagaaatgccgtctgaaccccgtttcagacggcatttccccgattatatagtggattaaatttaaatcaggacaaggcgacgaagccgcagacagtacaaatagtacggcaaggcgaggcaacgctgtactggtttaaatttaatccactataaagacctgcccaaccctcaaggaccccgatgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaagggcgggggagcggcactgccgccgcgaatgaaaaaaggtcgtctgaaactgctttttcagacgaccttttttaatggttgtttcaaatcaaaatatctatgccgccggccccatcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataatcgggcggagagttccagcgcggcggcttcgtcggcaagcaggccgaagccgtccgattcgaacgggcgttgcagcagtgggcaggccgccgccgtcagtgccgctgcgttttgcgccagccgttgcagggcgaatcggcctattgtttgcggcgaaaacaggcgttcgtccagcaagccttcgtcgtgccagcggcgcagtttttccagcgaaaaatccaaatgcagcgcgcacatgccgctgttgtcgggcagcagggtttcggatacgtccgccaaatcgccgcgtaccagtcagatttcgccggcagatgggcggtattccctgccgcccatttgtaaccggttctgccccgacaccatgacgaacaaggcgcagttgtggctgaaattgtggatttcggtgggaaacgcgcccgttccgccgccgcgcatccgcgacaaggtgatgcccgaatcgaagcggttgatgcacatttccagatgcaaaccgggctgttttgcctgcgcaatgagcgcgctgtcggaacagccgtccaacgcccagccggatttatcggagcggacataggtttggtactggcggtagatggcggcggtgttcatgattggataggaacgagttgtctaacaaatgaattaaataggaattattaccaataatcaagcgcagggattggttgaaacggaaaaggtcgtctgaaagggtgtttcagacgaccttttccgtatcgggaatttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtagggagtcgtctgaaaacggagcttccgaaggaagcggggggtttctgcgaagctaaagtgcggtttcaacgaattgaaaagcagcctgtatgttgaaaataccgctcaagcaaacctacggtttgccgccctctccctagccctctcccacagggagaggggattgggttgcaggctgcctttaaggtttaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgctttcacaaagcctgtgtgcactgaaaactgaaaggtcgtctgaaaacggagctttcgaaggaagcagagtttctgcgaagctaaaaccgaagctgcaaaaaatcgaaaagcagcctgcacgttgaaaatgccgcccaagcaaacctgcggtttgccgccctctcccacagggagaggggattggggtgcaggctgtctttaaggttcaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgcttccgttacaactccgcccactgaaagcagcctgcaacgaagccaaaacgacaaaccgcatcgtaaaccacccaacccataggagaaccccatgcaaaacgaaaccatcaacctgaaacagcaccttgccgccatcaaagaatactggcagcccgaaatcatcaaccgccacgggttccaattccacttggtcaaacttttgggcgattacggctggcatacgcacggatacagcgacaaagtgctgtttgccgtggagggcgacatggcggtggacttcgccgacggcggcagcatgacgatacgcgagggcgagatggcggtcgtgccgaagtcggtgtcgcaccgcccgcgttcggaaaacggctgctcgttggtgctgattgagttgtccgacccgtccgaggccgtctgaaaacgaagtttccgaaggaagctgagtttctgcgaagctaaaagcagcctgcaccttcaatcaatatgccgaaaatacaaccccaccgcacaccaacacacaaaggaaatcccatgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataaggtcgtctgaaaacggagtttctgcgaagctatagtggattaacaaaaaccagtacggtgttgcctcgccttagctcaaagagaacgattctctaaggtgctcaagcaccaagtgaatcggttccgtactatttgtactgtctgcggcttcgtcgccttgtcctgatttttgttaatccactataaaagcagcctgcacattgaaaatgccgcccaagcaaactttcagtttgcccgcctcgtcctagccctctcccacgggagaggggattggggtgcaggctgcctttaaggttcaggcaaattttaacttcgttgataccgcgctttagcttcgcagaagctgcactttcagacgaccttttggaacaccacaggtacacgcatttaaggaatgccgtctgaaatgcctgcctcaataacgcatcatgttgccgtcaatctcggccgcccatgcatcgatgccgccctgaaggttgtacaggttttcaaaacccgcgtccgccaaatacatcgccgtatgcaggctgcggataccgtggtggcaatacaccacaagcggcacatcatccggcagctcgttctgccgcagcggaatcagattcatcgggatatgcagcgcatttggcagcgaacaaaccgccgtttcttcatccgtacgcacgtccaacaaacaaaacatccgcccttcgtccatccacgctttcaattccgcgggcccaagttgcacaatatccatcgcaccccccaaaaaaaaccaagcaaaatgccgtctgaagccccaaacccgctttcagacggcatgacctgtcaacatcttaaaaatcgaaaccgccaaacggatcggcatccttatcatccaaatgcgccaccaaggtatcgaacagcaccttctcttcaaacacatcgcccctgcgcgtaatcaaaagcgcgcgttgaacaggcttgcgacctacgataaccaccatgcgtccgccatctttcaactgttctttcaacacttcaggcacaaggtttaccgcaccgccgacataaaccgcatcaaacggcgcacctgcggaaagttcggtcaacccgttgttttgcacataatcgatattgtccaaacccaagccgtccaacaccgctttggcgcggttttgctgttcgacatcgatgtcgtccgacaccacacgaccagccaattttgccaacagcgcggtcgcatagcccgaacccgtgccgatttccaaaaccgtatcgtttttcgtcagcttcaagccctgcgccagccgcgccacgactttcggctcgagcatcttatgaccgttggcaagcggcagcgccatatccgcatacgccaaaccctgcaagtcctcatcgacaaaaagctcgcgcggaatctccgccaaagcgtccaacacatcaaaatccaatacatcccacggacggatttgctgttcgaccatattgaaccgcgctttttcaaaatccatttagtgctccgtcaaataattgttccaacaatggcaggcattataaaaccacactcccgccgcgccaacttcggcacgcgccgacagcccgttttgtcagtctcaaaccgcctgacgcgaagcctcaaaccgcttctccaaaatcttcgccagttcgcccaaatacaaagcatccgtctcatcaaactgcgccaaatgttcgctgtccgcgtccaacacgccgatacagcggccgtctgaaaacagcggcacgacaatctccgaacgtgacaaagacgaacaggcaatatggtcgggatgcgcgttgacatccttaacaaccaccgtttcacccttcgcccaagcctgaccgcacaccccgcgaccgaacggaatccgcgtacacgccaaaggcccctgaaacggtgccaaaaccaattcgtccgaacgcgtatcgaccaaataaaaacccacccaaaaccaaccgaacgcctccttcaaaaccgccgccgtgttcgccaaattcgccacccaatccgcctcgtcagccaccacagactcaatctgcggcaacacctcccgataaagcgcggccttgtccgaagccgaaaaatgaagcgcgtgcatcacatctcctatagttgcatacatatcaggcggccattataaaacagcctgcccgaaacaacattccaaaccgcccggccggccgcttcaagttgcgaacccgccgcatatccactaaacttcacgttgcaccgcgccacacgcggcagacaaaaaaacacgacacggagcaaaaaagatgtatcgccaaatcggaatgtgggatcaaaaatgggtcatcggcaactggaaaatgaacggccggctccaaaacaacaacgcactgatgcaccgcttccgcatccaccccaccgccgaacgcgtcctcatcggactcgccgccccgaccgtttacctgctgcaactgcacaacgccatgcaaatcgttttaaacaaccgcatcctcacctgcgcccaagacgtgagccgcttccccaataacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaagggctggataccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacgcgcaactcgtcggcggcgcttcattgtcgtacgactcctttaccgccatcatcagtcccgcacaaaatgcgtagaaaattatggaacccttcaaaaccttaatttggattgttaatttaatttccgctttggccgtcttcgtgttagtattgctccaacacggcaaaggcgcggatgccggcgcgactttcggat

SEQ ID NO: 37779 - DNA, 4927 bp, Neisseria meningitidis
  misc_feature (904)..(904): N is any nucleotide
catcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcgcactaatcggacgtttcgatgtcgatttgtttgaagaatttttccacggcatcgtcaaccacagtatgatgaccctgcacatcgacaacctcagcggcaaaaacgcccaccatcaggcggaaaccgtattcaaagccttcgggcgcgccctgcgtatggcagtcgaacacgacccgcgcatggcaggacagaccccctcgaccaaaggcacgctgaccgcataaaaaaccataccgtctgaaacacccgcaggcttttcagacggtatcggaacagataagattacactacactacaaacagaaaaggagtaaacatcatgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcagncggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaakcgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactgattgccttttccaaacacaatgccgtctgaacatatttcagacggcatttttatcaccccacgcttaaaatcagtcccgattatgactatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatccgcacaaatttagtcaatatcaagaccaattatgaaccaactcgaccaacttggcacccgtatcaacctgatttgcaatgtcttcgacaaatggatcgggcagcaggatctgaattacaacctctttgccgtactttataccctggcaaccgaaggcagccgcacgcaaaagcatatcggcgaaaagtggagcctgcccaaacagaccgtttcaggcgtatgcaaaacccttgccggacaagggttgattgaatggcaggaaggcgaacaggaccggcgcaaacggttgctgtcgttgaccgaaacaggcaaagcctatgccgcacctttaacagaaagcgcgcaggaattcagcgacaaagtatttgccacattcggcgacaagcgcacaactcggctgtttgccgatttggatgcactggctgaagtgatggaaaaaacaatctcggaaaataaaaaataggggggcaaatatgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttgaaaaatgccgtctgaacacgcttcagacggcatttccatccgttcggcaaactacatcacatccgcccgccggttgacaagtttggcaaacaacttttcaacagaagcttccgcctgcaaaccaatgcgctggatcaggctttgcttctcctgatatttcacttcgataacctgtttgttttcaaacgctttcaacaacaaatcatcactggtcgaaatctcgtcaatcaagttcaacgccaacgcctgccgaccgaaccaatgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaaaaagaatgcttcaaacgattgccgctgttttttataattttccgaaaaatccgtcagtacgacactgccgctttccgactgtttcttactctgtacgatagccaacacaatcagcgcaattgcgccgaacacggtaagcagttcgagcaggaaaataccgtaattcagtaaaatttctttccacattgattggatttcctcttgttcaggcatgaacatgtcaatattgtccatcaccgtccgacagataaaaaaataaccgcttggagcggcattgtcattttcagcttggtgcccggagccggaatcgaaccggcacgggatgtttagtcccgacggattttaagtccgttgtgtctacctatttcaccacccgggcatttgtgaaaggtggaggcgggggcgcggattttaaccggcctgtatgaagattgcactcctcatagcataaacactctgccaccccgccatagtacgataatggaggcgagagtcggaatcgaaccggcgtagacggatttgcaatccgctgcataaccactttgctatctcgccctaaaactggcttatctaaaaaacttggagcgggaaacgagtctcgaactcgcgacctcaaccttggcaaggttgcgctctaccaactgagctattcccgcgcgttcaaacatatcggtttttggagcgggaaacgagtctcgaactcgcgacctcaaccttggcaaggttgcgctctaccaactgagctattcccgcgttgatatgtttgaaataaaacttggagcgggaaacgagtctcgaactcgcgacctcaaccttggcaaggttgcgctctaccaactgagctattcccgcaatgattgcggaagaatgaaatttttggagcgggaaacgagtctcgaactcgcgacctcaaccttggcaaggttgcgctctaccaactgagctattcccgcccgatttcattctccgatatcgaagagacacaattatt

SEQ ID NO: 37780 - DNA, 25509 bp, Neisseria meningitidis
gttctgcctgtatgattagcgtttatttgatttgctttctcatttggatatgaaattcgtcagcgaccttttgtccgtcatcctgtttttcgccacctataccgttaccaaaaacatgattgccgcaacggcggtcgcattggttgccggtgtggttcaggcggcttttctgtattggaaatataaaaagctggatacgatgcagtgggtcggattggtgctgattgtggtattcggcggcgcaaccattgttttgggcgacagccgcttcattatgtggaagccgagcgttttgttttggctgggcgcgctgttcctgtggggcagccacctcgccggtaaaaacggcttgaaggcgagtatcggcagggagattcagcttccggatgccgtatgggcgaaattgacgtatatgtgggtcggtttcctgatttttatgggtatcgccaactggtttgtgtttacccggttcgagtcgcaatgggtcaactataaaatgttcggctcgactgcactgatgcttgttttctttattattcagggtatttatctgagtacctgtctgaaaaaggaggattgactgtggaatattttatgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataatgccggccgtcgatttgatccgcgaacgcctgcagacgctcgatccgctggtgttggaaatcggcgatgagagccatctgcacaaaggacacgcgggcaataccggcggcggacattatgccgttttggtcgttagcggccgttttgaaggcgtaagccgcctgaaccgccagaaaacggtcaaatcgctgctcaaagatttgttttcaggcggcatgattcacgcgctcggcatccgggcggctacccctgacgagtatttccatacggcggactgaatgaagtctgcccgaacatttcaatttaaaatttaaagagagaagattatgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataattctgaaaacgggatatggcggcaagacgttcagacaggcgttttgccgccgcgcaggacagggaataccatgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaatggcatttccaataccgatgccgtctgaagcctttcagacggcattgcacgttcaggtaaggaggacggcttatgcgtgcggtcatacagaaaacggtaggtgcaaaggtggatgtcgtgtccgaagccggcacggaaacctgtggcaaaatcgacggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcaggtgtcgctctgcaacgatgggccggtaaccatactgctggactctttcatgacgcggatttccccaaaaatgaaggttgttccggattgaaattgaatccgcaatgataaaatatcgacaatgaacgacaatacacacacccttcccccgcgccacctgtccgtcgcccccatgctcgactggacggacaggcactaccgttaccttgcccgccagattacccgaaatacttggctgtacagcgaaatggtcaatgccggtgcgattgtttacggcgacaaagaccgctttttgatgttcaacgaaggcgagcagcccgtcgccctgcaactgggcggcagcgatccgtccgatttggcgaaagccgccaaagccgccgaggcatacggttacaacgaggtcaacctcaactgcggctgccccagtccgcgcgtgcagaaaggctcgttcggcgcgtgtctgatgaacgaagtcgggctggttgccgactgcctcaacgccatgcaggatgcggtcaagattcccgttaccgtcaaacaccgcatcggtgtggacaggcagaccgaataccaaaccgttgccgatttcgtcggcacgctgcgcgacaaaaccgcctgcaaaacctttatcgtccacgcccgcaacgcttggctggacggtctttcccccaaagaaaaccgcgacgttcccccgttgaaatacgattacgtttaccgcctcaagcaggagtttcccgggctggaaatcatcatcaacggcggcatcaccaccaacgaagcaatcgcaggacacctgcaacacgttgacggcgtgatggtcgggcgcgaggcgtaccacaacccgatggtgatgcgcgaatgggacaggctgttttacggcgatacccgcagcccgattgaatacgccgatttggtgcagcgtctctacacatacagccaagcccaaatccaagccggacgcggcacaatcttgcgtcacatcgtccgccacagccttgggctgatgcacggtctgaaaggcgcgcggacttggcggcgtatgctttccgacgcaacgctcttgaaagacaacgacggcagcctgattctcgaagcgtggaaagaggtcgaacgggcaaatatgcgcgaatagggcggggctgtatgtgtgaaatgccgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggaggagttgttcgcggcggtttaaatccaatgcgggggcgagcgtctgtttcgaccatttctgcccttgtgcgttggtcagcagcggcaggtgggcatattgcggtgtcggaacgtccaaacactgctgcaaatagatttggcgcggcgtggaaacgagcaggtcttgtccgcggacgatgtgggtaacgccctgttcggcatcgtcggcaacgacggcgagctggtatgcccagtaaccgtctgcacgaagcaggacgaaatcgccgatgtcgcgggcgaggttttgggcgtaaccgccgacgatgccgtctgaaaaaccgataatgcggtcggggacgcggatgcgccacgccggctgtttgccttgcagtgcagggcgttggccggggtggcggcaacgtccgttatagacgaacccgtctgcgccccgccttgccccggcctgccagtctttgcggctgcaatggcagggatagaccagtccggcggttttcaggcggcatagggtttcttcatacagggcgtaacggcggctctgataggcgacttctccgtcccactcgaatccgaatgcctcaagcgtgtgcaggatatggcttgccgcccccggcatttcgcgcggcggatcgaggtcttccatgcggatcagccatttgccgccgtgcgcgcgcgcatcggcataggaagcgacggcggtcagcagcgagccgatgtggagcagcccggtcgggctgggggcaaaacgtcctgtgtacatatctggtacagcccctttatttaagactattaatcaaagccattatctcatctttattcagttccatcccgggctcttcaagcaaggttaaatcatatagggcattatattgctcttcggtagctgaaccatccataagagcaggcgagaaaaaatcaaaggctctatctgcaattctctcattacttgcatttctactaaccagtttcgtcaattctgtatattttgaaaagtttatggaaaaataaaacagcgaaaaagttttggtttcgctgtttttgatttaattagcactgataatcttcaaattcccacgaaaaaaaacgaagtaaataagtcaatgacttttcccaagtttcttttgaacattctttaagaattttctcaatttccgatttaataacagaatgattaaattcattcataatcatcatacccgccccccatttaaccctttgattttggaaacaattatgcaaaatccatttaggagagcatatgcgaacagaaaatatatctgcagcatcactatcatcagttcctatgtctaaatcaattcccacacaaaaattgtctttgatttcgggaacgaaatcttcaaaggcacaatcgtaaagattgatggctttcaattctaggttaatcattttatattcaatagtatggggaggtaccggatccttaaaaatcagatctgaataaatttcattgggtgaaatgatttcgattgcttttgccatgattctatttccttttgtgttagtgggtaatgtcgtgcattaacttcttgcccattaatatttttagggtgaatccttgatatgccgcactgtgtccggtcaaacgggcgatgccgtctgaaagcctttcagacggcatcgggaaaatgcctaagccaaaggcgcgagcagtttttcaaacgcttcttcaaactgtttcaaaccgtcttcctgcaaacgcgttgccaaggtttcgacatcgatgccgagcgcggcggtttcggcgagctgcgcttgtgcttcttctacgccttcggtcagcgtggctttggctgtgccgtggtcgataaaggctttgagcgtggcatcgggaacggtgttgacggtgtgcgcgccgatcaggctgtcaacgtagagcgtgtcgggataggccgggtttttcacgccggtagatgcccataaaagctgcacgcggtttgcgcctttggtttccagcgcggcaaattcggggctgccgaagtattgcgcccagtcttggtaggcggctttggcaagggcgatggcgattttgcctttgaggtggtcgggcagtgttgtgtccagcgcgccgtccacacgggagatgaagaagctggcgacaacttggatatgggcaacgctttgtccggctgctaagcgtttggcgatgccgcgcgcgtaggcggcgtaggctttgagggtttgggcgcgtgagaacagcagggtcaggttcacgctgatgccgtctgaaacgagggtttcgagcgcatcgatgcctgcgtcggtggcaggcactttaatcatcgcgtttttgcacccgatggcggcgtagaggcggcgcgcttcttcaaccgtgccttgcgcgtctttggacaattcgggcgaaacttcgaggctgacgaagccggttttgccgccggtggattcgtgttcggcaaggcaaacgtcgcaggcggcacgcacatcggcaaccgccattgtttcgtagcgttgtttggggctgaggttttgctgcttgagggcggcgatttcatcggcgtaaagcgcgtcgccggcgaaggctttttggaagatggcgggattggaagttacgccgcacacgccctgtttcaacatttgcgccaattcgccgctttgcactagcgagcgggaaaggttgtccagccagatttgttgtcctaatgctttaacgtccgataaaatggtcatctctgattcctttggatggataggcggggtttgagggcttatgctaccccgattcggaaattttgggtagttttattacagcaaaggcggatggcaatggcagaaaacggaaaatatctcgactgggcacgcgaagtgttgcacgccgaagcggaaggcttgcgcgaaattgcagcggaattggacaaaaacttcgtccttgcggcagacgcgttgttgcactgcaagggcagggtcgttatcacgggcatgggcaagtcgggacatatcgggcgcaaaatggcggcaactatggcctcgaccggcacgcctgcgtttttcgtccaccctgcggaagcggcacacggcgatttgggtatgattgtggacaacgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatataaggcgttgcagccgtttcagacggcatttgtggtaagatatgccgtctgaaaacaaggaaatcccatgcaggcaatttctcccgaattacaggcgcgcgccgccaaaatcaaactgttgatcctggatgtggacggcgttttgaccgacgggcgcatctttatccgcgataacggcgaagaaatcaaatcgtttcacacactggacggacacggtctgaaaatgcttcaggcaagcggcgtgcagactgcgattatcacgggccgggacgcgccctccgtcggcatccgcgtcaaacagttgggcataaattactatttcaaaggtatcagcgacaaacgtgccgcctatgaagaattgcgcgcgcaggcgggcgtggaagaagccgagtgcgcctttgtcggcgacgacgtggtcgatttgccggtaatggtgcgctgcggattgccggttgccgtccccggcgcgcattggtttacgcggcaacacgccgcctatatcacggaacacgcgggcggcgcaggcgcggtgcgcgaagtgtgcgacctgattatgcaggcgcaagggactttgggcgcggctttgaacgagtacatcaaatgaaagtaagatggcggtacggaattgcgttcccattgatattggcggttgccttgggcagcctgtcggcatggttgggtcgtatcagcgaagtcgagattgaagaagtcaggctcaatcccgacgaaccgcaatacacaatggacggcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaaaatgccgtctgaaatataaacccggttcggacggcatatgccgaccgaagatattgaagagatatttatgagtgcaaacgtcagccgccttgttgttcaaaacctgcaaaaaagtttcaaaaaacgccaagtcgttaaaagcttctccctcgaaatcgaaagcggcgaagtcatcggactgctcgggcccaacggtgcgggtaaaaccaccagcttctacatgattgtcggactcatcgccgccgacgcaggcagcgtaaccctagacggacaagaattgcgccacctgcccatacacgaacgcgcccgcctcggtgtcggctacctgccgcaggaagcctcgatattccgcaaaatgaccgtcgaacaaaacatccgcgccatcttggaaatcagaaccaaagataaaaatcaaatcgacagggaaatcgaaaaactgctcgccgacctcaatatcggacacttacgccgcagccccgcgccgtcgctgtccggcggcgaacggcggcgcgtcgaaatcgcccgcgtactcgccatgaaaccgcattttattttgttggacgaaccttttgccggcgtcgatccgattgccgtcatcgacatccagaaaatcatcggtttcctcaaatcgcgcggtatcggcgtactgattaccgaccacaacgtacgcgaaaccctcagcatctgcgatcgggcctacattatttcagacggcacggtgttggcatcgggaaaacctgatgatttggtcggaaacgaacaggttcgttctgtttatctgggtaagaacttcaaatattgaaaatatttttcagacgggcgacctaatatcgtcgggcaggcggcaaaaatacggatttatgttgtttttacataaattaattcaaatttaaaacattgacttaaacctgttttcaaagaatattgcccgatatgcttgcatgtcgtcccgtaatttggtttaatacgcatctcttaacgagacagacaaaggccagatagctcagttggtagagcaacggattgaaaatccgtgtgtcggcggttcgattccgcctctggccaccaaaaaaccgccttgaagcggttattttttttgcctgccgtttttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgcctgctgtttggtcagcttggcggcgggtatttgataaaaataccgggacgcggcttccgcgccgaaaacgccgtagtgccattcgattgagtttaaatacagttcaaaaatcctgtctttgtcggtaacggcttccatcatcgcggtaatcgccgcttcttcgcctttgcggatatagctgcggctttcgtttaaaaacaggtttttggcaagctgctggctgatggtcgagccgcccgccttcactttgccgctgttccggttgcgcctgatggcgttttgaatgccgccccaatcgaagccgccgtgcccggcgaaacgggcatcttcggaagcaatcagggcttttttcaggttggtggaaatgcgtttgtagggcatccagcggtaatccagtgcgacatcgcgaccttcctgttcaaactgcttcatccgcatcgacataaaggcagtccgatggggcgcgacggcgcggtaggtaatgatgttgccgtacacataggcattgaaaaagataaagatgccgacgggcagggcaatcagccatttgatgatgcggaacatgtttatagggctttcatgtattcgataacggggcggatatcgggcgtaaatccgcgccagagggcgtaggaagccgccgcttgaccgactagcatacccagtccgtcggcagtttttttcgcacccgattgtcgtgcaaaatctaaaaacggttttgccgcgcagccgtacaccatatcgtaggcaagcgcgcagttttgaaaaatatcgggcggaatatcgggaatctgaccgtttagaccgcccgacgtgccgttgatgatgatatcaaaaccgccgttcacgtccgccatcgggacggcttcaatgccgaaaagctgcgccaattcctcggctttggcgcgggtacggttggcaatgacgatacgggcaggacggtgttctttcaaaacaggaatcacgccgcgcaccgcgccgcctgcgcccaaaagcaaaatggttttgccctcgatggcaatatttttgacctgcgtgatgtcgttggtcaaaccgataccgtcggtgttgtcgccacgcagcttgccgtttttcaacggaatcagcgtattgaccgcacctgccgccaatgcgcgttcggaatgctcgtccgccagatgaaacgcttcctgtttgaacggtacggtaacgtttgccccgcaaccgcctgtttcaaaaaatgtcgaaaccgcctgcgcgaaaccgccgatgtcggcgcaaatgcgttcgtattcaatgtcaacgccttcctgaagggcaaattgttgatgaatttgcggcgatttgctgtgggcgacggggttgccgaaaacggcgtagcgggggagggcggtcatggtcgtgttccaaaagacgggaaggctattttataacggcggcgtacagatggaaacgatgccgtctgaaaccgccttcagacggcatcgtttcctgtatcggtcgggaaaaatccggatgcggtgcgccggcttgtccgcattgttgacaatcttgccgtctgaaactatattttccggcttgaaatttgacgcaaaaccggtttcagacggcatcggcgtggtaaaatcgtgccgactttgcgtcaagccgccgcgttccgcatattttgctatttcccttttccaggagctgaaaaatgtctattaaaaacgccgtaaaattgattgaagaaagcgaagcccgctttgtcgatttgcgctttaccgataccaaaggcaagcagcaccactttaccgtgcctgcgcgcatcgtgttggaagaccccgaagagtggttcgaaaacggtcaggcgtttgacggttcgtctatcggcggctggaaaggcattcaggcttccgatatgcagttgcgccccgatgcgtctacagccttcgtcgatcctttttatgatgatgcgactgttgtgttgacttgcgacgttatcgatcccgccgacggtcagggttacgaccgcgacccgcgctccatcgcccgccgagccgaagcctatttgaaatcttccggcatcggcgagaccgcctatttcggtcccgaacccgagtttttcgtattcgacggcatagaatttgaaaccgatatgcacaaaacccgttacgaaatcacgtccgaaagcggcgcgtgggcaagcggtctgcatatggacggtcaaaacaccggccaccgcccgaccgtcaaaggcggttacgcacctgttgcaccgattgactgcggtcaggatttgcgttcggcgatggtaaacattttggaagaactcggtattgaagtggaagtgcaccacagcgaagtcggcaccggcagccaaatggaaatcggcacgcgctttgctactttggtcaaacgcgccgaccaaacccaagacatgaaatatgtgattcaaaacgttgcccacaacttcggcaaaaccgccactttcatgcccaaacccattatgggcgacaacggcagcggtatgcacgttcaccaatccatttggaaagacggtcaaaacctgttcgcaggcgacggctatgccggcttgagcgacaccgcgctctactacatcggcggcatcatcaaacacgccaaagccttgaacgcgattaccaatccgtccaccaactcctacaaacgcctcgtgccgcactttgaagcgccgaccaaactggcatactccgccaaaaaccgttccgcttccatccgcattccgtccgtgaacagcagcaaggcgcgccgcatcgaagcgcgtttccccgatccgaccgccaacccgtatttggcatttgccgccctgttgatggcgggtttggacggcattcaaaacaaaatccatccgggcgaccctgccgataaaaacctgtacgatctgccgccggaagaagatgcattggtgccgaccgtttgcgcttctttggaagaagcactggccgccctcaaagccgaccacgaattcctcctgcgcggcggcgtgttcagcaaagactggatcgacagctacatcgctttcaaagaagaagacgtacgccgcatccgcatggcgccgcacccgctggaatttgaaatgtattacagcctgtaagcacgtctggttttcagaaaagcaatgccgtctgaacacagtttcagacggcattttgcatttgaacggcaaaccggcggcgcggggcggcatttttcagcaggcgggcgatatttgctacaataggcttttgttttttttgggctgcacgaacgatgactgcatcgaaatcaggttttatcgggcaaatcttttcccgcaatatgcttgtctgtatttttacggggtttacctcggggctgccgctgtactttctgattaacctgattccggcgtggttgcgcagcgagcaggtggatttgaagagcatcgggctgatggcgttaatcggtctgccgtttacttggaaatttttgtggtcgccgctgatggacgcggtcaggctgcccgttttgggacggcggcgcgggtggatgctgctgacgcaggcagggttgctggcggctttggcggtctatgcctttttaaacccccgtaatcatctgccgctgattgccggcttgtcggtgcttgtcgcttttttttccgccagtcaggatattgtattggatgcgttcaggcgcgagattttgtcagacgaagaattgggtttgggcaactcggttcatgtgaacgcctaccggattgccgccctgattcccggttcattgagtttggtgttggcagacaggatgccgtggttagaagtatttgttatcacttcattatttatgctgcccggccttctgatgacgctgtttcttgcgcgcgaacccgtgttgcctcctgccgttcctaaaacgttgaagcagaccgtggtagagccgtttaaagaattttttacgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgcgaaaaatgcaggactgtggccggcagtggcggcaggtatcttgggcggtgtgtggatgctgaaaatcggcgtaaacaaagccttgtggctattcggcgcggtgcaggctgtaaccgttttggggtttgtatggctggcagggttcggacctttcgacacggtcggcacaggcgagaggctgatgctggcggcagttatcggcgcggaagcggtcggcgtggggttggggacggcggcgttcgtatcgtatatggcgcgtgaaaccaatcccgcatttaccgcaacgcagcttgcgctgtttaccagcctgtccgccgtcccgcgcacggtcatcaattcctttgccggttatctgattgaatggctcggttatgtaccgtttttccaactgtgtttcgcactcgccctaccgggtatgctgctgctgctgaaagttgcgccttggaacggggagaaaactcaggatgcaggcagatgaacgcgtcaaactggagcgtttacctgatattgtgtgaaaacagcgcgttctattgcggcatcagcccgaatccgcaacagcggcttgccgcccacacaaccggtaaaggcgcgaaatatacccgcgtattcaaaccggtggcgatgcgtatcgttgcaggcgggatggataaaggaacggcactcaggcaggaaatcgccgtcaaaaaactgaccgccgcacaaaaacggcaattgtgggagcaggcagaaaaaatgccgtctgaaacctgacggttcaggttcggacggcagttggcagcaatcagggaaaagcggggcaggcggtaaggaaaaccgacgtttcaacacacaggacggtacataaagcgtcgccctatgaaagtgaaggcatatatcagtattttttatacgccaacagaaaagaatacgatgaactgtttgttggatttgtattgattaatcagtatattttttatgccggggtatttttccttatcggtatcccttcttttatgaggatgcctgccgctcatataaagaacgggaaaatacgatgggaaaatacggtacagccctcgacatcgcacaatatgtcaacttatagtggattaacaaaaatcaggacaaggcgacgaagccgcagacagtacagatagtacggcaaggcgagacaacgccgtactggtttttgttaatccactatatttgtttgttttatattgtaagtatacgtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgaagatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagcaaaagttagtaaattatttttaactaaagagttagtatctaccatgaatatattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaaaacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatatgaagcttatgaagataaaagacatattcctgaaaatccatattttcatgaattttactatattaaaaaaggagaaaatccggcgattattactcatcggaataatcgaataaaccaaactgaagaagatagttatagcactagcgtaggttcctgtattaacggtttcacggtacggtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggggtggaaaacctatgggatgatacggtcggtaaaaagacccgtttaatgtgtatttccgttttttggattgtggttttcaatttgtagcgaatcggattcggcatatacggcattgcaaaaagcgtttgactctccaatgccgtctgaaaaccggtttcagacggcatttgcgttcagtgagaaaggtcgcgcctgccgcccgaacgtctcgccgcagcctctgcataacggcgcacctctttttccaaattttccaagttcaaaggaaaatcaggcagtctgtctccctgtttctcttcgcggacaatccgcccgccatccaaataccacgtctgttgcgcatgataggtctgcatatccgccgttacgccatccgctttcaatgctaccgtcgaagattgtgcaataaaaagatttccgtttttcaaataatattcgaaactctggcgtttttttccattgtcgaaactccaatagactttttgcggcagaccgtccgcatcatagccgaccacaagactgttcgccttcatccctcggggcatcaattcccgcatattctgataaaacacagaattgcgcgagtccgacgcaattcggttgctctctttgcggaagtcccaaaccttctgctcgtcattcgcgacatcccggtatttcgccaaatatacctgggccatctgataacacccgaggcaatgctcataaacatcttccccgattttcccgcgccccgccgcatcaaataccgaaccgtctggttgccaaacaacccgatattctcctgtcgtttcataattttccccgtgaaccgttccgccgtacacatttacagaaaacggacgatcgttccgatacagatattcggcattaacaaatgcttccggcgagcgttgcgaaagcgaaaccgcaaccaaaccgccctcgccgatatggtaatccagccaaacctctttcccatgttcctgctccgttacgtgaaaccatttcgccttttctttcaaacgactgagccggatagcgagcgcgagataatccttctccgactgcaacggaccgtcatccacagttccggcaagattttcctccgtccttatcgattccttcacgatgacaaccgccctgtcggcatttcggaacaggcgggcaagtttcgccacaaaagcattcggatttttaggtacttcagttgccgtatcgctcaaaaaccaacgcggattaatctcataggcaatacccgttcccagccaaaaggcaaatacaagtgcaaaaaatgacaacagtaccggtttgaattttttaaacatatttatttttcgtttaacagaatatatcgattatatcagacgagctttgattgccgggttttgctattttttgttgtaataatcaaattgcacgttgactatgtctttctcggtaaaaatataacggagcattgttttaagcctttcataacgttcattaattcctacgctatcaggtagccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaacaagtaatatttcttctgaagttttttaactcacacataatacacataataattaatctccaatacgatttaggtttttatcaaatgtaccgtttcttgtttcttttctgtaatgttattcatcgtagtaaggttctgttgaataattgtctttgcccccggcaatgatagtaacaattttcccttttgcttcccaagcttgtactcctatttcatcaaactcatagacatatgtcggataagattcatttgataaataatatttatcaacaccgtatgatttagggtaatggaaaagctgtttaaaatcttcaaaattcagacctattatattaacgcccataaaatatagctcctgataacaaaatatcgaaataattttgtttttttttttgacggaaatgagtaaatttgagtcgggagattcataatattctgttctaaactcatcaggaggttcatacataaaagtttccagtatgtttttgtactgtgttatatccgcaccaaaacggaatattcctacagaagtaaaaggtaaaaattcgggagttttaacgaccgcgtcgaccatgctcttctccttttgtttttcgattggcatttttggcaatatttctgattttttgcttaatctttaagcgttcatttttggacattccgggaataattttatttgttaattcagcaatttttgattccgctgatatttgacttcgaccgccatctccatgtttttcattcttggagcttcctgttcttttaggcggacaagaattatgaacccaaaccccttccgtttccgcctgattacccttgacgaagtaagtatgccaatcggcaacggtcagattgtaggctttgagcggttttggtttgacaacggttttgcggacggtttgggttctgccgctttcggataacagcctgcttcccgctttcaaatcttccgctttaatccatttgccgtccgaataaaacggatggatgcggttggaaatcaggatttggctgttgccgatgccgtctgaaagccggatatcgcttcagacggcattttgattgccgggttttgctattttttgttgtaataatcaaatcgcacgttgactatgtctttctcggtaaaaatataacggagcatcgttgtgaatctttcataacgttcatgaattcccacactatcaggcaaccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaataaggaacgtttcttataatatccttgaactcacacataataatgtatctccaatataattaaacttttcgtctcaatctacctttactatgttgtattggaaagtaaaaaaatttccagtcctctacatctagatcagtaaaaatataacggagcattaccctgaacctttcataacgctcattaattttgacacttttaggcaaccaagtagaagctttaatttcaaaaagtttccaattttgaaccattaaaaaatcaataatggtaccgattccaatcacgatgtcccttggtatatccatcggataaggatatttttttctaacctcaattaaatcattctccaatttccaatattcttcatcatcccacaccccgtcatcataccatttgccaataaatgaattttcgtcatactccttaaaacaagggatgtttcttctaaaatccttgaactcgcacataataattaatctccaatacgatttaggtttttatcaaatgtaccgtttcttgtttcttttctgttcagtttttcgggtgaagatgcctctttccaagcacctccattatgtgaatctacatcgcgtgatatataactctttccttttttaaaaatagcagcatcatttctcgttctttcttttatttttctatatcccaattcctttgctgctgcatatgcttctgaatcattcccatatatgggggtagatggtgtttttcttggcggacaatcattatgaacccaaaccccttccgtttccgcccgattgcccttgacgaagtaagtatgccagtcggcaacggtcagattgtaggctttgagcggctgctgtttgagggtaatgttttgaaccgtctgttttgcaccgctttcggaaagcagggtgtcgccttttttcagacgacctgcctgtatccattttccttgactgtaaaacgggtggattttattggaaatcagggtttggttgttgccgatgccgtctgaaatttcaatgtaaacggtttcttgatacggattgccgtatcgggcggtaacgggtttgtatcccgtttttccgcttgcctcgtccttggcgaagacgcggtcgccggttcggatacgggcaatggctttgtagccgtctgccgttttgaccaaggtgctgccgtggaaggagcaggtgtaggatttttaaagaacttagttctcaatatcctgtttcattcatcaaaatgccgtctgaaagctgaataccgcttcagacggcattttggtggttgggtttttaagccaacctacgcttactgaaaaccaaattgagtttcagacagtttttaggtttgggtgtccaatctaacttatatttgtccatttaattagtcgtttgtatcaaatttccattatttattttccaatttactttataattatcttcataataatctaattcaaaaaaacctgatatttcaatatccaattccattattgttttaatacatttttcaaaataaataatgaaataagattttacgcatgcaccaaaaaaaatatagctgctccaattaaaactatttgtcgggaaaacccacccgcttttatatatttttgcagattctttctcttcgatattaaagggacaattattccaaaaattattaatgttttcttggatgatttttatatcatcgtcagagcattcaatccatccttttatggaaacatatgatgccatgtttaatctcctaaacctgttttaacaatgccgccttttgattcaatatatgacttaacttgtgaatgaacaccgtatttaaaccaaaattctgcacgttttccctgttggtttgctgcttcgatggttgctttaatttgctttctatttttttgatttaagaaatttttaggtttatctattgctgaaattgttcttttggcttgtattaaagcatcattcgtaacagcgtcaatttctctgccgttaataaattttgatgaaccatcagtttttcttctaattaaatcttcataatgtatatctagagcttctctatactttgcattttgatataactgtctcgcactatcagacaaagccaatttctttttataagaatcagcaaaatccccgctaaccgcagccttccctggttttgccgcctttgccaacttcgcgactttggctgctgcggcaacgttgaagacggcttcgacggtttcggcggcattgggattttcctgtatccaccggtcaacggcttcgcgcgtattcttttcaaagcccgccacgctgcccaagccgccgatgacggcgaatttgccctcggcgggcaagggggcgatgttgcgcattgcggctttgtctatggcatagcgcgttccgtacagtatgtcgcctatgcccaaggcttcgcccgcgctgataaaggggttgagcgcgccggcggcgacgccgttgataaactccatgctgttgccccagcggtcgagcttggcattgtgctcgaacatttttctgttggcttcatcggcgcggtcggagaaattgctgccgaggttgctgtaattgtcggatatgcgttgccggatgctgcgggtgtcggtcggattgagtttgatactgcgggctgtgccgttgacgtgataggtgtattcgtctcgtgcgcccgtaggtttggggtaattgccgcccttcgggccgtcgtaggcatcggcgggatgatgttcgtgtccttcccagttgagccggtatacggtaaagccttcgtcaacgttgcctttttcttcgctcgcgctgtcggcggcgtggttgtcgaagggggcgtgttcttcgtgtccgtgtccggaaaagcgggtgtggtagccgattgtgccgttgatgtttgcctgttggatgagcaggttgcccatctggtgggtatagtcttggatgacgttgattttgccggtgcggtcggaaacgctgccgcgcgggtcgccgaagaggtggtatttgccgccgggttcgtagtgctgccgttgggcgttatcggtaatgaacgggtcttgcgccaagtccgccgcgagggcgggctgtatgagtgcggccgccgctacggcgcaggcggcaaggaggtttgtcagtctgcgcagcggtttcacggtttatcctcctttgcggcggcggatgacttcgttgccgacatcgggttttttaccgttgttttgtttgaagtcgggacggttttgggcggttgtgtcgccgtagggggtaatgtcggagaaatcgaccatcaggcggtctgaggctttgacggttttgctgactttgtaagggccggtccaaagggcgtattgttcttggtattgggattcgtaggcggcggttttaggggtaatcagcagtttccggctgtcgcggtcaacggcgaaatattcgagcttggtttgggctttaagggtttcggcgttgtagaggtgcagttcggtacggctgcggacggtgccgaatacgtcgacggttacgaatacgtcggtgtcggcgtattcgggcggtacgacttcgatgccgcgcaggtagaagacggtttggatgaggttggtcaggaaggaaacgtcgcgggggttggcgagcagggtttcgttgcggtagtcgcccgtgccgttgacggacagtccggcggagcgttcgcctttgcgtccgctgtttttcgtcagggcggcggcgggggcgttcaaaagcgatgtggaagtggttacgctggagagcgcgtcggatttggtggtggcggtagtgtcgtaggcggggtagctgtattgggtggcactttcggggttgttgtggtagccgccgcgtatcagtgcgtcgatagagtagcgtccgccgcttatgttgcccgaaccttggtcaccg

SEQ ID NO: 37781 - DNA, 72750 bp, Neisseria meningitidis
cggcggtatcggcagcatgttgcagagattgacgggtcatttcttttcatcaaaaacattcaacaaaatacactttaggcagtccgattcaggctttacgcttgaaaaacagcctgtccagcgaccatgctccgccgcccgccgccgcgatatagaggaatacgaagcagaacagcactgcggactcgccgccgttggcaatcgggaacaaagcatttccggaagcgtgcgccataaaataggcaaccgccatctggccggacaaaacaaacgcggcagggcgcgcaaacaggcccaacaccagcaaaatgccgccgacaatttctaaaataccggcaagcagcaacgagcccgccgggcgaaccgctgcccatttcaatggggaaggcgaagattttcgacgtaccgtgcaacaaaaacaggtaggcggttacgatacgcaaaacagaaagcaaaaccggttggatacggttgcagcaatcggacataaaagctcctttgatatttgtcttcatttcaggcggtagagtatagatgtttccccttttcaaatatatactgcttttattgatacaacttttccacacaagaaaatatggacaccctgttcagcctcaaggttttccgccaagtcgtccaaagcggcggcttcacccgcgccgccgacgcgctcggcatctccaccgcaatggcaagcaaacacgtcagccacttggaaaacaccgtccaagccaaactcctgcaccgcaacagccgcaacctcagcctgaccgaagccggggaagaatactaccggcaatgcagttacgcgctcgacacgctcgacgatgccgcgcaaaaagccgccggggggacggaaaaaccgcaggggctgctgcgcgtaacgatgccgctgtggtttgccggcagccagatatgcaactggctggcggaataccgcgaacgttatcccgaagtggcattagaactgattttggacaaccgccacgtcgatttgattgccgaaggcgtggatttggcgttgcgcgtttcccaaaccctgtccccgtcgctgattgcgcgcccactggcggaaatcgaatttgccctgctcgcctcgcccgatttcctgaggcgcaacggcgtgccggaaacgccggaagaagtggcggggctgcccgccgtcctgccgacctacaccaaccagcagaaactcgacctcacccgcaaatcggacggcaaaaaataccggcttgaactgacccccgtcatccgtaccgacaacacgctgatgatgcgcgaaatgattaaggcgggcgcgtgcatcggttatcagccgctttgggcggcggaacacgatttgcgctgcggcacgctggtgaggctgctgcccggatacgccgtcccgaccgaccggctgaatgccgtttatgcagacagggcattcttaagcgcgaaagtccgcagcttcatcgattttctgaacgaaaaaatcgccagcaggaaaggctgccgaaatgccgtctgaaaccgcccgccccctttatgcggacacgtgcgccgcacacacgctcgtctggttccgccaaaacctccgcatccgcgacaacgccgccttatgcgccgccgttgccgaagtttgcccattatcggcatttggattgacgatgccgaaacagacaaccctcgccgcgccgcgttctaccgccaatccgccgccgaactcgcccaagggcttgcagggcgcggcatcccgctctacacggcggcatctcctgccgagctcgtccggctcgccgtccgcctcaatatccgcaccgtcatcgccgacgaatcccatacttttgccgacaaactcgccgacaacgccctttggcacgaattggacaaacacggcatcgcgttaaccttcgtcaacgaccgcgccgttttcggcaaaaccgacctgatacccgacggcggcacggcatatgccgatttcgaccgctaccgcgaagtatggctcgaccgcttttccaagcagccccccgccggtccggacctattcgcggcataccgccaacccttccccgaaaacctttccgccccgcagcctgccgcgctttcagacggcatcttcctgccgcaaaacagcggcgaaacggcggcttggcggcagtggcggcggtttctcgaacaggcggattcctactccgttttaaaggatttcccctcgcgcaaacacacttcgctgatgggcgcgtatttgagtgccggctgcatctcgccgcgcctgctcgcgcgggaaagcctcgaacgccgtctgaacgcgtgggcggacaacatcatccgccgcgattttttccttcaacttgccttgcagcacacggatgacgacccttcagacggcaatcctgaacacaccctgcgcctgacgctttggcagcagggccggaccggcattccgattatcgatgccgcgatgcgctgtttgcacaaaaccggcagcctccaccccgccctgagacgcttgagcgcggattttttctgccacgttttaaacctcccccgccgcgaaggcgagatatggtttgcccgacagctgaccgatttcgatgcagcaatcaaccaaggcaactggcggcttgccgcctcacggcacacctgccccgacattgccgccgccgcacacaaaaccgaccccgacggcacctttgtcagacggcacattcccgagcttgcccacctgtccgccgacaccgtccacacgccttggcggtttgcctgttcggtcgatacccacggctatcccgcccatcctgtcgccggtattccctaagcggtacggcaacctaaaacaaatgccgtctgaacttccgtttcagacggcattgcgtccgaatgactcaatatcttccgtttttttcactttcaatcatcaggtatgcccaaatcaccgccacccaagccgacaccgttcccatcgccggcaaaaaatgctgccaatccgtcatcggcggcacagggcaacggccgcattcgatttccgcgccgcccaacaaccggtacagcaacatatccgcaatccaaagcaacaacgggtatttcaaacgctgcaaccaaaaaaccaaccacgtccgcacgattcacctcaccccccattccgacaacgatattgtaccgcttccgtgcaatgttaaaataagcccacttctaccgccgtacaaaacgccatgctcaccgatttagaaaaaaacgccatccgcgaccattaccaaaacatcggcaaaaacctgcccggtttccgtccgcgtgcttcgcagcgggaaatgattgcggcggttgccaacgctttttcgcggacgttggcgcgcgaagaaggcggcgagccgcccaagcgcgaaggcgagagcattgccgtgatcgaagggccgaccggcgtgggcaaatcgttggcctaccttttggccggcggcatcatggcgcaaacacgcggcaagcggctgattgtgagcagcgcgacggttgccttgcaggagcagttggtagaccgcgacctgccgtttctggtcgaaaaaagcggtttggaactgaccttcgcacttgccaaagggcgcggccgctatctctgcccctacaaactctatcgactgacgcaaagcaatgcccagcaaaacctgctcggctttgaagcccccgccgtcttgtgggacagcaaacccaagcccgaagaattgaagctgctgcgcgacatcgccgacgaattttccgcccgacggttcaacggcgaccgcgacacttggccggaaaaaatcgatgacgcgatttggctcaaagtgaccaacgaccgccacggctgcctgaaaaccgcctgtcccaaccgtccggaatgtccgttttacctagcacgcgatgtcttggaaaccgtcgatgtcgtcgttgccaaccacgatcttctgcttgccgacatcagtatgggcggcggcgtgattctgcctgcgcccgaaaacagtttctattgcatcgacgaagcgcaccacctgcccaaaaaagccctcagccgttttgccgccgaacattcatggaatattgccgtttggacgctggaaaaactgccgcagctgaccggcaaaattgccgcgctgaccgataaagccgaacttgccaacctagccgacgaagccgccgcatccttgctcgacagcctgcatgaatggcaattccatttggcggaagagccgtctttaagtctgggggtgtctgaaaacgacagacgaaccaacagcgaaccgacttggctgtgggaagacggcaaaatccccgaaggcctcgaaaccaccgtttccaatacggccattgctgcgcgcagcctgctcaaacacgttatcgggctgaacgatgcgctttctgccgcacgccgcgaaaaagaacaggacggcgcgctcctcgaccgcctgaccagcgagttcggtctttttatcgcccgtatcgaacaaatcagcgcggtttgggatttgctctccactgtccccctcgagggtgaagaaccgttggcgaaatggataacccgccgcgccgacgacaaaaacgactacattttcaacgccagccccatcagcagcgcatcccaccttgccaacagcctgtggcggcgtgcggcaggcgcggtattgacttccgccaccctgcaatccttgggcaacttcaacctgatgctgcgccaaaccgggctgcaatggctgcccgaaaccaccaccctcgccctcaaaagcccctttgactttgaaaaacagggcgaactctacatcccccccatatacgccagccccaaagaccccgaagcccacaccgccgccgtcatcgaatggctgcccaagcttatttcgcccaccgaagccatcggcacgctcgtcttgttttcctcgcgcaaacaaatgcaggatgtcgccctgcgcctgcccggagactacctgccgctcttgctcgtacaaggcgaattacccaaagccgtcctcctgcaaaaacaccaccgggccatagaagaaggcaaagccagcatcatcttcggactcgacagctttgccgaaggactcgacctgcccggcaccgcctgcgtgcaagtcatcatcgccaaacttcccttcgccatgcccgacaaccccatcgaaaaaacccaaaaccgctggatagaacagcgcggcggcaaccccttcatcgaaatcaccgtccccgaagccggcatcaaactcatccaggccgtcggccgcctcatccgcaccgaacaagactacggccgcgtaaccatcctcgacaaccgcatcaaaacacagcggtacggccaacaattattggccggcctgccgccgtttaaaaggatagggtaaacataccgcccttcccgcaacagaaaggaaaaattcatgaactttacccgactgctcaaccaagtcttaagcacggttcaaaaaaaaggcaacacattctccgacagcccgctcaattcattcggcggaggcgcgctggttgccggtgtcgcctccatgctgctgaacggtaaaaaccgcaaaaccatcaccaaaatcggttcgaccgccgctttgggctacctcgcctaccggggctatcagatgtggcagcaaaacaaagggcgggcaaccgtaacacaaagcgatttccaacctgccggagaaactgaagaaacatacagccgtaccgtattgcgcaccatgatagccgccgccgcttcagacggcatgatagacgaagccgaacgccggactatcgaacaggaaagcggcacagaccccgaaactgccgcatggctcgccgccgaataccgccttcccgcaagcatcgaagacatcgccgccgccgtcggcaacgatgaggcgttggcggcggaggcctatctggcggcaaggttggtctgtgccgatttgtcgcggaaagaaaccgtcttcctcgcccgcctgtcgcaggctttgaaactggatgacaatctggtggagagtttggaaaggcaattggggttttgatgacacagccggggagggaaaatcatcaaaaaacggttattccgaccccggcctcaaaacggcaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataaaagccgccgccccgaacggcaaacagcggcataggctgccaaaggcaatatccgacaagaaggcaggctactgcaatgcgccgccgtgggaagatttaagcaggcgttcgtgtttgtggaattcccgccccatataataagaaccgaaataggtcaggtggtcttggtcgccgtaaagatagcggccgtatatttcgaccgtgtttttgggcaggtatttttgtgcgtccacccaatgcacattgggaatatctttaatcaaatcaaagaccgcctgattgctcttgccgatgtcgcccatagcctgaatggggcggagatattggtttgcggcaaatcttttcaatttttcctccctcaggggcgaacggctgattgatgtgttgtttgcaaaaacatagacgggtttgacggcggctatccttttgacggtttccctgaatcgggctgggaacccgggtattaggaaggattgcgcttcaaatctcggcacaggctggccgcccatcctcaaatcatagaattgggcaatgaaaacggcttcggctttttcaacttcatcccggtattttcgacataacgggttgtctgccagcttctcatctacccaaaccaaacactccgaatcgagggacaggattttggctttccacccttcccggctgccgacataatccagaaaccccctcaggtgtccggcgtgcgagtcgccgagggtcaggacggtttccggaaaatgattttccgcagcaaggggcgcgccgggcaacgggcggaggtgttcctgtttcaatatccccccttgcgtacaggttgtaaccgacaagtatcagggacggggcgagatagaggcagaaaaatgcctttttgaaggtcatcttccgttttctaagcggctgttcaatcaaataataactcaacagggaaaatccggccgtcaacgcggcaaccgccgatacggcaggcagtccgagctgtttgtcgcctgtaatgtaatgggcgaaagcaataaaaatccaatggtacaggtatagggaataagagattttgccgacaaatacgatggggcttgccgacaggatgcgggtcggaagtgtcccgtattgcatactccggataagcagtgccgtcagcaggcagggaaggagcagggtcattcccgggataaacggattgtgtttgtcaatcacgaacaggcaggcaagcaatgcgccgaagcagagtgatgaaagcaactgccgttttccatttgctgtttgccgtctgccgttttgcgtttgcccgtaaaccgccagcagcgaacctgccaacagctcgggaaacctcagtgtcgaaaggtaataagtattgggttggttgaggatgtcggtataaaacccgcttggcaaaaacgatgaggcagtcaaaatcaaaaacaggatgatgctgatgttacgcagcacccgtagcgatttggtttttttgcagcaaaatatcagcaaaaggggatacaggaggtaatactgttcctctactgccaaagaccagatatgcagtacggggttctcgtcggcactcaaatcgaaatacccctgctgaaaccccagataaatattggacaagaaaaccgcagaaagctccacggttttccgcatttggttgaaatcttcgtaaaggaagatttgagaggcaatcaccgaagccagcgacacggccgcaataaaggcaggataaatccgcttaatcctgcgggtataaaaatcccggaaagaaaaagaaccgttctgtatttcagaaagaatgatgccggtaatgaggaatcctgagatgacaaagaaaatgtccacccccaggaatcctccgggcagccagcggttattcaggtggaaaatcatgacggatagcacggcgacggcccgcaatccgtcaatttccggtctgtatcggacagcttgcataaatatcgcccccgtatgtcccgttatcttaaaaatgccgtctgaacgcgcgttcagacggcatcggtttcagtaaacgctcaaatccgtttcgccaacgcttcagccttgcccacatacagcgcgggggtcagctcaagcaatttggctttggcttcggcggggatttccagcaatccgataaagcctttcagcacttcgggcgtgatgccgcctttgccgcgcgtcaggtctttcagtttttcgtaaggattggcgacaccgtaacggcgcattacggtttgaatcggctcggcgagcagctcccaagtggcatccaaatcggcggcaagcgcggcggggttgggttcgagcttgttcagaccgcgcaggtgggcggcgaaacccaatacggcatagcccacgcctacgcccatattgcgcaatacggtgctgtcggtcaggtcgcgctgccagcgggaaatcggcagtttttcggacaaaaagcccaatacggcgtttgccataccgaggttgccctcggagttttcaaagtcgatggggttgactttgtgcggcatggtggaagaaccgacttcgcctgctttgactttttgtttgaagtaacccaatgaaatataaccccaaacgtcgcggttaaagtcgatgagaatcgtgttgatgcggctgagggtttggaagaattccgccatatagtcgtgcggttcgatttggatggtgtaggggttgaaggtcagaccgaggctgatttcgacgaagttgcggcagtgggtttcccaatctacatcaggataggcgaccatatgggcgttgtagttgccgaccgcgccgttgattttgccgaggaactcttgcgcttgcaggtttttaaactggcgttgcaggcggtacacgacattggcggtttctttgcccaaagtggtcggcgtggcgggctggccgtgggtgcggctcatcatcgggacggcggcaaggtcgtgcgccatagcggtcagtttttcgatgatttcggccagcttcggcagcaaaacagcctcacgcgcttcttgcagcattaaagcgtgggacaggttgttgatgtcttcgctggtgcaggcgaagtggatgaactcactcacggcggcgacttccggcacttcggcaaaacgttttttcagccaatattcgatggctttgacatcgtgattggtggtggcttcgatggctttgacggcggccgcgtcttccaatgaaaagttttcaatcaccgtgtcgatttcggcaagcgtttcggcactgaagggcggcacttcggcaatcttcggctcggcggcgagggctttgagccagtttaattcgactttgacgcgcgccttcatcaggccgtattcggaaaaaatcgggcgcaatgcttcaacggattgggcataacggccatctaaaggggaaagcgaggcgatggggttgatcatttcggcatcctgttcgggaaagacatcaaaaattgttaaattgtttgcaattatacatcactctcaggacgctatgccgtctgaagcccgtgttccgacagatacgcaacgatttcgtcttcatcgtccgatatggcaaacaaagagaccgccccttcggaaatcagaccgcgcgccaaaagctgcgcgtttatccactccgccaagcccgaccaaaacgcctttccgaccaaaacaatcggacgcggcggcactttgcccgtctgcaccaaggtcaggatttcaaacaattcgtccagcgtcccgaagccgcccggcatcacgacatatgcttgggaatagcggaaaaacaccgccttgcgttcggcaaaacgggaaaaccgcaaggcgatgtcctgatacggattcggtttctgctcgtgcggcaaaacgatgttcagccccaccgaaaccgacttccctgcaaacgcgcccttgtttgccgcctccataatccccggcccgccgcccgaaatgacggcaatgcccgaatccgacagccgccgcgccagacggcaggcgaacgcataatccgcatgattctgcggcgtgcgcgcgctgccgaagatactgactgccggaaacacgcccgccaatgcttcgtctgcctgcctgcgttcggcatcataacgtgcctgctccggcacacggtttgtattctccattccatcctccgttcaaaaacagcgattgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggtaacgccgtactggtttttgttaatccactataacgcaagcaccgcaaagccgcgccaaccctctcccaaccttttttcagacggcattttcggtaatctgctaaaatcgcccgcttgagtttccacagaaaaatccgaaaaatgaatattttttacgaagagtccggccaattcaaaatcgccgccatcatccaaaaaaacgatgccacctaccaagtcgataccccacacggcaaacgcaccaaagtgaaggcgaacaacgtctttgccgagtttgacggcgatatggcggcgtttttggaaaacgcgcaggcacaggcggcggacatcgacaccgatttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaacgcaaaaaacagcaagacgcgcaaatcgacgcttgggcagaagccttgaaacgcggcgagatgccgtctgaaatcgcggcggatttgaaaaccatcctgcacgcgcccgacaagcagtcgctgacctacaaagcctttaccaaagccgccgacgcgctgaaaacctctgcctacgaattggcgaaaaaaacgggcggcattacgtccattccccaatacctgcaagacgggtttgaaatcaaatacttccctaaaggaacaggcttccccgaccttgcccttcccgaaatgcccgacctgcccaaggccgacgttaccgccttttccattgacgacgaatcaaccaccgaagtggacgacgctttaagcctgaccgacttggacaacggcacgaagcgtgtcggcatccacatcgccgcgccgtcacttgccgttaaaccgggcgacaaaatggaaaaaaacatcatggaacgcttgagcacggtttatttccccggcggcaaaatcacgatgctgcccgaaaactggattgccgcgttcagccttgatgcaggcgcacaccgccctgccgtcagcatttatttcgatgtggacggcgagttcaacgtcggcgcgccgacctgcaaaatcgaagcggtcaacatcgccacaaacctgcgtatccaagccatcgagccgcatttcaacgccgaaaccggcttggacgaagccggcgaaatgatgttcgcccaccatcaagacctgatttggttctatcaattcgccaccgccctgcaaaaagcgcgcggcaaatacgaacccgaccgcgcgccgcaatacgattacagcatcgaattggatgaggaaggcaaggtatccgtcgtccgccgcgaacgcggctcacccatcgatacgctggtcagcgagatgatgattcttgccaacagcacttgggcacaaatgctccatgacaacgacctgcccggcctcttccgcgtccaacccaccggaaaagtacgcatgagcaccaaatccgagccgcatatcggcatgggcgtgcagcattacggctggtttacctcgccgctgcgccgcgccgccgactacatcaaccaaaagcagctgatcagcctgatagacgacactgccgagccgctgtatcaaaacagcgatgccgagcttttcgccgcactgcgcgactttgatgccgcctataccgcctacgccgatttccaacggcagatggaagcctactggagccttgtgtacctgcaacagcaaggtacaagcgagctgaccgcgaccatcctcaaagaagacctcgtccgcatcgaaggcctgccgctggtcacgcgcgcgaccggtattccgtttgacgcactgcccaaatcacaggcattgttcaaaatcaccgaattggatgccgagaagcagtttgtctcgctcaactacatcaaggcagtcgcacccgcgggtacaacggcaggcaatgccgtctgaagcccgatacggcaaactccggcaaaaacagaaacctgaatctcatcattcccacagtcgggaatccggttttttgggtttccgttgtttttccgtttcaatgaacttccaagccgccgttcccgataaatacccgcaatctaaaatcccgtcattcccgcgaaagcggaaatccggctcgttcggtttcagttttttaggtttcaggcaacttctgaatcgtcattcccacgcaggtgggaatctaggtctgtccgcacgggaacttatgcgccgtcattcccgcgaaagcggaaatccagattcttcggtacagaaacttatcggataaaacggtttctttagattctacgtcctagattcccgcctgcgcgggaatgacggcataggggtttccgttttcccgataaattaccacaacccaaaatcccgtcattcccgtaaaagcgggaatccggctcgttcggtttcagttttttaggtttcaggcaacttctgaatcgtcattcccacacaggtgggaatctaggcctgtccgcacgggaacttatgcgccgtcattcccgcgaaagcgggaatccagaccgttcggcttcagttttttggtttcgggcaacttctgaatcgtcattcccacgcaggtgggaatctaggtctgtccgcacgggaacttatgcgccgtcattcccgcgaaagcgggaatccagaccgttcggcttcagttttttggtttcgggcaacttctgaatcgtcattcccgcgcaggtgggaatataggtctgtccgcacgggaacttatacgccgtcattcccgcgaaagcgggaatccagattcttcggtacagaaacttatcggataaaacggtttctttagattctacgtcctagattcccgcctgcgcgggaatgacggcataggggtttccgttttcccgataaattaccacaacccaaaatcccgtcattcccgcgaaagcggaaatccggctcgttcggtttcagttttttaggtttcaggcaacttctgaatcgtcattcccacgcaggtgggaatctaggtctgtccgcacgggaacttatgcgccgtcattcccgcgaaagcgggaatccagattcttcggtacagaaacttatcggataaaacggtttctttagattctacgtcctagattcccgcctacgcgggaatgacgatggaaagattgttgttgcttcggataaatttctgcagttttaaataaccggattcccgcctgctcgggaatgacggcataggtttttttgtttttccgataaattaccacaacccaaaatcccgtcattcccgcgacggcgggaatccagtcctttaaactccagccattcccgataaattcctgttacttttcgtttctagattcccgctttcgcgggaatgatgaatgacggtgtaaaagtaactcgaaatccaaaaagccataccgcccggatttttgccgatcggtatggctttttgcttcaaaccgccttagcggatgtcgacatacgcgccggaatgcaggtcacgcaacaggttgacggttgcctgttcggctttttgttggaagatgtattgccgcacggaattgcggatacgttcctgaggtgtgccggcatcgcgcacttcgttcaatttgatgatatgccagccgaattgggtgcggacgggcgcgccgacctgtccgggtttgagcgcgtggacggcttcttcaaaggcgggaaccatcacgccgtcggcaaaccagcccaaatctccgccgttgcccgcgctcgcgtcttgcgaatattggcgcgccaggctggaaaagtctgtgccgctgcgggcctctccgtagattttgcggatggtgctttccgcgccgacggcggcgttttcgctgtcggctttaatcaggatgtgttgggcgcggtattggcgcaacggtgcgccttcgggcagggtgatgccttgtttttgcgcctgctcgaggaaggcatcgatttcagcttcgctcacgcggctgttctgcatcactgcctgctggcggactttttcggcaatgatgttgtcggcaaaatcgcggcgttgggcggggctgaggtttttgagggcgggattttttgcgacgacggcatcgatttccgcttcgcttgcttgaatgttgcggcgtttgcccgcctgtacaatcagggattggttgacaagctgcatcagcacctgtcgggacagctcggattcgcttatctgcgcgtctttgggcaggttggctttggcttcggcaacggcttcggcaagccggcggcgcgtgatgacttcgttgtcggcaacggcggcaatgccgtctgaaaagcggataccgccctgctgttgtgcgggtgcggcttctttttgcgccgtggcggcaactttggcaactttggcaactttggcaactttggcagctttggcagctttggcagctttggcggatgcggtttttgccttttgcggtgcggcgtggacatcggctgctgccagcaatgcggcggcaatcatcagggctttgattttcatcattctttccttatcgtttgaatcctgcctttgatggcgggtttggggttgtcggtggaatgccgtcttgtgcgggaacggtgctcctgccaggtttccgacggtcagggtcgtttgttgcgtccggcggaaagagagtgggcggtgatatagccgggaacggcgacatccatcctgtctgcggggtttctgccgacactgctgaggtctttcaactgaagtgagaaaaagacagcgtttttgtaggtgttttcgccggtaacgtagcgttgggcgtacacgcccgcgccccagcagccgcaactgcttttgtattccgcacccgccagcacctctatcggttttttggcttcaaaaccgtagttgtaacggacgacggccgacaggttgcgcgtcagcggccattgtgcggacaggtcgagctggctgagtttgtcgtaaaaataggaaccgtcggacttcaggtagattttttcgttgcgcccgtatttgtagcgggcgttcagcactttgccctgtgcgggacggtagcttgcaccgacggcgtagttctcggcgcgtttgtcgttttggttgtagtggatgctgctgtcgaggatgaagcggctgccgatgctgccggaggcaaatgccacccagtcggaacggttgcgcggttttttgccgacgctgccgtcaagcatcaccgcatcatccttgaaatagaatttctgaccgatgccggcgcggaaacgctcttcccccgtcgcgccgtccaaaatacggctttgcacggcggcggaaaggctgtttgcggtgttaatcctgtcgttgccgtaatagaggttttcgcgaaagagctgcccgtagccgaagctgctttccgacgaatcgaaattgggcaggtcgttttgggatttggcaggaatatagttgtagaacaggcgcggctcgagggtttgcaggacttctccgccgaacatccgcgtattccgctcaaaagttgcgccgctgtcgatgttgacaatgggcagagtgcggctgacgcgtcgggcttcttggctgccgaagcggttgaggctgtaataggtggcgtgcagtccgagtttgggacggacatagccccagctgttgctgaaatcccatttgatgtcgggatagacgaccaggcggctgccgtcttggcggctgtcgtggctgaatcgggtaaattgtgcggacacgccgatttgcgccctgccggtgtttttacgccactcgaccgaaaggcgcggcatgagggcatacggtttgtctttgtagccgctttggtttgccagcgtctggtatttcagaaccgaaaggccggcattcaggctgccgcccgccgccctgccgccataatccagccatacacggcggttgaggttgacgttgccggcgatttctttgttgccgtaaaagtcgcggtagtagccgctgtcggagacttggttgaaatcgacacccgcctgaagcgtgtcggaaatgtcgtgccgatgctgccatttcgcctgatagcggttattcctgccgcttttcttgtcgtgcggcagccaggtcaggtcggactggccggcataatccggccgcaggtagcgtacctgcccgtcaaagaccgcgccgcgttcgccgatcacgctgggcgcgaacgtggcatcgagattgggggcaaggttgaaataatagggaacggaaagggaaacgccgtccgaaccggcggacagtgagggaacaagcaggccgcttttgcggttgccgtcaagcgggaagtccgcccaaggggtgtagaaaatgggaacgccgccgaacacgaaggcggcgtgtttggcaacgcctatgcctttttcccgatcggcttcgacagaggctgccttgacataccagccggcatcgccggcggaacaggtgttgaattgggtttccgtcagtttgtaatgcccttcgcccaacatttcggcggtgcggctgacgctttgcagccgccgtccgccttgttcgatttccatgcggacgttgtgcgcttccccggtctgctgctcgagattgtaggtcagggtttcgccccgaatcagcgtaccgtcctgttggagggcgaaccggtcgcctgcggtaacggtgtcgcccgactggtcgtaatccgcccaatcggtattgagggtcgtccggttgcgttcgacgacgacgttgccttcggcacgcacctgcacctgcgactgtccttccatcctgtcggcaacaatgcgcgtatagtcttcggggatggatgcttcgccgctgccttggacggcggcttcggttctctcggggctgccgctttcgttactgcaaaacaggcaggtcgaaccgaggctcaggctggtaggctgtatgggttcggacacgctccgaacgctttctccggcggtcggattgtccgtttcctccgccgcaacggcatcggcggcggcgcaatgcgtgccgaagcagaggcccaatgccagcaccagtggtttgagtgaaaataaacgagccaaaatcgcccctcaagtcggtttgccagttagaatagcgtttattgtaacctgaaatgctttagtactgttatgcaacgacaaatcaaactgaaaaattggcttcagaccgtttatcccgaacgggacttcgatctgacttttgcggcggcggatgctgatttccgccgctatttccgtgcaacgttttcagacggcagcagtgtcgtctgcatggatgcaccgcccgacaagatgagtgtcgcaccttatttgaaagtgcagaaactgtttgacatggtcaatgtgccgcaggtattgcacgcggacacggatctggggtttgtggtattgaacgacttgggcaatacgacgtttttgaccgcaatgcttcaggaacagggcgaaacggcgcacaaagccctgcttttggaggcaatcggcgagttggtcgaattgcagaaggcgagccgtgaaggggttttgcccgaatatgaccgtgaaacgatgttgcgcgaaatcaacctgttcccggaatggtttgtcgcaaaagaattggggcgcgaattaacattcaaacaacgccaactttggcagcaaaccgtcgatacgctgctgccgcccctgttggcgcagcccaaagtctatgtgcaccgcgactttatcgtccgcaacctgatgctgacgcgcggcaggccgggcgttttagacttccaagacgcgctttacggcccgatttcctacgatttggtgtcgctgttgcgcgatgcctttatcgaatgggaagaagaatttgtcttggacttggttatccgctactgggaaaaggcgcgggctgccggcttgcccgtccccgaagcgtttgacgagttttaccgctggttcgaatggatgggcgtgcagcggcacttgaaggttgcaggcatcttcgcacgcctgtactaccgcgacggcaaagacaaataccgtccggaaatcccgcgtttcttaaactatctgcgccgcgtatcgcgccgttatgccgaactcgccccgctctacgcgctcttggtcgaactggtcggcgatgaagaactggaaacgggctttacgttttaaacccaatcaaaatgccgtctgaaaaccaagtttcagacggcatttttcaaacgggcttactgcgcggctttttgttcttcgcgtactttgtccgccaaaaggtcgatggtgttcataccggactcccagtcggcaaattcaactttatatttaccgccgacgataaccgtgggcgtaccgtcgatttggaaggtttcggtcagctcctgcattttgtcggcgcgcgcctggctttcgggggactcgtaggcggcaaggacttttttgccgtcaaaggcggtttgttcgcccagccattttttgaggacttccggattttgcagcttgattttttggttgaccatcgcatcgaaaatatggctgttcgccacatctttgctgtcggcggcagccatatcgacggcggcggcgaggcgtgccagcgtcagcatttctttctgccagacgacgtgttcggtacgcaggtacatatcgtctttaaaagacttggcgtgtttgcttaaaacaggttcgaggtgggcgcagtgcggacagaaatagccgaaaaactcaaggacttcgactttgcctgcctgctgttggggaatcgggttggcaaggacggtatagttttgcccttcgaccagccctgccggggcggcggctgccgaagcggcaggcgcgctgtcggcggggacgctggtttggactttgctgtcgcacgcggcaagggcgaacagggcggcaacgccgagggcaaggtgtctggatttcatacggttctccgtgatgttggaaacagatgttggaaatcaatcggaatccggctattttattgcatttccgcgtattgatacagtttgccgccggaaaaggacgttttcgtttcaggaaaccgcttcagacggcatcaaacccgatgccgtctgaagcggtttctgtcgtacaatacgcgccgttgccccagacgggtacgactgttgaggaacaatgatgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgaatttacgctgtttgacgcgcagatgacgcaacacgcgctgattgcctattctttcggtttaatcggcttaatcatgattaaagtgttggcacccggcttctatgcgcggcaaaacatcaaaacgcccgtcaaaatcgccatcttcacgctcatctgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtgatgtgcggcggactgtgggcagcgcaggcttacctgccgtttgaatgggcgcacgccggcggaatgcggaaagcggggcagctctgcatcctgattgccgtcggcggcggactgtatttcgcatcactggcggctttgggcttccgtccgcgccatttcaaacgcgtggaaaactgaccgatgccgatatcctttttcggcaaacgcttttccacgcctatattcgggcgcgcatcccccacgtccgcaccagccggacgggctgccgcatcatcaatgccgtctgaaaacaagaaaaccgataccttatgattttaacaccgccggacacgccctttttcctccgcaacggcaatgccgacacgattgccgccaaattcctgcaacgccccgcgcccgcataccgccgagagctgcttcccgacagcacgggtaaaaccaaagtcgcctacgacttttcagacggcatttcgcccgatgcgccgctggtcgtgctgtttcacggtttggaaggaagcagccgcagccattacgcggtcgaactgatgcttgcggtacgcgatcggggttggcacggcgtagtcgtccatttccgcagctgcggcggcattgccaacaccgctccggtgttctaccacttgggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaacggtttgatgctaatattccccctttccccagacgaatacggaacccgacatgaccgacatcctcaataaaatccttgccaccaaagcacaggaagttgccgctcaaaaagccgccgtcaacgccgaacacatccgcacacttgccgcagaagccgcgcccgtccgcagcttcatcgattcgatacgcggcaaacaccgcctaaacctgcccgccgtcatagccgaaatcaaaaaggcaagcccgagcaaagggttaatccgtccggacttccgccctgccgagattgcacgcgcctatgaaaacgccggagcggcgtgtttgtccgtactgaccgacgaaccctatttccaaggttcgcccgaatacctcaaacaggcgcgcgaagccgtatcgctgcccgtgctgcgcaaagacttcatcatcgacgaataccaggtttatcaggcgcgcgcatggggggcggatgccgtcctgctgattgccgcagcactggaacaggaacaattggaacgctttgaagcggtggcgcacgaattgggcatgaccgtcctactcgagctgcacgacgaaaccgaattggaaaaatgccgcaacctgaccacgccgctgtggggcgtaaacaaccgcaacctgaggacttttgaagtctccctcgaccaaaccctgtcgctgctgcccgcgctggaaggcaaaaccgtcgttaccgaaagcggcattacaggcaaggcggatgtggaatttatgcaatcgcgcggcgtgcataccttcctgatcggcgaaacgtttatgcgtgccgacgatattgaagcagaagtgggcaaactattctaaatcccgatttcagacggcatattgccgccgaccgatcaacacccttaccgagcacggaaccatcatgcaccgaccgaccgccaaacagattctgcacgaagtatttggttatcccgaatttcgcggcaggcaggaggctgtcatcaatactttggcaggcggcgggagtttgacggtgctgatgccgacgggcggtggcaagtctttgtgttaccagattcccgcgctgatgcgcgaaggcgtggcggttgtcgtatcgccgctgattgcgctgatgaacgaccaagtggcaaacctgcacgccgccggcatcgaagcggcggcagtcaacagcggcacatcggcagacgaggcgcgcgagattgccgaccggcttgcccaaggccgtctgaagctgctttatgtcgcgccggaacgcttggttaccgaccgctttttgcgttttctcgaccaacaaaccgtcagtctgtttgccattgatgaggcgcattgcgtcagccaatggggacacgatttccgccctgaatatcaacagctcggcatgcttgccgaacgctatccgaacgtcccgcgcatcgctctgaccgctaccgccgatgccgccacgcgcgccgacatcaagcattatctgcacttggacgatgcgcccgaatttgtctccagctttgaccgtccgaatatttattatcaggttatcgaaaaaaacaacggcaaaaaacaattgctggatttcatccgcaaagaaatgacggggcaaagcggcattgtgtattgcctaagccgcaaaaaggtggaagatgtggcgcagtttttgcgtgaaaacggattaaacgcgattccgtatcatgctggtttgagcatggacgtacgcgaggaaaaccaacgccgctttacgcatgaagacaatattatcgtggtggcgaccgtggcgttcggcatgggcatagacaaacccgacgtgcgctttgtcgcccatctcgatatgccccagagtgtcgaacatttctatcaagaatcggggcgcgccggacgggacgggctgccggccgcaagctggctgtgttacggtttgaacgattgggtgttgctgcgcgaacggattgccgaaggcaacagcgacgaggtgcaaaagcaaatcgaaatgcaaaaactcgatgccatgcttgccgtctgcgaaaccgccgcctgccgccgcgtactgctgctcaaacatttcggcgaagcatccgaaccctgcggccattgcgacaactgcctgcatccgcccgtacggtttgacggcacggtgttggtgcaaaaattactcagctgcgtgtaccgcgccggacaacgttttgccgccggttacatcaccaacattttacgaggtaaaagcgacgattggatacgcggcaaccggcacgaacaactgtccacattcggcatcggtacggagttgtccgacaaagaatggcgcagcgtcatccgccagtgtatcagcctcggctacctcaccgtcaacattacccgatatcaggcattgcaactgaccgaagccgccaaaaaagtcctcaaaggcgaaaccgaagtgatgctgcgtccgctcaagcgcgacaagcccgccgcccgcaccctcaaagacaactggctgcgtaccgaacgcgaagaacgcctgtggcaggcattgcgcgtttggcgtatgaaacaggcagaagccgaaggcatccccgcctatatgattttcggcgacaaaaccctgcgcgaccttgtcgaaaaaatgccgcaagacctcaacggtctgcacgacatctacggtttgggcgaagccaaaatcgaccgtttcggacacggcatcctcgaagtctgccgcaacgccgccggcttcagccgcgacgcggtcatccgtccgcaaaccgaacgcgaacaacaactgcgtcaaaaactcgaagcctggcggtatgaacaggcaagggcggaaaactgcgccctgcatgccgtcctctccgacgaaagccttgccgatatgcttgccgatacgcccgaaaccgaaaccgacctcgaaggcgtgtacggcttgggcagcgtacgcgccgccaaatacggacgggacatcctcgccgtctgccgtccgttttcagacggcatcgatgaaaccgccaaacgcaaacgccgcctgatgcgcgccctgatccaatggtgcggcgaaacggcaaaacacgaacagtccgaaccctaccgcattctcagcaaagccgcactgcgcgccattgccgccaaacagccggaaggcttggcggagcttgccgccgtatacggcgtaggcgaagaaaaagccgcacgttacggtgcggcggtgttggcggtattggaacgaaatgccgtctgaagcccgttaccaagtttcagacggcattgcctctatttaaaaattcctgtttttatagtggattaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccactatcatatagatttttatgccatttggtcagaaacagcgaagacaggcagggaaacgccttcagttccatcgcgtcttcaaaatcatcccaaacatcgctcaaattctgtttggatatgccgtattcccgtccggcaaacatcacggtctttttgcttttggcggcttttttgaatgcctttctctgtttttcgggtatctgctgccatctcaactgacggtacacgtcgtagccgtcgccccaaaaagaggcataccgttgcgtgtcttcgccgaccagcggcgcggtattcccaacccgtacatatcccgtcggcacgacggcacttgccttatacatgtgcagaccgcgttcccaatacatattcaattgaatcgctcataaatttttgctccaaaatttaaagttttactatagtagaaataaatatcaaaactgaaaatattactgaaaaaattttatattgtttaacttttcttttatacgaattcgcctttgttgaaattaattgataatcaaaccagcaagaaataattccataataaaacattccaatccaataataaaattcaggtctcttagaattagtaaaaattttaaatccataatctctttcaaaagtagctattatacaagtaaacaatatcaccaaccctaaacagtccaacataaaaatatagtttaattttttgttcatacaatatttccaatattattctttaagtctttgtaaagcgatttcaaatccgccagctcctccgccccaagcggtttgttgccctgccagtccaaagccagcagggtcgcatgtgttttttttgccaccgtgttcttcaactcgggtaacctggcaggcagtgtactgcttcagtctgatgttatagacgcaatatacgtctccggcatcagcatatagtggattaacaaaaatcaggacaaggcggcgaagccgcagacagtacaaatagtacggaaccgattcacttggtgcttcagcaccttagagaatcgttctctttgagctaaggcgaggcaacgctgtactggtttaaatttaattcactatacatcggcatttcctttatttctgtcggttttcacagacaaatgccgtctgaaacctggaaacggcttcagacggcatctgcacatcatctcttcggaaaaaactgcaccacgttctccccttgcggcagcatcagttttttcacggcgtgtccgtacaccgtttccagcgtaatgcccaaaccgccttcccgctcaaatattgtcccgacacacgaacgcgcggcgttttcatcgttccacgccatcgcccgccaaacgcccagcgtgtccatatccgcccaaaacgtttccgcctttttgtaatccaacaccagcttcgccgtatcggtaacggggtcgtaaaagccgttttcagcaagcatatcgcccaagtcgtgcatatcagggaaaagcgcgctgcggctttcaatgccgttttctttcagacggcatttcagttccgccaaggtatctcgcccgaagcaggtaaaaaacagcagcccgtccgtcttcaaggcgcgcgcccagttgtgcagcacaggaaggatttgttccgccgccaacagtccgagattcgaccacaacatatcggcacacgcttcgggcagcggcgcgatcggggattggcagtgttgcaccacgcccttacccgtaaacctttgccaaaaaccgcctttgcgggcggcagcggcagccgccaaaaaatccgcacgggaatcgtattcttcaaataccgcctgcggatagcgtttcgccagcaggctgcggctgatgtccgcatccgcaccggcaagcaggatatgcttgggcgcgttgcggacgagtgtcagccgttggtcggtatgttcggcaagatggcggtgaacctgccagcgtgcgtcctgatggttcatctcaaacccccttcaacaaagtcgcggtacagcgcggcaaacgcttccgcatggctcaaaaacggcgcatgcgccgccttttccatcacaaccaacctgctgcccttcaaacggcggtgcagatattcacccatacgcggcggcgtaatcgcgtctttgccgccgaacaccagcagtaccggaacatctatcttgtccaacaaatgccgcgcatccgccctttccgccgcgtccaacgcctcctgcaaggcttgaggcgtgccgcagcgcgccaaatcgggcaggattctgcctatgattccgtccgcatcaggcgtgtgcagaagctgtaattgtagaaactgtttgatatgtttggcataatccgaacggaacgcaccgaccattttgcccaatgcaggcgcggcaagcccttcgggatagtcttcgtcagccgtcagccgtgcgaaactcgccgtcaggcagagcgaacggactttgtcgggatggcgcgccgccagatacagcgcgaccaatccgccgagcgaccagccgagaatgtcggccggagcgtcaatttgagcggcaatgccgtcggccgcagccgcaatgtcgaaaggtcggacaaacggagcgtccccgtgtccgggcaaatcgacggcggacaccggccacgttgcaggcaggcgcggcatcaaatcgtcgaacatgtggcggttcgccccccaaccgtgtatcaggtaaacttttttgacggcatcaggcatggattttctctctcgttggcggcgcatcgcagacgcgcccactatcaggcgttgcgtattatgccacggttcgtctggcgtttcagacggcatctgcgccggctgccgcgacgatttggcggcataccgcaccgacgcggcaaacagctgccccctgtgtttcagacacatccaaggcggatcggtgtgcggcggctgtcagaaaaaaccgcccgcattcgaccggatgtgggcttcgctgcattacgaaccgcccgtcagcaatatgatacacgcgctgaagcacttggctgatttgagcatggtgcagccgctggcagacctgatgatgcagaatccgcccgaccggcttgcagacgaatgtttcgatttcgtcctgcccgtaccgctaagcagggagcggctgctgcaacgcgggttcaaccaaagtgaaagcatcgtcgggctgctggcacaacgctacggctggcagatactgccccgacacaccgttttccgacaccaccgcccgccgcaaagcacgctcaaaggcggcgaacggcggcgaaacatcaaaaacgcctttgaaatccgcacaccgataccggaaaactgtaatattctgttaatcgacgatgtctttaccaccggcgcgacgctggacgaattggcaaagacgctgaaaaaatcgggcgcaaaccgaatctgctgctggacgctggcacgcacgccaatgaaaaaataactaaattttttgacaccccatccgccttgtggcaaggttacgcgcctataagtgattgatatttatgtttaccatcgttttataccagccggaaatcccgccgaacacgggcaacatcatccgcctgtgcgccaataccggcgcggatttgcaccttgtcaaaccgctcggcttcccattggattccgccaaaatgaaacgcgccgggctcgactaccacgagttcgccagcctgacggtgcacgaaaacttcgacgactgcctcaaggcactcgcaggcaggcgcattttcgccctgaccaccaaaggcacggcgcgccccgatgaaaccgcgtttcaaaaaggcgacgttttactgttcgggccggaaacgcgcggactgcctgccgacatcctcgacagcctgcccgccgcgcaaaaaatccgcctgccgatgcagcccggcagccggagtatgaacctttccaacaccgtcgccgtgattctctttgaagcgtggcggcaacacggttacgcaggcggcgtttgaacgcaggttcatgccgtctgaaaacctatccggacacattccgaaccgccgtccgcactgtacggcggttcggaacgtatccggcgggcatgatgcccattcgtcttcaactcaagaacggaacacgttttgactttaacccgaaaaacccttttccttctcaccgccgcattcggcacacactcccttcagacggcatccgccgacgcagtggtcaaggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaacttcgccgtttcgtcatcgggtacgaacctctcggttgaaaaacgccgttacgaatacgtcgtcaaaatgggaccgtttacctcgcaggaacgcgccgccgaagccgaagctcaggcgcgcggtatggttcgggcggtattgaccgccggctgacggttatttgataccttattaatatccacattttccaacccacgatttacaaaggcaaaatatgaacatcaaacaccttctcttgacctccgccgcaaccgcactgctgagcatttccgcccccgcgctcgcccaccacgacggacacggcgatgacgaccacggacacgccgcacaccaacacaacaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactgaatttgatacaatccgtgccgtctgaagcccaaaccggtttcagacggcattttgcacccgacacttcaggattcggcacacatgatcagcagactgaccggcaaactggttgaaaaaaaccctccgcaaatcgtcatcgatgtcaacggtgtcggctatgaggccgacgtatcgatgcagaccttctacaacctgccgcccgtgggtgaaagcgtacaactgtttacccagcttatcattcgggaagacgcacatcttttatttggttttgccactgcggaagaacgcaagaccttccgccaactgatcaaggtcggcggcatcggcgcgaaaacggctttgggcattttgtcggcaatgactgccgacgaactggcgcgggcggttgcagaagaagatgtcaaacgcctctcctccgccccgggaatcggcaaaaaaaccgccgaacgtatggttttggaactgcgcggcaagctggtcgcgcatacggtaacggacgggctgtttgccgccgcacccgccgccgacgaaacggaagacatcgtcagcacgctgcttgcgctgggttacagcgaacgcgaagcaaaagcggcggtcaaaggcgttccggaggggacggacgtgggcgaaggcgtgcgccttgctttgaaaaacctgctgaaataatgccgcctgaaggcggcgcggcgtttgccctgacgaaaccctgcgtttccgcctcgcgctgtcttcccgacggcttttcccgtaaaatggcgttattgtccttcctttcagacggcattgtgtttgatgccgtctgaaactgttttaccgaaatcgaaaacaatgttgaacaaaatattttcctggttcgagtcccgaatcgacccttatcccgaagccgccccgaaaacgccagaaaaaggcttgtggcggtttgtctggagcagcatggccggcgtgcggaaatggatagccgccctggctgcgctgaccgccggcatcggcattatggaagccctggtttttcaatttatgggcaaaatcgtggagtggctcggcaaatacgcgcccgccgaactgtttgccgaaaaaagttgggaactggcggcaatggcggcgatgatggtattttcggttgcgtgggcgtttgccgcgtccaacgtgcgcctgcaaacccttcagggcgtgttccccatgcgcctgcgctggaacttccaccgcctgatgctgaaccaaagcctcggtttttatcaggacgaatttgccggacgcgtgtccgccaaagtcatgcagaccgcgctggcgttgcgcgacgcggtgatgacggttgccgatatggtcgtttatgtgtcggtgtatttcattacctccggcgtgattctcgcctcgctcgactcatggctgctgctgccctttatcggctggattgtcggtttcgcttcggtgatgcgcctgctgattcccaaattggggcaaaccgccgcatggcaggcggatgcccgctcgctgatgaccggccgcattaccgatgcctattccaatatcgccaccgtcaaactcttctcccacggcgcgcgtgaagccgcctatgccaagcagtcgatggaagaatttatggttacggtgcgcgcccaaatgcggctggcgacgctgctgcattcgtgcagcttcatcgtcaacacctccctgaccctctccaccgccgcactgggcatctggctctggcacaacgggcaggtcggcgtgggcgcggttgctacagccaccgccatggcgttgcgcgtcaacggtttgtcgcaatacattatgtgggaatccgcgcggctgtttgaaaacatcggcaccgtcggcgacggcatggcaaccctgtccaaaccgcacaccatcctcgacaagccccgggcactgccgctgaacgtgccgcaaggcgcaatcaaatttgaacacgtcgatttctcctacgaagcgggcaaaccgctgctcaacggcttcaacctcaccatccgcccgggcgaaaaagtcggcttgatcggacgcagcggcgcgggcaaatccaccatcgtcaacctgcttttgcgcttctacgaaccgcaaagcggcacggtttcgatcgacgggcaggacataagcggcgttacccaagaatctttacgcgcccaaatcggtttggtcacgcaagatacctcgctgctgcaccgttccgtgcgcgacaacattatttacggccgccccgacgcgaccgatgccgaaatggtttctgccgccgaacgcgccgaagccgccggcttcatccccgacctttccgatgccaaagggcggcgcggctacgacgcacacgtcggcgaacgcggcgtgaaactctccggcgggcaacgccagcgcatcgccatcgcccgcgtgatgctcaaagacgcaccgattcttcttttggacgaagccaccagcgcgctcgattccgaagtcgaagccgccatccaagaaagcctcgacaaaatgatggacggcaaaaccgtcatcgccatcgcccaccgcctctccaccatcgccgcaatggacaggctcgtcgtcctcgacaaaggccgcatcatcgaagaaggcacacacgccgaactcctcgaaaaacgcgggctttacgccaaactctgggcgcaccagagcggcggcttcctcaacgaacacgtcgagtggcagcacgactgaaccgatgccgtccgaacacccgttttcagacggcattcccacacccaaccccaaagaaaccatgaacgacaccgcccaaattaccgccagctacggccgccgctacattgtccgcacgcccgacggcacaacctacgaagccagcacccgcaaaaaacgcgtcgatttcgcctgcggcgaccgcgtccgcatcagccccgtcaacgccgaacaagttgtgattgaagattttttaccgcgccaaagcctgctctaccgccaagacgcgtggaaaaccaaactcatcgccgccaacgttacccaactcctcatcgtaaccgccgccgtcccgagtccgagcgtgcggctgctgcaacgcgccctgcttgccgccgaagccgccggtattgaagccgtcatcgtcctgaacaaagccgacctgcccgaaaccgccctttggcgcgaaaaactcaaattctacgaaacgctgggttatcccgtcatcgaaacccgcgcactggaaaacgccggcagcctgcgccccgccctgcaagggcacagcaacatcctgctcgggcagagcggtatgggcaaatccaccctgaccaacgcccttttgggcagccaaaccgcccgcaccggcgacatttccgccgcactcgactcgggaaaacacaccaccacccacgcccggctttatgatttgaacggcgaaacccaactcatcgactccccgggtttgcaagaatttggtttacaccacctccaagccgccgatttgccgcgctatttccccgatttccgccaccttgtcgggcaatgccgcttccacaactgcacccaccgcgccgaacccggctgcgccttcaaagccgccgcgcaaaccggggcggcaagccccgaacgcctcgcctttttgcagggcatcaccgacgaactgcccgggtaacgccttgccgcctgggcggaaaaaatgccgtctgaagccggattcgggtttcagacggcatccgtttttcaaaaatgctacaatccgctttttaccggaacatccgaaactatgttccaacacacaggacggcacataaagcaccgccctatgtattgccctgatttggaaagggttacacccctcccaaataaagtctgatcctgccgccctaaagggcggggtttcaaccgaaaaggaaatacgatgaagaaaaacgccccgaaatcgtttgaagaagccttgtcgcgcctcgaatcgctgacgcagtctatgcagggcgaaatgcccttggaagacgcgcttgccgcctatcaggaaggcaacgaactggtcaggtactgccaaaccaaactggcacaagtcgaacaaaagctacaggttttagacacagacgggctgaaggagttaaaccttgaatccgacgaatgatttgaaaacgtggcaacagagggcgcaggcgcaaacagagctgctgcttgaacggtttttaccgtctgagggggaaataccgcacacactgcacgaagcgatgcgttatgcggctttggacggcggtaagcgtctgcggccgatgctggttctggcagcttcggaattaggcgaagccgtgcatgaagcagtagaacaggcaatggcggcaatcgaaatgatccacgtctattctttggttcacgacgatatgccggcgatggacaacgacagcctgcggcgcggcaaaccgacttgccacatcaaatatggcgaagcgaccgcccttctgaccggcgacgctttgcagacacaggcatttgacgtgttgagccgtccgacagaactgcccgccgcacgccagttggcaatgttgtcggtgttggcgaaagcgggcggcagcaggggtatggcgggcggtcaggcaatcgatttggcgaatgtcggcaaacaaatggttcaagccgatttggaacagatgcacagcctgaaaacgggtgcgctaatccgtgcggcggttttattgggggcgacggcgtgtcctgatctgtcagatgcggaactttccgtattggacgcttacgcggcaaaactggggctggcgttccaagtcattgacgatgtgttggattgtgaagcggacacggcgactttgggcaaaacggcgggcaaagacgcagacaacgacaagccgacttatgtgaaactgatgggcttggaagcggcgcgctcatacgcacacaaactggttgccgaagcggtcgcgctgctcgaacccttcggcgacaaagccctgcgcctgcggcagttggcagaatttgcagtcgcccgcaaatattaaaaccggcgtatatcgccggctgaaacgtgccggcacagcgatgccggcctgcacttgaatgaaacaaatgccgtctgaaagggtttcagacggcattcctatgcttgtctattccctgttgcgcgtgtgccaaaaataccgccacacaaaacatggaaacgcaaaaatcaggtacaggcagacgactgtggcataaaactcccaaccctgatcgtgtaccgatcctgcacgggattcgaggatgtaggcaagaacggcggtcagcgcgaaacctgccgccagctcgatcatgtggtgtccgaaatgtttgcgcttgagtgcggccacgccgaacagtctggtcgtgaggaagggggcgttggcaaagatgagtgccaagaccaaaaggatgtacatggatgcggtcatggtgggctttctgtttaggcgttgtcggcggcgatgccgtctgaaccgcgttgcggaacggcatatcttaacaaaaacggcagcctctgacacggctgccgttgcggcggcttacagcgtgttctccaacgccttggcgcaccagtcgataacggtttgcggcatgatgccccacaggagcagcaagaaggcattgaccgtcagaacaaatttggcggcatagttgctgccgaccggctggtcatgatcaggcacatcgaagtagatgactttgaccacgcgcaggtagtagaacgcaccaatcagcgacatgatgacggcaaatacagacaaccaaacatggccttgtttcaagagtgccataatcacgccgaatttggcgtaaaaacccatcagcggcggaatgcccgccatagagaacataaccagcagcatcaaaaaggcaagccatacgcggtgttggttcaaccctgccaaatcgctgatgttttcgcactcgttgtccccgtccgacaacaccatcaacactccgaaccctgccgccgccatcagcgcgtaggtaatggcgtaatagaggcccgccgcaaagccgaccgcgcccgccataaacgccaacaggatgaaacccatatgcgatacggtggaataggcgaacatacgtttgatattggtctgcatgatggcggcaaggttgccgaccagcagcgaggcggcggcaagcagggcaaacatcagagaccagtcatgatgcacggttcccagcccggtaacgaggatgcggaaagtgaaaacgacggcggcgattttcggggcagtgccgaccaaggcggtaacagaagtgggcgcgccgtgatacacgtcgggcacccacatatggaacggcaccgcaccgagtttgaacgcgacggcgacgacgataaacaccaaacccagtttcaacagccattcgttggcttcttcattgaaggaagaggcgagcacgccggcaaattccagcgaaccggttgcgccgtaaaccatagaaataccgtagagcagcaggccggatgccagcgcgcccaaaacaaaatatttcaaggcggcttcggcggcaaagccggaatcgcggcgcagggcaatcagggcgtaaagggcaagcgacaagagttccaaaccgatataggcagttaaaaaatgccccgcgctcaccatcacactcatacccaacagggcaaacaatgacagggtgtaaaactcgcctttaaaaataccgcgcacttggttgtagggcttggcatagacaaacagggcaaaggtcaaggcatataaaaccatttttgccaaacgcgacataccgtctgcaatatacatcccgttgaacgaagacgtgctgccctgttcccacaccgccaactgcaccacagccgtaaccgccaccgttgccaacgcgccgtaatgcgtccacgggcgtttgtcatcactgacccacaagtccgccagcaacaataacaccagcagcgacagcagcacgatttcgggcatggcgggcattaaattcaaatcagaccagttcatttacacacctcaaatcttgctttgtgccacatgggcaatcaaatcgtttgccgcctgatgcaccacttcgataaatgcgttcggatacaggcccatacccaaaacagccaccgccaaaattgccaaaatcgcaaattcgcggcaattgatgtcttgcatttcggcaacgtgcggattgtggatcgcaccaaaaataacgcgtttgtacatccacagggtataagatgcaccgtaaatcagggtcatggcggccaacgcgccgacccagaaattcactttgaccgcgcccataatcaccataaactcgcccacgaagccggaagtcgcaggcaaacccgcgttcgccataccgaacagcatcataaacgccgcaaacttgggcatcacattgaccacgccgccataatcagcaatattgcgcgtgtgcaggcggtcgtacatcacgccgatacacataaacatcgcggcagacacgaaaccgtgcgaaatcatttgaatgattgcacctttcaatgcccagtcgtccaactgcccgtcaacaaacaaaaacatcccaagcgttacaaaacccatatggctgatggacgaatacgccaccagttttttcatatcggtttgcaccaaagccaccataccgatataaatcacggcaatcagacttaatacgatgatcacgggggcaaaatagcgtgccgcatccggcataatcggcaggataaagcgcaagaaaccatacgcacccagtttcagcgtaatggccgccaacaccatcgaaccgccggtcggcgcttcaacgtgggcatccggcaaccaagtgtgcacagggaacatcggcacttttacggcaaatgacaggaagaacgccacaaacaaaagctgttgtacgcccaacggaatctgttcgatgttttggaaatcgacaatagagaagctgcctgtttgataataaaggtaaaccatcgcaaccagcatcaggagcgaacccatcagcgtgtagaggaagagcttgaccgacgcatagacgcggcgcggaccgccccatacaccgataatcaggtacagcggaatcagcataccctcgaagaacacataaaacagaatcgcatcctgcgcggcaaacgcgccgttaatcaaacccgacatgatcaggaatgccgccatatactgcgccggacgtttctgaatgacttcccaacctgccaataccaccaacagcgtaataaacgcattcaagatgataaagagcactgaaataccgtccacgcccaatgcgtagttgattttcagaagcggaatccactcgtggaactcggtaaattgatagccgccgctcaaacggtcgaaaccggtaaacaggggcagtgttaccaagaaaccggcaagcgcacccatgaaggcgagcacgcgggcaaacggcgcacggctgtccgaccccgttgccaaaaccagcacgcctgcggcgatgggtatccatattgccaagctgagtaggtagttggaaaacatagtggttaacctgtggttaaaataaaaatgtgtttatgtggatatttcttcgtttcagacggcctgaaggtttaaggccgtctgaaaccttattcttatcggaacaatccccagaaggtcatgccgagcaagaccaatacgccgaacaccatagcggcggcgtaggtgtagataaagccggtttgggctttacgcacttgcgcggcaatcgcgccgaccagtttggcagagccgttgacaataccgttgtcaataatggcggtatcgccgactttccagaagaaagtgcccaatgcgcgtgtgcctttggcgaaaacgttgaaatacagggcgtcgaggtagtatttgttttcaaacaaaacgtaaatcggacggaacgtctgtgcaattttcgctggcaggtgcggcagtttgacgtacaaaagccatgcgctcaacacgcctgcgatagcaaggtagagtacgggcgaatgcaggctgtgggacaccattgccaatgcgccgtggaactcttccttcatgatgtgtatagtcggatgcgcgtcggcgttgacgaaaatcacgtctttgaagaaatcgccgtagagcatgggttcgatggcgatgtagccgatgatgacggacggaacggcaagcaaaatcaaaggcagggtaaccaccaacgggctttcgtgcggattgtcgtttttacccaaaccgtgatgttcttcgccgtggccgtctgaatggtgttcgggcaggctgcgccatttctcttcgccgtggaacaccataaagtattggcggaacgcgtaaaacgcggtaacaaacacgctggcgaggacggcaaaataggcaaagccgctgcccggcagtgtgctgtatttcgccgcttcgataatcgaatctttggagtagaagccggagaagaacggcgtaccaatcagcgacaagttaccgatcagcatggtcagccaagtaaccggcatatattttttcagattgcccatatggcgcatgtcttggtcgtggtgcataccgataatcgcgctgcctgccgccaagaacaacagggctttaaagaaggcgtgggtcatcacatggaacatcgccacggaataggcagacgcgcccagagccacggtcatgtagcccaattgcgacagggtggaatacgcaactacacgtttgatgtcgttttgaatcacgcccaaaaagcccataaacagggcggtaatcgcgccgatcaccataatgaccgacagcgcggtgctgctcatttcataaatcggcgacatacgcgacaccataaacaaaccggcggtaaccatggttgcggcgtgaatcaatgcagaaatcggggtcgggccttccatcgaatcaggcagccagacgtgcagcgggaattgtgccgatttacccatcgcaccgacaaacaggagcaaacaggttacagtaatcaaagaccattccacaccggggaacagttggatagtggcattttgcacgttgggcagataagcgaatacatcttgatagcgcaagctgccgccgaaataggcaagcaccaagccgataccgagcaaaaagccgaagtcgccgacacggttgatcaaaaaggctttcaggttggcaaatgtcgcgctcgggcgtttgaaatagaaaccgatcaagagatacgacaccaagcccaccgcttcccaaccgaagaagagctgaatgaagttgttgctcataatcagcatcaacatactgaatgtaaacaaagaaatatagctgaagaagcgttggtagccgactttttcatcgtgcatatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacttggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaaggcgtggactccgccaccactcaaaatcagctctgtaaaaccggtctgagtcttcttttcccccgtactcaataatttatccgccgcctctttaccaccaaattcatttacaatttgtaaaaatcgtgtcgccttgtaaggttgcggcaaattcaaagcctcctgataaatatttaacatggctttatgaaattcttgttctaactgatttttatccatcattcttcttccaatatttcagaccggattattcttacccagaatttcttttctcatccgctcccgtctgatcacctaccgaatcaggtcgtctgaaacagtctgaaatcgcttttcagacgaccctcagcctttttcatacccttcgtaataatacgactgctcgatacctttaaagatgatttcacggttgtccacatcgtcagtcaggttgtcctttaacagaaagcgcagttctaaatcgttgacggggctgcgttccatcgcctgcaaatacagggttttacttacattttgccagttcacgacttttttcaggttttttttcagcaccaaatccagccagatgcgggtacttctgccattaccctccaaaaacggatgggcaatgttcatttcaacatatttggcgatgatttcttcaaaagtccgctcgggcatctgctcgattttaaccaaagcctcttttaaatacatggcgttggcaaaacgaaaaccgcctttggaaatgttgtcttccctgatttgacccgcaaaatcatataagccgccgaacaggtaacggtgaatctgttgcaggcccgcggtggtaccgacttcgatacggtcgatgtcgccgctttcaaacaggcggcgggcattatgcaggctttgttcgtctatggatttcatcgtttttcctatcgggttttcagacggcatcggtgtcttgtcaggtctcgacccaacctacctttaccctttcaactcgtccaaatcggcaacgttgattgtttgtcggttgcggtacaccagcaccataatcgccaaaccgatggcagattcggcagcggcaacggtcaatacgaagaatacgaaaatttgtccggcagtatcgcccaaatgttgcgagaaggcgataaagttgaagttcaccgccaaaagcatcagctcgatcgacatcagcaataccagcacgtttttgcggttcataaagatacccattgcgctgataccgaacaggagcgcacccaataccaaataatgcgtcaaggtaatcatgctttgccctcctctttcggcttgaggtcgtctgaaacttcgctttcttcggcagattcgacttgcggtttgaccgcttccattttcaccagacgcatacggccctggtcggcgcgtactttgacttggtcggcaggatccatgcgtttcggattaaccgttttacggtgaaccagcgcaatcgccgccaccatacccaacaacagcaataccgccgccaattcaaacggcaacagatagtcggtataaatacggctgcccaaatcgcggatattgttgtaatcggcaggaatgtctttcatcagaccaaatgcggcaaggtcggttttcgggttgaccagaatcaggatcagcgcaaccgccaacaatgtgccgaccacaccggcaacaggcgcgtgccgccagaaaccggcacgcatttcttcaatgtcgatgttcaacatcatcacgacgaacaggaacaacaccatcacggcgccgacgtaaaccaccaccagcgtcacgcccaaaaactcagcctgcatcagcatccaaagcatcgcgctcacgcagaaggtcagcaccagatgcaaagcggcgtgaacagggtttttagcggtgacggttttgagcgcgccataaagaattatcactgcaaaaatataaaataaaatcagttggaaagtcatagtctatgctttctttattaatcaaaaatatggtttcaagcagtctgaaaatcctggttacgcaaacaatcaaacttaatcagttgatccatatccgcacaaatccacgttgtcgcaattttgaataacaacatttctatgtgatacggttttgcttgtttaccataaacttgtttcgccaaatcttgtaacaacccacaatattgatgaaacgaaacgtctggtttccgataattcggtttgatatcagaaaaatgaaacaatacgttcatatttcggatttctagttccctatttctaccttgtggctgaaaaaacaaatctgcatttgtaaatttaaacaacaaccaattcaacgaaaaaatagcgcgtgaatcataaatggcgaatcgctcacaatctataaaagaagccaatttagataatgatgaaattttcaacaaaccactactcaattttcccgaattaagttccgataaaaattgacgaataagctggctattttcagcagattgtttaaaacttttaatcccaccccattcacggataatccaataatgcgtcttcaagctatcatcattttgtaattttggggataaattttcttttaaaaaaatattttgttcaaaattacttaatccacttggcaactcaatcggactatttctagttctaatttcttcaaaattatctattggctcatgttcggctaaatatttcaatgcattaatcagtccttccatatttaaaaccttccaagaagccccaaagcattaacgatacggcgcgtcagcggctttgcgtttggcgatttcagcttcgtatttgtcgccaatggccaaaagaatcggcttggtcatgtgcaagtcgccttttttctcgccgtggtattcaaaaatatgggtttccacaatcgcatcagtcgggcatgcctcttcgcagaaaccgcagaagatgcacttggtcaggtcgatgtcgtaacgcttggtgcggcgcgtaccgtcttcacgttcttccgattcgatgttaatcgccattgccggacacactgcctcacacaacttacacgcgatacaccgctcttcgccgttcggataccgccgctgcgcgtgcagaccgcggaaacgcacggattgcggcgttttctcttcggggaaataaattgtgtctttgcgggcgaaaaagtttttgagcgttacgcccataccttttaccaattcgccaagcagaaaggtttttactaagttagccatattatgttccctcaaaacagggatttcgttaggtattcaaaatcgctttgttcagacggcctcaagatgccgtctgaaacttatttccacaaattcagcggtgaaatcatccacacgcccaaaatcacgatgtaggcgaagccgatcggaatcagcactttccagcccaagcgcatgatttggtcgtaacggtagcgtgggaaggtggcgcgtatccacagataccagtacagaaccgccgccattttcgcgaacatccaaaatgcggaaggcgtaccgacaatgccccagctttgcgggaagggagacagccagccgccgaggaacatcaacgatgtcagcgcggcaatcagaatcatgaaaatgtattcggcaaggaagaacagcgcgaatgcgaagccggaatattcgacgtggtgaccggcaacgatttcagactcgccctctgccacgtcaaacggtgcgcggttggtttcggcaacggcggaaatcagatagacgatgaagatggggaagagcggcagccagttccaagagaataccgaaccgcctgcgatgccttttgcctgcgcggcaacgatgtcggagaagttcatgctgcccgacaccatcacgacgcacaccagcgcggcactcatggcgatttcgtaggaaatgctttgcgcggaagcacgcattgcgcccaagaacgaatatttggagttggaagcccagcccgcgatgatcacgccgtaaaccgacagcgaggtaatcatcaggatgtacaaaagaccgatattgatgttggtcagcacccattcttcattgaacggaatcactgcccacgccgcgaaagacggggcaagcgacataatcgggccgatatagaacagggctttgtttgacagcttcggacgggttacttctttaaacaagagtttgaacacgtcggcaaacggctgaatcagaccccacgggccggttacgttcggaccgacgcgaagctgcatgaagccgatgactttacgttcgaaataagtcaggtaggcgacggtcagaatcagcggaatcaggataatcacaattttgacgatgacggataccaccaagcctacagtaatacccaaatcgcccagaccgagcgttgcggcaaagaggttttggaaccattcctgcataatcaagctcccgccagttcaatagtgtccatcaacgcacccagcgcggcattttcggtatgcagcggcagatgcaccacgttttcaggcagtccggcatcggctttgacggcaaccgatacgcttgcgccgttttgtttggcgacagcggtttgtccgtcttgcaggcccaagcgtgccaatgtatttggatttacacgcgcagcaggcacggcggcatggctggtttcttgcaacggtgcggaacggcgcacgatagaatcggtgtgataaataccgacgccgccgacacggacgaggcggtctgaggtcgtctgaacgccctcccctgtccatgcgttgcggttgtccagtttggacggcaggctttccacatccagcgcgtctttcaaaatcgcagcggtatcgtggtattcaaaacctttcaggtcaaacaggttgcccaatacgcgcaacactttccacagcggacgcgaatcgccgaagccttgtaccacgccgtggaaggattgcagacggccttccatattgatgaagctgcctgaggtttcggtaaacggtgcaatcggcaacaacacgtcgcacacgtccagcagcgtttcgctgacaaacggcgtaaacgccatcacgctttttgcctgtttcaacgcggctacggcttttgcaccgtccgccgtatcgatttcaggctcaacgttgagcagcaagactgcctgtttcggcgcgtttaccatttcgacaacgctcttgccggagtttacattcaagacatccgcaccaacgctgttggcggcttgcggcaaaatgcccagcactgcgccggtcgcgtcagccagctcttgcgcggcggcgtaaaccgcggcgtaatcaggatggttttgcacttccgcgcccaaaatcaccgctgctttttcagcatttttcaggctggcggtaacggcgtgttccgcattgacagacaggtttttcagacggcctgcccactcgtcgggatgtgcggcttcttgagacagaagcggcataaacaattcttctttactgctggccaatacgctcaatgccatacggtctttggcggcgcggcgcaggcgggcagtcaggagcggctgttctttgcgcaagttcgcaccgactaccaatacggcatcgttgtcagccaaagattcaatgctttgtcccaaccattgcgcacctttaaggccgtctgaaagacgtttgtcttgttggcgcaaacgggttgcaaagtttttaacacccaagccgtcggcgagtttcttcgccagatacagttcttcaaccgtattcatcgggttcgcccaaacgccgacttggttttgcttgccgtctttggcgatacattcaatcgcgctgcggacatattccaacgcggttttccaatccacgtccatccactcgccgccctgtttgattttcgggtttttcagacggctttcgtgatacaggccttcgtaggcgaaacggtcgcggtcagacagccagcattcgttaatcgcttcgttttccaacggcaacacgcggcggacggtatggtctttggtctgcacaatcaggttgctgcccaaagcatcgtgggcggaaacggatttgcggcggttcaattcccaagtacgcgcgttgaagcggaacggtttgctggtcagcgcgccgacgggacacaaatcaatgacgttgcccgacaattcggtttccaccgttttgccgataaagggcatgatttcggagtgttcgccgcgattcaccatcgcaatttcctgcaaaccggcgatttcttcagtgaaacgaacgcagcgggtgcagtggatacagcggctcatttcctcggcggaaaccaaggaccccatatctttgccgacgacggaacgtttttcttcggtgtagcggctggtggttttgccgtagcccaccgccaaatcctgcaactggcattcgccgccttggtcgcaggtcggacaatcaagcggatggttgatgagcaggaactccatcacgccttcctgcgcctctcgggcttttgccgaatgcgtacgcacaatcatgccgtctgtaaccggcgtggcacaggcaggcaggggttttggggctttttctacgttcaccagacacatacggcagttggcggcgatggaaagttttttgtggtaacagaaatgcggaatataagtaccgagcttgtgcgcggcttcaatcaccgtcgcgccctgctccacagatacttgtttgccgtcgatttcgatttgtaacatggttcgttcctagttacgggtatttgataaataatcttttatggaggtcgtctgaaaaatgggtttcagacggccttttgagtttcattgacaatcaatactgtttaaaacgtttactgccaccttgccgtcattcccgcacaggcgtgaatccattcttgggttttcggtaactgttttcaaacattggtttcttaacttttgcggtgattcccgccgtagcctgtctgcgcgtaggtggggctggaataacgacagtttttaaagttccagaaataaaactaaacaaacaacacgcccgacaagtccaatcattcagtattttgttcttcaatcagtttaatcttccattcacgtcgccattttttcatcgttttttctttggcaactgcttcaggcatattctcaaaaaactgataccaaactaaatcatgcacatcatatcgggcagtaaagccatcaatattgacatggtttttgtgctgccaaaccctttccggcaaattcatggtaacaccgatatagagtgttccatttttaccgtttgccaaaatatatacggcaggttgtctagtaagcggatggtttcgtattcatttttcctgcaatataaacaacaacttttttaatatcatttacaaccgttttcatctgaaaacatctgcctactcccgccgtcattcccgcgtaggcgggaatccattttttgaatttcggcaactgcttttcaaatatcgggttctgtaaattccactatggattcccgcctacgcgggaatgacggcaaagttaaatttttagcattttgcttttaaccaatataaaaccaactaaaactataactcatttattatatttttaaatgacttaaataactctttaacagcacgctcattgtcttcatctgtaggctcaaacttttcacaccaattaattatatttacatcgccatgcaataactctgcataacatcctactgcatcgcaactaccaccccgtgtccttgacgtgccaaaaataaaatcacaattatgcgaataaagtttgtataaatttcccctaacctcgtattcattatcaccagatgaataaaaaccaattctctgaccttcatgatcaaatactgcaacaaaatctaagccgtttccatgtctttcaaaaaagactagaaatttagaaaatttccgacaaatctgattaaaaagcgtattgagtgtcgtactcttacctttgttggctgcaccgtatagaataaaaattttagcttccaccattaccaccctccccacttatgctctttcatcggcccgccgtgttcgatgtaatgcacaaactcatcacggaaatgcttggtaaagctgcggacggggaagacggcagcatcggcgagggcgcagatggtgcggcctgccatttggttgccgacggaatccagcaaatccaaatcttccattttacctttgccttctacgatgcggtggacgatgcggtaaagccagcccgtaccttctcggcagggggtacattggccgcaagactcgtcgtagtagaagtagctcaaacgctcaagggctttgaccatgcacacgtcttcgtccatgacgataatcgcgccggaaccgagcatggagcctgctttggagatcgagtcgtagtccatattggtctgcatcatgatgtcggcaggcaatacgggcgcggacgaaccgccgggaatgacggctttgagttttttaccgccgcgcataccgcccgccattttcaagacttcggcaaacggcgtacccaatggcacttcatagttgcccggacgctcgacatggccggaaatacagaataatttggtaccgcctgcattcggaatacctttatcggcaaatgcctgtccaccgtcacggataatgaatggaacggaggagaacgtttcagtattgttgatggtagtcggtttgccgtacaggccgaacgaagcagggaatggcggcttaaagcgcggctggccttttttgccttccagcgattcgagcaatgcggtttcctcgccgcaaatatatgcgccgtagccgtggtgggcgaagagttcaaattcaaaatccgaacccaaaatatttttacccaaaaagcctgcggcacgcgcctgctccaaagcggcctcaaagcgttggtagccttcaaaaatttcgccgtggatatagttgtaaccggctttcgcgcccatcgcgtaaccggcgataatcatgccttcgatcagggcatgcggattgaacatgatgatgtcgcggtctttaaacgtacctggttcgccttcgtcggtgttgcaaaccacatatttttcgcccgggaaagaacggggcataaagctccatttcaaaccggtcgggaagcccgcaccgccgcgcccgcgcaaaccggaggttttgacttcgtcaatcacatcggtttgcgagatgttttcggacagaattttacgcagggcggtatagccgccgcgtttgacgtattcgtccaatgtccagcaatcgggattggcggtatccacttggtcaaaaatcacgcctgattggtaaatagccatttttggtgtgcctgtttgttttcgtatcggttgcggccgctgtttcagacgaccttaagatgtctttgtgtaccggcttgtaacgtcgtctgaaataaaatctagtttatcaaatcgatattttcagacgacctttaatcgtttttgttggatctcgaccacttgcttgtctgtcgtcattcccgcgcaggcgggaatccatcctcaatggtaagcaatgtcttattaaattcagaaaccgaatcttaccggtggattcccgcctgcgcgggaatgacggcatttcggtatttcagtagggcggattcttaaatccgacattttgcctttttacccactctgtcggctacaagtatccgacctacgtttaaatcgtcgtttcagacgacctactccaactccgccagtttcttctcaatcgcttcttcggtcataaagctgcacatgctgtggttgttgaccagcataacgggagcgtcgccgcatgcgcccatgcattcgccttcgacaagggtaaacttgccgtcaggggtagtttcgccgtagccgataccgagtttttgtttgaggtattcgccggtagccataccgccgcgcagggcgcagggcaggttggtacaaacggtcagtttgtatttgccgacaggctcaaggtcgtacatattgtagaaagtggcgacttcgtaggcttgtgcaggcgtgatgccgatgtagtcggcgacaaaagcgatggtctcgggagcaagccagcctttttcggtttgggcaatacgcaatgcgcccataatcgcggagcggcgttggtcggcaggatattttgccaactcgatgtcgatttgttttaaagattctgcggataacattatcggtcaacctccccgaatacgatgtcctgcgtaccgatgatggcaacgacgtcggcgagcatgtggccttttgccatttcgtccatgccttgcagatgggcgaagccgggtgcgcggattttcaggcggtagggtttgtttgcgccgtctgaaatgatgtaaacgccgaactcgcctttcggatgttcgacagcggtgtaggtctcgccctcgggaacgtgcataccctcggtaaagagtttgaaatggtgaatcaggtcttccatacctgttttcatttcggtacgtttgggcggagcgaatttgtggtttgtggtaatgaccggacccggattgacacgcaaccactcggaacattgtttgatgatgcgtacggattgacgcatttcttccatacggcagaggtagcggtcgtagcagtcgccgttcacgccgacagggatgtcgaaatccattttgtcgtacacttcgtaaggctgtgtcttacgcacgtcccattccacgcccgaaccgcgcaacatcacgccggtaaagcctttttgcatggcacgttcgggggagacgacgccgatgccgacggtacgctgtttccaaatacggttgtcggtcaggagggtttcgagtgtgtcgatatttttggggaagcgttcgcagaaggcatcgataaagtcgagcatggtgccttcgcgggattcgttgagctgcttcaatactttggcattgcggaatttgctgccctcgtatttgggcataaagtcgggcaggtcgcggtaaacgccgccgggacggaagtaggcggcgtgcatacgcgcgccggacacggcttcgtacaagtccatcagctcttcgcggtcgcggaaggcgtaaagaatggcggtcatcgcgccgatgtcgaaggcatgcgaaccgatgcccatcaagtgattgaggatgcgcgttacttcggcaaacatcacgcggatgtattgggcgcggatgggcacatcgataccgacaagtttttctactgccaaacaatacgcctgctcattgaccatcatggaaacatagtccaagcggtccatatagggcagggcttgcagataggttttggtttccgccagtttttcggtacctcggtgcaagaggccgatatgcgggtcggcacggacgatttgttcgccgtccagctccaaaatcatacgcaatacgccgtgcgccgcagggtgttgcgggccgaagttgatggtgtagtttcttaatttattggccaccgtagttctcctcacggacgatacgcggcgtgatctcgcgcggctcaatggtaacaggttggtaaatcacgcgtttttgctcttcgtcgtaacgcatttccacatagccggaaatcgggaagtctttgcggaacggatgtccgacgaagccgtaatcggtcaggatgcggcgcaagtccggatggttgttgaacatgatgccgtacatatcgaaggcttcgcgttcgtaccaatccgcgctgttgtaaatatcgactacagattcgactacggggaagtcgtcgtctgaaacccagacgcgcacgcggatgcgttgattgtttttaacggaaagcaactgactgacgacggcaaagcgtttgccctgccatgcttcgtttttgtaagtgctgtaatcgacaccgcacaagtcaaccagaagctcgaaatgcaactcttcatggtcacgcaatgcggtcatgactgaaatatagtgctcgggcagacactcgacggtaatctcgcccaaagcggaaatgactttgcctgcctgattgcccaaaacgcggctgacggtttcgtataagtcttgaatgcttgccatatcgtcctctccttactcgtcacgcgcaatggtggaagtgcgcttgattttttgttggagctgaatcaggccgtaaatcagggcttccgcagtcggcggacaacccggcacataaacatctaccggcacgacgcggtcggcaccgcgcacaacggaataagaatagtgataatagccgccgccgttggcacatgagcccatagacaatacccagcgcggctcggcgagctggtcgtacactcggcgcagggcgggcgccattttattggtgagcgtacccgccacaatcatcaggtcggcctgacggggggacggacggaaaataataccgaaacggtcaaggtcgtaacgcgccatacccgcgtgcatcatttccacggcgcagcaggccaagccgaaagtaaccggccacaacgaaccggtacgcatatagttcagcaccgtatccgcgctggtggtgatgaaaccttttttcaaaacgccttctattcccattccagcgcaccttttttccattcgtaaacaaagcctaccgtcagaacaacgataaacaccagcatagaccagaagccgtacgcgcccaaatctttgaacacgactgcccacggcagcataaacgcgacctccaaatcaaacaggatgaagaggatggcgacgaggtaatagcgcacgtcgaacttcatcctggcgttttcaaaagcttcaaaaccgcattcgtaaggcgcgtctttttcggcatagtggcgtttcgggcctaaaatcgtgccgagcaggataaacagcacgccggccgcgaggccgatgaggataaagacaaagacgggaaagtaagcggacaacatggttacacccaaatccgttaacaaaatttctacaataatttcgtattttagcgaatttcaaaaaccattaaaaggtaaatatcggcaaaacgcccaaaaaaacccaataaatacaatcatgttatgataacgattcttatttgattttataaggtcatataaatttttacaccgtaattcgtggtatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccactatatataggaataagaattcgggacaaaatgtttaaaccattttgtcccgactgctgtgatgcggtttttttgaactagcaggacgttacctaaaacctgcgttgcctgaaaccctttaagacggttaaatccctctgccgtatttgtattctacaatcatattatcgtcggtaataacttccgccccagccgaaggttccgtcatctgaatcagcatacgagagacaaccttttgtgctgcagcatccacggtgctgctgtcaaatacgtgcctgccgctttccggccaaatcaaccgggagagacgttgcttgagcagttctttattagggaaaactaccggggttgccgagccgactaccatatgcccatagcggtatgcatagggaatactgtgtacggcggtagcaaaagcatgcgggctgtgcgtggtattaaacattacaataccatccggggtaaggtggctttgcacctgttttaaaaattccgcactcaacaggttggtggaataggcacgccagtaccaagtcgtattcatcaaaatcaggtcgaatttttcatcaggatggcgacgcagccatttcctaccgtcatccaatacaatttcaacacgtttgtcctgcaaaagcggggcgatttgcggctcgtccgcgataaggctacggtatgccggattgatttccgcaacgatcatcgactgcatttccggaatggcagacaagacgcgcgcccacgaacctgtactcagtccaacgacgaaaatgcggcgtatgccagacttcagggagggtagcagataggcacgttcgatgccgttgacactattgaatacatcggtattgtatgcgccgtcgtatacattcgccccataaacaaccttatcaccatctctatggtaaaccgcaacaatgccgtgtttgttttcaatcagcctatccggacggtcagcaatattttgaaagacagaatccggcagtaggaacatgaggatgccgaacattagggaaactgctaccgacactgcattcagtcggagacttttttggaacagtgtacaaaacaaagggacagcagcagaaatcaaacagatgagcaggtaaatctgttgggtggacaagaaatcaagtatcacaaagccgataaggaccggacccaatgcactgccggcaacgttggcgaaataaacattggaaacctgtcgtccggatttgttgccatccgtacccacatggtgtacgagcgggaaaatcaaccctctgacgacggcagacagggtaatgaagataccggcgtggtggacgaagccggaaaaacccgtcaacaaccacgcagcacccaaaatcaaaaagtcggcaatacccgcccacaagaagcactgcccgataaagggaatatcaacaaagcggctgcggcaaatccgtttgccaaaatacgcgccgacggcgataccggtcagaaaacaggcaagggtaaatgaaaatgcctgaggcacggactgtgctgcgaacgaaaacatcctcacccacaagacttctatacccaagctcaataagccgctaaggaaagaaagcatataaatcaaactagtattcggtttagtgttcactatatccatcctttctgtaacgcagccatactgaagcagcaatcagaaggttaaagcaggctgtcagcgcaatggtttgggagagggtaaaaaagacgtagaaaaattcggcggcggcaagcgatccgagtgccgcacccaaagtgttgaaaaaatataaggtaccgatagactcgccaacattatgtattttccggttaaaaaaacaggtcagcaagggcaaggtcgcgcccatcataaaggtaggaagcagcaataagaggaaattggcagcagcgatgatgggcaaatcagcctcaactaaaagatgccccaagccggaaatcagacccctgcttaccaaaccgaacagaccgatggatacttcagcgatgcaaaacagggggatgatacttgaaggaaaacggtcagcaatgcgtccaccgaaatacgcacctacacccaagccgaccataaatacagaaataatgacagtaatcgaactcaaatcgatacctatgtgactgaatagaagcctctgccagctgacctggtaaatcagggcgcagaatccagaggcgaaaaacaccagcgacaatcctttcagggttttacttgcggtcgaattcatattttctattttcaaataggcggaactataaatgaaatgtatcaatgtgtaaacatttgtattaaccgtaggaaatcaccgtattgctcaaactgcaggccgggaaaataaactcgtaagcccgcaaacggcgtatcactgttcaaactgctgtgcggcttcacggtgttataaaaataatggggctgtcctggacaactaagataaactcgattttactaattgttttaaaatggaaatttgaacttttatctcactgttgttaaaacgccattcgcactcctttaaatacagctcaaaatgcgctttgggaatgccgttaaacttgcgtaaatgaatagctacgataacaatccgtataaacaatgctgtcgggctctgttgctgttcttgcagttacacctgcgacaaatagctcaatgagtttattttgtttataccggcttagacgactttttctcatagggataattctaacttaatttgaatttccctatttatctaggacagccctaatgattaaattggatttaaaaagcataaatttatatgatattgattttgaaaaatttacccccgaaattccagataatttccatagatggatagatttggatatcggaatcgaaggagaacaaggctcatctattttttcactttgcatttgttctcctaaatggatttcccatcattgtaataaagaaggttttttttggtctaatgcattaatattagaacagtttgatcataagattattaaaagtgaaattgataaaatattagaatattgctcaaaagaaacttgggatttgacactttcaaacttattacgatttttttcttgggaattcgaagattacaatccaaacacataagagcaatttgggatgataagtctggagcaattgtaatcagagacccaaattcaaaagatggtggaactgcatttagaccaaccttaggcaaaacttactttgacaaacaaaaataaaattattatgaatataatcaattacaaaggtgatgacattattatttctttaacaagagaagagcttcaattattgcgttcccttgttattgaaatttatgcaggtgtttgcatagatgcagaagaatttgagattgtgtcaggaattcgcaatccaaaattggtataagagctagaacaacaattaattgaagcatatgatttaatggatacaacaggataaccgaattatatttgagatagctccaaaattgataagttctgttaataatgtcaatgctgtcggggacagttttttgcaaaggtcttggatggcgcgttccaccaaaccgttttccttacggattcaagcgattacccgttatttcgcccgttttctcttgatgatttcagtttttcaaccaccgttttatatttcttcgtcaataaactcatcttcatgccgcaagctgcggataaaggtttcaaaatcgggggcaagttcgacgatttcaaaatccgattcttgttcgacaaacaccactttcggctcgccgtctttgccgcacgcccgatagtctaaggcaaacatggcatgaccgcctgacgggtcgttggcaaaatacacgccgataggcgggtattcccattcttccagccaaagtttttgccccatcgcgccgcacaaactcccttctttttcaaaaccgattcccgatacctcgcaaatttgcacatgattttccgcccacgaatttctctgcgtggtcggaaaacagtttttgacaaatattccgccgttttgtactgccatcaattcaataaaactttgcggcaatttatagcccagttcactttctacggcagccaaaatttcaggggtaaacggggcttctttgtagttttcatctgcccaactattagttttccatacggaggacaagtcaaaatctttaaaaacttgggacataatgttcttccttattgatctcagtgataacagagggtgggtattcatacccggcttttaccgtccgtcatttatgttccggcgggaatctaggacgtggaatctaaagaaaccttttatccgataagtttccgtgccgaaaggtctggattcccgcctgcgcgggaatgacggcggcggttgcggcaaaattgcccttcccgttttcagacggccttttgctttgtccttactacgttttttgccgtaagtcagattcttgtatccgacatttccaacagcggtgtttcggaaacaatagacgcgtcaaatgtttttgtcggatacgaatatccgacccacatctctatttgctctgtgtgtacattgtagcgtgggcttcatccacgataatgacggctaaaaatgccgtctgaaattttgggcttgattcatagaaaaagcccacgctacgggtttctattctctcctgctaaggtttttgccgtaggtcggatacgaatatccgacctacatttcaaatttacatctcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttatctttggatgcggcggtttggcgcgtgttgccgtaactgtcgtaggcaggctttttgacggacaggtagtgcaatacttcgggtgggatctcttcgacgaagcgggagacgatgccgaattgggtttgtccgtgcagcatgcgttgttgcgccatggtgatgtagaggcgtttgcgggcgcgggtgatggcgacgtacatgaggcggcgttcttcttcgaggccgccgcgttcggcaaggctcatttcgctggggaagcggccttcttccatgccggtgaggaagacggcgttaaattccaagcctttggcggcgtggacggtcatgagttggacggccttttcgcctgcgcctgcctggttttcaccggattcgagggcggcattgcttaggaaggcgagaatggggaaggcggggtcgtctgaaatgttttcaggcaggatttcgaagttgctgtcttcgggtttgaattcgatggcggcgttgacgagttcgtcaaggttgtcgagacggtcttggttgtcgcctttttgggtgcggtagtgttcggtcaagccactgtctttgaggatgccgacgatgatttcggacagggacagttgtccgacttggttgcgcagggcttcaatcaggcggacgaaggcgacgactttggcggctttcgcgccggcgttgcaggcggcttgccagagggtgatgccttgttcgtttgaggccgtctgaagattttcgacggtacgtgcaccgatgccgcgcggtgggaagttgatgacacgcaagagggcgttgtcgtcgtcgggattgacggcgaggcgcaggtaggcgagcgcgtgtttgatttcttggcgttcgtaaaaacgcaagccgccgtagattttgtagggaatgccgctgcggaacaggctttgttcgataacgcgggattgggcgttgctacggtagaggacggcgatttcgtccaaatcccagccttcgcgttcgagggctttggtttcgtccaagatgaaccgggcttcttcgaggtcggtaaaggcggagtagtagcggattttgtcgcctgcttcggcgtcggtgcgcaggtttttgccgagtcgttcgtcgttgttttcaatcacggcattggcggcggcaaggatgttgccgacggagcggtagttttgttcgagtttgacgggcgcgtcgatgtggaattcttccatcagcgcggtcatgttgccgacgcttgcgccacggaaacggtaaatgctttggtcgtcgtcgccgacggcaaatactgctgcgtggttgccggcaatcagtttcagccaagcatattgcagtttgttggtgtcttggaactcgtcaacgagaatgtggttgaagcggttttggtagtgctggcgcaggatttcgttgttttgcagcatttcgtagctgcggagcatgagttcggcaaaatcgaccacgccttcgcgttggcagattttgtcgtattcggcgtagcactcaatcatgcggcgtgtgtgcggatcgggcgcgctcaacacggaagcgcgcaaaccggattctttttgcgcgttgataaagccttgcagcgaacgcggcgcgatgatttcttcggcgatgttgaggcttttgagcaggcgtttgatgagggaaagctggtcgccgccgtcgaggatttgaaaggaagacggcagaccggcgtcgcggtggtgcaggcgcaaaaagcggtggcagagaccgtggaacgtgccgagccacatggcgcggacattgatgggaatcatcgcgcccaaacgggtttgcatttctttggcggctttgttggtaaacgttaccgccataatgctgtgcacgctggcttgtccgctttgcaacagccatgcgatgcgcgtggtcagcacgcgcgttttgccgctgcccgcgcccgccagcacaagtgcggattgcggcggccaggttacggcggagagttgttcgggattcaagccttgcagcaggttgggggcggattggtcgggaaacataaggatgccgtctgaaaagtggaatgcgctattttaatagaaacggtttaaggtcgtctgaaaaagtgcagcggcagggcagcacttttccaatcgacggtttgatgatgcagcacagaagatattgacaaaccgccgcccctgcatatagattcattaaaacataaccaaaatgaacaacaaatgagaatagagatcacaccaatcagcgaatccgctttggtctaccgactgaatgcgccttccgaactgggcaaacagcaaaagttgtgggcgtttgccgctgcgctcgggcagcacgacaggattgaggaagtggtggtcggcatgaacaatctgaccgtgtttacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcccggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatgattcacgtttcggcagtgcaggcaccggcgcatattcaggataccggacgctacggacaccggcgttacggcatcggtcatgccggtgcgatggacacggttgctttggcggcgggcaatattttattgggcaacgacgaaggcacggccgcaatcgaaatcgctttgggcgggataatgctggtgtttgaacgggatacgccgttttgtctcaccggtgccgtgtatcaggcggaattggacggcgaaccggtctattcgtattggcgttataccgcccgcaaagggcagaccttgaaactggtgcgtgccgtgcagggcatgtacggctatgtgtgcgtggcgggcggatttgatgtgccggaagtgatgggttcgagaagcaccgacctgaaagccggtttcggcggccatcagggcagaatgctgcaaaaaggcgattatctccccatcggcaaaggtgcgcaggaattgtccaaagtcggcattgccccgataccgtttaccgataccgtccaccttgttccttcgtcggaatatgccgctttcagtgaaaaagggcgtctgaatctggaacgggaaacgtggacgctgcaaagcgatagcaaccgcatgggctaccgcttcgacggacagccgctgaccctgtcgcaacctttggaaatgctgtcccacgctgttcaggcaggaaccgtgcaggtgccgcccggcggcaaaccgattatcctgctggccgatgcgcaaaccaccggcggttatccgaaaatcgctaccgttgccgccgccgatttgggcaggctggcacaggtgcgcttcggcagcaaagtcaaattcaaaataatcggcttgaaagaagccaccgccctgcggcgcaaaaacaagcctatctgaaccaaatacggagaatcacccatgaagcaggttgatttaaacgccgatctcgccgaaggctgcggcagcgacgaagccttgttgcagctgattacttcggccaacatcgcctgcgcccaacacgccggcagcattgccgatattcgggcggcattggcgtatgcccaacaaaacggcgtgcgcatcggagcacaccccggctatcccgatcgggaaaacttcggccgtaccgaaatgaatctgtccgaagccgatttgcgggcgtgtctgaattaccagttgggcgcattgcaggccttgtgccgtgatcagggtttggaaatggcttatgtcaaaccgcacggcgcaatgtacaatcaagcggcgaaaaaccgtgcgctggcggataccgttgcccgaattgtggcggatttcgacccgaaattgaaattgatggcactttccggcagcctgctcttggaagccggaaaagccgcaggcttgggtgtgatttccgaagtattcgccgaccgccgctatatgcccgacggtacgctggttccccgcagccgccccgatgcgcaggtggacagcgacgaagaagccatcgcccaagtattgcagatggtgcgggacgggcaggtcaaagcagtggacggcagcctggttgccgtgcaagccgacagcatctgtctgcacggagacgggccgcacgccgtggtgtttgccgaaaaaatccggcaggaactactggcggcaggcatcaaagtttctgcttgaaaaacagttcataggccgtctgaaaaccgcaggtttcgccaaaacgagcaaagcgagtttctgcgtagctaaaaccgcaggtttcgcccaaacacagcaacaaccaattttatagaggataagcgattatgtctgatcaaaaaaaccgcagaaatgccttaatcggcgctgcattcctgatggcgacttccgccatcggcccgggctttctgacccaaaccgccaccttcacccaagcactggcggcaagtttcggctttgtgattctgctctcgattctgctcgacatcggggcgcagctcaatatttggcggattgtcgccgtttccgaaaaacaggcgcaggatattgccaatcaggtcttgcccggcgcaggctatttcttggctgtgctgattgtgatgggcggtttggcgttcaatattggcaacgtcggcggcgcaggcttgggtctgaacctgctgaccggactgtcaccggaaaccggtgccgtgatcagcggcgtgattgccatcggtgtgtttctgtttaaagaagcaggcaaagtgatggacaaattcgcccaagtgatgggtttcgtaatgattgcgctgacggtttatgtggcatggcaggcgaatccgccgctggcagatgccgccgtgcatacctttatgccggaaaaactcgatgcaatggcgattgttacactggtgggcggcacggtcggcggctacatcaccttcgccggtgcgcaccgtctgctggacgcaggtatcaaaggcaaatcggcgttgccggaagtgagccaaagctcggtgcgggcgatcctgattgcctcgattatgcggattgtattgtttttggcggttttgggcgtggtcagccaaggcgtacagctcaatcccgacaaccctgcttccacaccgtttgaatatgcggcgggatacatcggcctgctgattttcggcgtggtgatttgggcggcttcgattacttcggtgattggtgcggcttatacttcggtgtcgttcttctccggtctcagcccgtctatcgaacgcaataaaaacaaatggattattgcctttatcgccgtgtccaccgccgtattttccaccatcggcaaaccggcgcaggtgctggtgttcgtaggcgcattaaacggcctgattttaccgatttccctcggtctgattctgattgccgcctacaaaaccaaaattgtcggcgactacaaacacccgctgtggctcaccgtttccggcgtgattgtggtcggtttgatggcagtactcagcgccatcaccatcagcaaatatatcggcggcttgttcggctgaaccttgtagcgcagatgtttgattttgtatattatccgaagtttgccgcctgatatggaaaattcctgtttcagacgatgtatccggtctgaaacctattcacaactatgaaacgcttcacctatactctttccgacggtttgtgcatcgaaatcgaactcaaacgcagtgccaagaaaaatctgattctgcgccccgtcaatatgcagacggtcagcatcaacgtcccacccttttttcaagaccacgcgttagcaaactggctggcggcaaacgaaacgattttgcggaacacgcttgccaaaacgcccgtgcatcctgtttcccacccaaacttacccgagtggatttggtatcggggaataaagaccaagctggatacccacagccaaagccatatccgtatcacgtcgtctgaaatcctgcttccccgaaaagaaaccgccgcacaaatcgaccacctgcgccgcctgttgaacgaacgcgcccgcgaatacctgctgccccgccttgaaaaacacgcagccgaaacaggactgacgcccaccgccacagacctgagcaacgccaaaaccttttggggcgtatgccgcccgcacaccggcatccgcctcaactggcggctgatcggcacgcccgaatacgtcgccgactatgtctgcatccacgaactctgccacctccgccaccccgaccacagtccgcgcttttggcatttggtgaacacgctgacgccgcataccgacaatgctaaaagttggctgaaggcgcacgggcgggaattgtttgtgctggggtaaaggctaaccgtagcgtgggcttcgcccgcgagaatccaccccctcccgtacggagggagagggttggagagagggtggctcttgtcccttgttctgtatatttgcaagccaccctatcctagccttcccccgttggataagggaaagggatcaagctgctgtaactgaaagaggtcggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctaaaaagtagaatgcgctattttaatggaaacggcggggttttaaacggttcttatttgtttgttttgatttttgcttggataaaaaatcccatcattcccacaaaaacagaagcctgaaatcccgtcattcccgcgaaagaggaatccggtttttgggtttcagccattcccgataaatcgctttagctctgccgcaaccttaaaacggcacggtacgaaaataccgtctgaaacccagattgtcaggcttcagacggcattttttgttcagacggttgccgcttcttcgccgaacacttcccgccacaatttcctgacattgccgtaatgtgccaacagttcgccggttacttcggtttttgccgcgtcgcgcagtttggtgttgtgctgctgccggcggtagaagcgataggcggtgcggctttgtccggcgagggttttgtcaatcaaaccgcagtcggcggagatgtttaagagggcgatgttgccgtagttgtccaagagttgcggatactggcgggcatgggcaagtatcagatattggacgataaattcgacatcgaccacgccaccgcgcgcgtatttgacgttgctgtcggcaggcgggtgggtggggaacattttttcgcgcatttcgatgatttcgcctgccaaggcggtttggtcgcgttcggcggtgaggatttcggtgcggatgcggtcgaaggccgtctgaatttcggacgtgccgcagatgaagcgggcgcgggtaagggattggtgttcccacgtccaggcgttttcgcgctggtatttttcaaaggcggcgatgctgtgggcgaggaaaccggcgtcgccattagggcgcaggcgcaggtcggtttcgtagaggctgcctgcgccagtggcggcggaaagccagttggtcaggcggcgggcgaggcggctgtacacgtcgcctgcgtcggggtgggggtcgtcgtagagatagacgaggtcgaggtcggaggcgtagccgagttctttaccgccgagtttgccgtagccgacgacggcgaattgcggtgtgtcgcggtgttttttgggcatgtccgcccatgcgcacagcagggcggcggcgaggatggtgtcggcgagggcggagagttggtcggagagggattctaccgtccacagtccggcgaggtcttggacggcgagacggaagacttgggcgtgctggaagcggcgcagggtgtccatttgcgcttcagtatcgccgccgcaggctttgaggtcgtctgaaagggcggcggcgagcgcctgccaatcaaacgcggtatccaaaagctgcgcgctgatgagttcgtccaacaaaatcggatatttgttcagatacgccgccacccaagaactttggcccataatctgcgccagttgcgccaaggtttgcggatgttcgttgaggaaggcgagataggcggatcggcggctgatgttttcgagaaaatccaacagccgcatcaatgtatcggtcgggttgctttgcgctgccgccgcctgtacgaacagcggcacaaccgcatcgaaacgcggctgggcgtgtgcggaaagatggcggtatttatggccgtggcggatttggtcgagccttgcggcgacggtttcggcatcgaacccgtgcgccttcagacggcatcgccgcccttcttcgtcgggtttgtcctgccatgcccattgccattcgctgttgtcttgcgtttgctcttcgggttcgctcaaaatttcgttgaacaactgattgactttgttccgatgaacattgagaccgtctgaaaaagcggaataactgtcgaaacccatgctttcggcgagcagttgccgctgttcgggcgaggtcggcagggtttgggtttgctggtcatcccagtattgcaggcggtgttcaacatcgcgcaggaagcggtaggcggcaagcagggtttcgacgtgttcagacagcatgatgcccagctcggcaagcttcttcagcgtttcctgcgtgcctttcagttgcagcgcgcgcatttgtccgccgcgtatcatctggaaaatctgggcgataaattcgacttcgcggatgccgcccgcgccgagtttgatgttgtccgccatgccttttttgctgacttcgctgctgatttggcggtgcagcttacgcatcgcctcatacgcgccgtaatccagatatttgcggaacacaaaggggcgcaccagtgctttgatgtcgttcggatacggcgtaaccacgcgacctttgcaccacgcgtagcgttcccattctcgcccctgtgtaatcaaatattgctccagcgcggtttcgctcaataccaacgcgcccgaatcgccgtccggccgcagccgcatatcgacgcggaacacctgcccatcggcggtaatgtcgttcagcagcgcaatcagtttctgcccgactttggtgaaaaattcctgattgccccgttcgcgcctgccgtcggtgtcgcctgattcgggatagacgaaaatcaaatcgatgtcggaagacacgttcaactcatagccgcccgccttgcccatcgccaccacgctcaaatgctgcggcgatttggtataacgcccgatcggcgtgccgtacatgtcccgataataggcgtaggcaaaatccagcgcggtattgacggcaaaatcggcaaacagcgtaatcgtgcgggttacttcgttcaaatcgctgatacggttgatatcgcgcacgataatctgcgacaccacataacggcgcaactcgcgcaactgccgcgccaattcttcctcgttttcttccgcgcggatttcgccccagtcggcaaaggcttggaaatccgcttcggtcaaaaccttgtcgagcataggcaggaatatttcgggcttgagtttgccgttgtcgagctggcgggcgaggaagagggaatggcggcgggcggtgtcgaggcggttgtcggacatttcggattccgtttggaaggatgacgggaatgagatagtggattaactttaaatcaggacaaggcgaggggatgccgtaccggtttaaagtcaagccactatatcatagcaaccttcgatgtcgtctgaaaccttgccccgatattcggacggatgcctaccaataaaaaacagcggcaaatgccgccgtttcctgttcacacctcgccacgctcttttaaaatagcataagccgcacttttctcccgtgtggaatttttaaaaaaaccatcactcttgacgatttcatgcagctcctcacttgatttctccgcatattccattttcaacgccttatgctcattgccggcttcaatcattccctctcccactgcttttgctgcttttgccacaccattccaaaaacccataatcatgtcctccaatcgtttcaaataaggtcgttgtttctgtcaagaaacaacgacagtttataaactgtcggaaaacaaaatgccgtctgaaggccggataatgcttcagacggcatcggattgccggttttaaccctgccctccgccgttgttcaaatagtgttcccagtgagaatataaccgggcaatattttcttcataggtgtgggcagaaggaatataaccgtctttgggcggcatatacctgacaaatgattctatttcttccggataatcaaaatctgcataaattttttcaacttcccccaaaggatcctcaaattcttcttttctatggaatacatcgcttaagaggacgtacagccaatttttaggggaataatccctcatttccgaagccaaatcttccagaacaggctttaattcaagaatattggatttgttgattaaagatagtttgaacacacgttcatcatgatctgaaagcgtcatttttcgggcataagctgccacatcagcccaacccaagtatttattcccatacccccacagaatatccttccaagaaagacggactttttgcgcggttaaatcaaggttcattttttactccgattgcctgctccgtgttcacgcatcggtttgccttatttcaaacagggcggcgcgtaagggattttcaaggggcgtcaggcggaaaaaggaaatgaaaatgccgtctgaacggcaaaacgtgcgttcagacggcattttgggcggatcgcgtcatcgcgccaaagccttcaaacattctttgaccaatgccggacctttgtatatcaatccgctgtacacttggacggcggtcgcgcccaagcggattttatctgccgagtcctcgccttccataatgccgcctacgccgataatcggcagcttgccgtctatgtggtctgccaacagcttcaacacccgattacttttttcatgaacgggcagcccgctcaaaccgccctgctcgcctgcgagcggatggctgccgagacttgatttgtcgatggtggtattggtagcgatgatgccgtccatttcgacggatttgacaacgtgggcgatgtcttcgatttgtgcttcatccaaatcgggggcgattttgacggcgagcgggacgtatttcccgtgtacagaggcaagctgtgcctgtttgtttttcaaagcctcaagcaatgcgctcaactcgtcgccaccttgcagcgcgcggaggtttttagtgttgggcgaggaaatattgacggtaatgtaacttgcgtgtgcgtaggctttttcaaggcagattaaataatcatcggcagcgttttcgatgggtgtaaccgcgtttttaccgatgttgatgcccaatacgccactgaatttacttttttcgatgttgcgtatcatggtgtcgataccgtggttgttgaaacccatgcggttgatgatgccttggtgttcgggaacgcgaaagaggcgcggctgcgggttgccgggctgcgggttgggcgttaccgtgccgatttcgatgaaaccaaagccgagcgcgcccaatgcgtcgatgtattcgccgtttttgtcgagtccggcggcaagtccgacagggttgggcaaatccatacccatcaattttacaggtttggtacggttgtcggttacaggaatcaaacccaatttataaaccgtgtagagcgcgtcgagcgtgaagtggtgggctttttcggcatcgagtgcaaacaggatgcgacgggcaagtggatacatgacagggctttctgcttcagatggaaatgccgccattttaaccgaaatcccgccaaacatacggcacacaggtcaaacttgaacgacaaaacccgccgcacccaaaaatgtacaaatcggcaaatattgatataatagtcattagatagaaaactctattaaaagtcggtacaataccaccgatttatttcccttaaacaacctgccgcaaggcataaaggaacgactgatatgtcaaacatcgaacaacaagttaaaaa

SEQ ID NO: 37782 - DNA, 60872 bp, Neisseria meningitidis
ctgcttgccgccacggcaacagacagaccgatgaccatgatgacggggccgatgacgaccggaggcagcagtttgtgtaccgctgccagtccgcgccaacggatcagcgcggcaaacacaaaatacataaagccggcggcaaacagtccgaacatggtggaaggcagcccccattcgccgacggagtagataatcggtgcgataaaggcaaacgaacaaccaagaaaaatcggcactttgcgtttggttgtgatttggaacagcagcgttcccaagcctgcgcccaaaagcgcaagagccggattcagaccggtcagcaggggaaccagcaccattgcgccgaatgccacaaataaaatctgtgcaccggaaacggcaagtttcagttggttcataccatcttctttcaatcggttcaaacggcacggattatactggtttgccgagggtctgcgtaaaaatacatacgtcgggcaacagatatgccgtctgaaaggcaatgtctgtctgttgcaggatgaaagcaggagaaatggagtataatccgacactttccatattcaatccgcaagccgtccggcttccttatttcagacggcattttccggtaatacggcatgacagaaaaatcccataaaaaaacagcaaaaggcagggcgggaagcccgtccccaacgtccgcacgcaacaagaaagccgacaacggcgcacggggcaataaagtttccgagcggctcaaggcggtcaaagagttgcagaaaaccgaaaccaaaaaggcgcgtcccgaacatgtcgtcaaccttatcggcgacgcactgtggctgatgggtttggcggcaaccctgtatttggcgatttccctgatcagtttcgatatgggcgatccgtcttggtcgcacagttcgccggttgtggaagatgtcgccaattggggcggactgttcggcgcgtatgttgccgatgtcggctattatcttttcggctggtcgttctggtggtggatagcggctgcctgcgtcgtgctgtataaaaatttccgcctgcacgcaaaacagacggaaaacgaggcatacaaccacaaaatcgctgccgccgcgctgtttgtcctgacggtcttcagccccgtcttggagtattttgtgctgggcggaaaatatgccgactccctgcctgtcggagcaggcggtatggtcggcatacgcgtcggcgcagtgtttgcgtggctgctggggaaatcgggcagcctgctgattatcttggttgttctgctgttgtcgttgtccctgctggtgcagatttcatggctggaatttttgaacggtgcgggcagggcggttcaaaaccgcctgagtgccttatccggcaaggtcatggctttaggaaaacgccggccgaataccaaaacagacggtgtcgatacccaaaatacacggcgcatggtaaaagaagccaagaatattacggccaaacccgttgccttgcccgaaggcagcagcagcaaccgcaaatccgtcgcggtttccgtcgcgccgccgcccaaaattcaggtttctctgtttgaagatgacgaacctcggcaggcgggcgaataccacaagcctacattgaacctattgcggattcctgacagcgaacccgtcagcatcaatcccgccgaattggagcgcactgccgaactgatcgaatccaaactggcagaattcggcatcggcgtacaagtcgtatccgccacatccggccccgtcatcacgcgctacgaaatcgaacccgcgcaaggtgttaaaggcagccaaattgttgccttgtcgaaagatttggcacgctctatgtcgctgcagtccgtgcgtatcgtcgaaaccatcgcaggtaaaaacacgatgggcatcgagttgcccaacgacaaacgccaagacgtgatgttgagtgaaatcttgtcctcgcccgtgtttgccgaagccaaatccaagctgaccgtcgcgctgggcaaagacattgccggtacccccgttgtcggcgacttggcgaaaatgccgcaccttttggtcgccggtatgactggttcgggcaagtccgtcggcgtgaacggcatgattatgtctatgcttttcaaagctacgcccgacgaagtccgcttcattatgatagacccgaaaatgctcgagttgagcatttacgacggtattccgcacytgctctgtcccgtcgtgaccgatatgcgcgaagcagggcaggcgttgaactggtgcgtcgccgaaatggaaaaacgctaccgcctgctttcccatgccggtgtgcgtaatttggagggcttcaaccaaaaagtcgaagccgcaaaagcggcaggcaagccgctgctcaatccgttcagcctgaaccccgacgagcccgagccgctggaaaaactgccgttgattgtggtcgttatcgacgaacttgccgacctgatgatgaccgaacgcaaagccgtcgagcagcaaatcgcccgtctcgcccaaaaagcgcgcgccgccggtatccatatgattgtcgccacccaacgtcccagtgtcgatgtcgttaccggcctgattaaagccaacatcccgacgcgtatggcgtttaccgtgcaaagcaaaatcgacagccgtaccatcctcgaccaaatgggcgcggacgaactgctcaaatatggcgattcgctgttcctccagcccggcagtgccgaaccgactcgcctgcaaggcgcgtttgtttcagacgacgaagtacatcaagtcgtcaactatgtcaaatcgcaagccccagccgactatattgaaggtctgctcagcggcgaggccgcgctggaaactgccaatatcgttaatccgaatgcagacagcgacgaattgttcgatcaggcagtcgcctatgttttggaaagcaaaaaaacctccatttcgtctttgcagcggcagctgcgcatcggctataaccgcgcggcaaacctgatggaggcactggaaaatgcgggtgtcgtttcttccaccgacctcaacggcagccgtaaaattttggcgcacaaggaccatttgtagcccgtattgcaaaatgccgtctgaacggcggaattggcgtttcagacggcatattatgtttcaggcgaaacattgtgatatacttgccagctaaaatttcccctttgcggcaatgcggttcaaatatcgtaccgttgcgctgtttgcttccccatgtagggaagaaagtttatcattttatcaacacaacaaatttaagggcttatgatgagcgtaactgttgaaactttagaaaatctggaacgcaaagtagtgttgtccctgccttggtccgaaatcaacgcagaaaccgataaaaaactgaaacaaacccaacgccgtgcaaaaatcgacggtttccgtccgggtaaagcacctttaaaaatgattgcccaaatgtacggtgcgagcgcacaaaacgacgtgatcaacgagctggtgcaacgccgcttctacgatgttgccgttgcccaagagttgaaagtggcaggcttcccccgttttgaaggcgttgaagaacaagacgataaagagtctttcaaagttgccgccatttttgaagtgttccccgaagtcgttatcggcgatttgtctgcacaagaagttgaaaaagtaaccgcttccgtcggtgatgccgaagtggaccaaaccgtagaaatcctgcgcaaacaacgcacccgcttcaaccatgtcgaacgcgaagcccgaaacggcgaccgcgtcatcattgactttgaaggcaaaatcgacggcgaaccttttgccggcggcgcatccaaaaactacgccttcgtattgggcgcaagtcaaatgctgcctgaatttgaagccggcgtagtcggcatgaaggctggcgaaagtaaagacgttaccgtcaatttccctgaagactaccacggtaaagacgttgccggtaaaactgccgtgtttaccattacgctgaacaacgtttccgaagcgactctgcctgaagtcgatgcagattttgcaaaagccttgggtattgcggatggcgacgttgccaaaatgcgcgaagaagtgcagaaaaacgtaagccgcgaagtggaacgccgcgtaaacgaacaaaccaaagaatccgtaatgaacgcgctgctcaaagccgtagagctgaaagcacctgttgctttggtcaatgaagaagccgcacgcttggcaaacgaaatgaaacaaaattttgttaaccaaggtatggctgatgctgccaacttggatctgcctttggatatgttcaaagaacaagccgaacgccgcgtatctttaggtctgattttagccaaactggttgacgaaaacaaactggaaccgactgaagagcaaatcaaagccgttgttgccaactttgcagaaagctacgaagatcctcaagaagtgattgactggtactacgcagatccttcccgcctgcaagccccgacttctttggcggtagaaagcaacgtcgttgatttcgttttgggcaaagccaaagtaaatgaaaaagctttgtcttttgacgaagtgatgggcgcgcaagcctgattatcctgaaaatgccgtctgaaggcagtttttgaaagcaccgaagccgcttttaaagctcgctttggtgcttttccatcatgaaaggagacgaaatgtcttttgataactatcttgtcctaccgttatcgagcagagcggtcgcggtgagcgtgcattcgatatctattcccggcttttgaaagagcgcatcgtattcttggtcggaccggtaaccgacgagtccgccaatctggtggttgcccaactgttgtttttggaaagtgagaatccggataaggatattttcttctatattaactcgccgggcgrttcggtaacggccggtatgtcgatttacgacaccatgaatttcatcaagcccgatgtatcgactttgtgcttggggcaggcggcaagtatgggcgcgttcttattgtcggcaggcgagaaaggcaaacgttttgccmtacccaacagccggattatgattcaccagcctttaatcagcggcggtctgggcggtcaggcatccgacattgaaattcacgcacgcgaacttttaaaaatcaaagaaaaactcaaccgcctgatggcgaaacattgcgaccgcgatttggcagatttggaacgcgacaccgaccgtgataatttcatgtctgccgaagaagccaaagaatatggtttgattgaccagattttggaaaaccgcgcttctttgcggctttaataaaagaaacctgagagaaaccgatgccgtctgaaacgttcagacggcatttgtttcaagctgcgtttgatatggtatcgataccgtcatccacgggacggaagaaggatttggagttttttaaaggatccccgttcccgcctgtgatggacggatgccgtctgaaagccaaatggggcagcagtttttgcaagggcgcgacactcgcatcctcctgaatctgccggtacggttattgagaaaagacaagggcaggaagcggtatcccgccttccttatttatacctgcaattcatctccgtatttgccgattgtattttcatattgcgcctccattccttatcggtttaaaaaaatgccttttccaatgggatgggttttatatcaatgaaaataaacggtttttatttaaaaatagccaaggtaggctggcggttggattttatagggagtgtatcgggataaccttcccttgatggcgtttgagtccgttctccccataattggttttgacatactcttcaacaatagccagaaattccgttgcaatgttgtcgcctttcagcgttactttacgttcaccatctacataaacaggggcaacgggtgtttctcccgtaccgggcaggctgatgccgatgtcggccaatttgctttctccgggcccattgacaacgcagcccattacggcaacgttcagggattcaaccccaggataaagggtacgccatatagacattttttggcgcaggtaattttgaacatcttgtgccagctcttgaaatacggtactggtggtacgcccgcagccggggcaggcggtaaccatcggcgtaaacgaacgcaatcccatagtctgtaaaatctcttgcccgacgacgacctcctgagtacgcgggctgccaggttccggagtcagtgaaatgcggatggtgtcgccgattccttcttgaagcaagacggataatgccgccgttgatgcgacaatgcctttgctgcccataccggcttcggtcaaacccaaatgcagcggataggcgcaacggctgcccagttcgcggtaaacctgaatcaaatcctgaaccgcgctgactttgcacgacaggatgattttgtcttcgggcagtcccaatagaacggctttttcggcagattccaaagcggagacaatcagtgcttccttcgtcacttcttcgggcggtttcggcgcggaagaagcgaggttggcatccatcatacgtttggcgaggctttgatccaaagaaccccagtttacgccgatgcggacggctttatcgttttcagcagcagtccgaatcataaaggcaaatttttcatcgccttttacgcctttgccgacattgccgggattgatgcggtatttggacaatgctttgccgcattctggaaattccgccaacaggcgttcgccgttgaagtggaaatcgccgataagcggtgtggcatagcccatatcgtccaagcggcggcggatttcggcaactttggacgcggcttcggggctgttgacggtaatacgcaccatttcggatccggcatcgctcaattccttaatctgcaatgcggtggcttttgcatcggcagtgtcggtgttggtcatagattggataacgacgggtgcttctgaaccgacggtaatatgatcgatgcggacttgatgcgtcttgcggcgttggagtgtgttcatatggtttgaatctgtttattgaccggtgaggacggtttgcaattcttccgagtaggggaaattcgcctgcaattgtgcttcatattcgtatgccgcctgtgcgttgccgagggctttggcaattttccagcctagcagcaaatcatcggcctgaaggacttctaccctgctttggtattttttaaagtagtaatcggcatcgcccaactgcccggccagcattttggtgcgcgccagttctttaaatgcgggtgggaactgcggctgggcggcgagggaacgtttcaaataggcttccgccaatccgaattgcccctgttttgcgctgcatatgcctttattcaggttggcaatataaggggtcgggtaggtggggtcggccagagctttgtcgaaatatgccatagattcggcagggcggttgagcctgccgcataggaaccaaccgtagttgttgttgatttcggcactgtcgggtttgatggagagggcttgccggaaactttcctgcgccttgtcgttaactttcaggtattgatagatttcggcacggaccagccaggcaagctcgtttttagggtccgatttcagggcgtcttcaatacttgccgtcgcctgacggtagtcctgaccgcgcatatattccattgccaactgggttttgatattggaaacctgattggctttttctgcccgcgaggggcggtaggaagtgctgcacgcgcccaaggcaagaacgagtaataaagagattcgtttggatggcttaaaaggcataattacccctgttgtccgattaaaatctgctgccatttttgttggcggcgcgttttatcctgaacctgccccgccaactgtccgcaggcggcatcgatgtcgtcgccgcgcgtttttcgtacggtaacgacaaatcctgcctgctgcaaaatatcgcggaacacacggatgttctcattgctggagcgttcgtatccggagtttgggaagggattgaacggaatcagattgaacttgcagggaacatctgtgaccagttcgatcagttcgcgcgcatgttgcgccttatcgtttattccgtccaacatgacgtattcgaaagtgatgaaatccctgggtgctttgaccagatagcgttggcatgcggccatcaattctttcaagggatattttttgttcaacggtacgatttggttgcggacttcgtcattggaagcgtggagggaaaccgccaaagccaccggcatgacatcgcgcaacctgtccatttggggaaccatacccgaagtggaaacggttacgcggcggcggctcaaaccgtagccgtggtcgtccagcatgatgcttaaggcggtaacgacattgtcgaagttcgccatcggctcgcccatgcccatcatgacgacgttggaaatcacgcgctcgtttttcggtgtaacgcccatcgctttgtttgcccaccacaattgcccgatgatttcggcagcagtcaaattgcggttgaagccctgccggccggtcgaacaaaatgtacattccaaagcgcagccgacttgtgaggaaatgcagagcgtgccgcgatccgattcggggatgaagacggtttccacgccgttgcccgtaccgacatccaaaagccattttcgagtgccgtctgaagatttttgagacatcatcagcttgggaatttcgatgcctgcctgttcgttcagtttatggcgcaacgattttgccaaatcggtcatttcgtcaaaattttgcgcgccggattggtgcatccaacgcataacctgtttggcacggaaaggtttttcgcccatatcggcaaaatgtcgggtcagcccttgaaggtcgtagttgagcagattggttttcatgtgtttgtgtttttcttaaatcaaggcttcaaataaaaaattgcagggcaggcaagtttgatttgaagccttttgcaacagagttttcagacggcatggatatatttatgccgtctgaagaggagttgggcggtgtattgtatcaacgggggcagatttcggtttggctgaaaaagtaggcaatttccaaagcggcattttccacgctgtcggaaccgtgtacggcattaatgctgaccgaagtggcaaagtccgcgcgtatcgtgccttcggcggcttcggaaggattagttgcacccatcagttcgcggtttttcaggacggcgttttcaccctctaatacctgaatcataaccggaccgccggtcataaattcaaccaatccggcgtagaaggggcggtctttatgaaccgcataaaattcttgcgcctctttgagagtaagctgcttcattttggcggcaacgattttcagaccgttctcctcaaagcggctgtatattttgccgataacatttttgccgacggcatcgggtttgatgatggagatggtacgttcaatcgccatgctatatccttatttttacttaagaagaatcaaatcggtattctatcaaaaaaataacttatccgcctgaagccttgggagatagggtcaggtgcggctgttccaaataaacttcggactgcatttcgaccatccggctggcggtgcgggtaaattcttcggcaaaatcgccttccgtatagatatggttgacatctaccgcgccggtggcacacagtttgacccggaaatcgtagagtacgtcaatcagccaagtcagccgccgcgcctccgccttttcttgcggtgagagttgttccaaacctgaaataaaaaccatttcataatgttcggccaaatacagatagtcggactgtgagcgggggccgaagcacagtgcgcggaaatcaaaccatatggcacggccggactcggctttgtggggaatctcccgaccgtggatggtgctgatgccggggttcaaatcggtaatgcctgtcatttctttgaacagttttgccagttttgcctcattttcttcattggcaggcgtaaagaaaatctcggcggggcggagggtacgcagtcggtagtcttcaccgccgtcaacgtttaagacggtcaggctggactcgatgagcgcgattgtgggaagaaaactgctccggttttgaccttgcgggtagagttcggaaggcgcgtagtttgaagtcgccaccaaaacaacgccctcgttaagcaggttttccagcagacggcctaaaatcattgcatccgcaatatcgctgacatgaaattcgtcaaaacacaatacgcgggtttctttggcaatctcggcggcaacggatttcaacgggttgctttcgcttttcagggttttcagccgctggtggatttctgccataaaggcatgaaagtggacgcggcgtttgcggcggtacgggaggcagccgaaaaaagcgtccatcagaaagcttttgccgcgtccgaccccgccatagaaataaagccctttggggacttgcggggaacgcaaactcctgcctaaaaaacggtttcttttgcgtttgaacatcatcaattcggtccaaagccgatcgaggtgttcgatggcggctgcctgcgcgtcgtcgcggatgaagttgggcagttgtgaggcagcctgataccaggtcagcgggctgtggttttcaaacggcggggctttaaaaagttggtctctattactcatatttaaccttgttatacttcttgcggctaagaaagaaaatgcttaccgtcggtattataaatgatttccttcaaacttggcattttccgtggaaaagaataatgacgcgcacaagggggtataagcaaaggcggcgtttcaatatggtgcagatatgagctcaaatgccttttatagtagattaaatttaaaccagtacagcgttgcctcgccttgccgtactatctgtactgtctgcggcttcgtcgccttgtcctgatttttgttaatccactataatccgtagagtcggctcctttcggctcagacggcatacgtttatgccggcacttcttaccgccctcgtgccggctatcccaaaactgctttgaacactgaacgctctttggtttacttcaaaaacgcggcgtgataagcaatatgctcgccaataaaactggcgatgaagtaatagctgtgatcgtagcctttatggaaacgcacatcgaccggctggtttgccgcacggcaggtttcgataaaatcttcggtacgcaattgtgtcggcaaaaactcatcttccaagccttgatcgatgcgcataccttgcactttatagccttgttgaatgagtgagttagcatcatattgctgccatttttcacggtctttccctaaataagcagtaaaggctttttctccccacggcacgaggcttggcgataaaataggcgaaaaggcagaaacactttgataacgttcctgattccgcagcgccaataccaatgcgccgtgtccgcccattgaatgtcccataatggaacgtttgccgttggtaggaaagtgtttctcaatcagacggggcagctcgttcaaaatgtaatcatacatttgataattcgccgcccaaggctgttcggtcgcattcaaataaaagcctgcactctgtcctaaatcgtaagcatcatcgttcggcacttgctctccgcgagggctggtatcgggggccaccacaattacttgatgttctgccgcataacgctgaaagcctgacttggtaatgaaattttgttccgtacacgtcaagccggaaagccaataaatcacaccaagcggtcgattttctggattatttggcaaatagacggcaaatttcatttcgcattgcagcgtttgggcatgatgcgcccaaacttgttgcgaaccaccaaaaatttgatgttgttcaatcagtttcatcgcataccttagtagtgaataacggcgcggatcgatttaccttcgtgcattaagtcaaaggctttattgatttgatcgagtgtcattgtgtgggttacaaacggttctaactcaatgtcgcctttcattgaatcttccaccattttcggcagttcagagcgacctttcacaccgccaaatgctgaacctttccaaacacgacctgttaccaactggaacggacgcgttgaaatttcttgtcctgcacctgctacgccgatgataatggattgaccccaaccacgatgtgcactttctaatgcctgacgcattacgtttacattgccgatacattcaaaggtatggtcaatgccccatttattaatgtctaacaacacatctttgatcggtttatcgtaatcgttcgggttcaaacaatccgttgcaccgaactgttttgccaactcaaattttgatggattggtatcaatggcgataatgcggccggctttggcttgacgcgcaccttgcaccaccgccaaaccaatcgcccccaaaccaaacacggcaacagagtcgccttcttgcacttttgccgtattatgtaccgcaccaatacctgtggtaacgccgcagccgagcaaacatacttgttcatggttggcttcagggttgattttcgccagtgaaacttcggcaacaacggagtattcactgaaagtcgaacagcccatatagtgatagattggctgaccttgataagaaaaacgcgtcgtgccgtccggcattaagcctttaccttgtgtatcacgcactgagacgcacaagttggttttacctgaacaacaaaactcacattcgccacattcggcggtgtaaagcggaatcacgtgatcacccggttttacgcttgacacaccttcgcccacagcaacgaccacacccgcaccttcgtgtccaagcaccacagggaatacgccttcaggatcgcttcctgataacgtaaacgcatcagtatggcacacgccagtgtgggtattgcggattaacacctcgcctttacgcggcatttctacgtcgatttccacaatttgtaagggttggttaggggcgaatgccaccgccgcacgagatttgatggttgaatcggcttgtttcatttccattgtctttcctcttaattcattgacaaagttgccttgcctgagcaacatagcaacagtttacactttagagttaactctaaagcaagtgttttttactgtttttgtttagaaggagggaaaatgacttatactactgccaaagccgccgaaaaaataggcatctccgcccacaccctacgtttttacgacaaagaaggtttgttgcccaatatcggacgtgatgaatacggtaaccgctgttttaccgataacgatttgcaatggttgggcttattgcaatgcttgaaaaatacgggaatgagcttaaaagacatcaaacgctttgcggaatgtaccgtcattggcgacgataccattgaagaacgcctttccttgtttgaaaatcaaatagaaaatgtgaagtgtcaaattgccgaattaaaacgctatttagatttgcttgaatacaaattggcgttttaccaaaaagcgaaagcattaggctcggtaaaagctgtaaatttgccgcaaattcctgaaacggcttagttttagtgcaataagcaggatttttgtcctgttcgtaatagaaatcaaaaatttgttgtttaaaaagcggattgtaagcaatgatatagtggattaacaaaaatcaggacaaggcgacgaagccgcagacagtgtaaatagtacggaaccgattcacttggtgcttcagcaccttagagaattgttctctttgagctaaggcgaggcaacgccgtactggtttttgttaatccactataaaaaaatccacgctctaatccgttgcttgcttggctcaaggtattgaagcaacggatgaagttaaaccacagaaaaaacgccgcgtaacagcggcgttttgatgctaaggtttaattggcattttcttttaaagccaagtcgacccgctcgcgcaattctttaccgggcttgaagtggggtacatgtttttcaggtacttccacacgctcgccggttttgggattgcgaccgatgcgggcaggacgatggttcaaatcgaagctgccgaaaccgcggatttcgatgcgttgacctcgggcaagcgatctagtcatggtgtcaaccaagacttttacgctgtactctacgtcttttgccagaagatgcgtgccgtttttggcggcaaacacttctgccaaacgaaccattaactcagactttgtcatgtctgcaaccttattcttgttcgccggagagtttggctttcagcaggtcgcccaagctggtggtgccggcattcgcattggcggcggcattgacggagttcagtgcttcgcggctttctttggcatctttggctttaacggaaagtttgatgctgcggtttttgcggtcaacggtaacgatgacggcttcaacttcgtcgccttctttcagtttggtggtcaaatcttcaacgcggtcggctgcaaattcggaagcaggcaggtagccttctacttcgtcagacagggcgataacagcacctttggcgtcaacagatttcacggaacctttaaccaaagaacctttgtcgttcacgctgatgaagttgccgaacggatcgccttccagttgtttgatacccaaggagatgcgttctttttccacgtcgattgccaatacgacggcttcgacttcttcgccttttttgtatttgcgtacggcttcttcgccggattcggtccaggacaggtcggacaggtgaaccaaaccgtcgatgccgccgggcaggccgacgaatacgccgaaatcggtaatggatttaaccgcgccggagattttgtcgcctttgttgtggttggcggcaaattcttcccaaggattggcttggcattgtttcatacccaaagagatacggcggcggccttcgtcgatttccaaaatcatgacttcgacttcgtcgcccagttgtacgactttgctcgggtgtacgtttttgttggtccagtccatttcggagacgtgtaccaaaccttcgatgccttgttcgatttcgacgaatgcgccgtagtcggtcaggttggatactttgccgaacaggcgggtgccttgaggataacggcgggtcagaccgctccaaggatcttcgcccagttgtttcatacccaaggaaacgcgttgtttttcttggtcgaatttcaatactttggcttcaacttcctgaccgacttccaagacttcactcgggtgtttcacgcgccgccatgccaaatcggtgatgtgcaacagaccgtcgatgccgcccaagtcaacgaatgcaccgtaatcggtaatgtttttaacgatgcctttgatgacggagccttcttgcaggttttccagcagggctttgcgttcttcacccaaagtggcttccagaacggcgcggcgggaaacaacgacgttgttgcgttttttgtccagtttgatcactttgaattcgatctctttgccttcgaagtgagaagtgtcttttacaggacgtacgtcgaccaaagaacccggcaggaatgcgcggatgctgctaatcataacggtcaggccgcctttgacttttccgttgatgatgccggacaggatgtcgccgttttccatggcttcttccagggcaatccaatcggctgcacgtttggctttttcgcgggacagtttggtttcgccgaagccgttttcgacggattcgatggtaacggtaacgaagtcgccgactttaacttcaatttcgccttgagcgtttttgaattcagctacatcaatcagggattctgatttcagacctgcgtttacggtaacgaagttttggtcgattgccactacttcagcggtaatcacctcacccgggttcatttcttgcagggtaaagctttcttccaacagctgagcaaaattttccatagacatatataactcttttcggtacaccgccaaggggtgcggggtgggttggtggatatctgccgtccttggcagggcagacgggtacataaggtttcagacggcatatgggggatttttatgccgtctgaaacgtaatttgtgcgattatacctgaaaatttaaacttcacgataccaatcaagcactttttttacagtttcttctatagtcaggcggcttgtgtccaaaagcagggcatcgggctgttgtttcaggggggcaactttgcggtttcggtctgcctcgtctctggcttcgatgtcggacaggatgcgctcgaatgccaaaccttcgcaggggatgccgatttgtttggcgcggcgttcggcacggattttggattctgccgtcaggaagattttaagttcggcttgggggaagacgaccgatccggtgtcccgtccgtcggcaaccagtcctttttcggtcagaaaatcgcgttggcgttgcagcagggcggcgcggactttaggcaactgtgcgactgcggatgcgcccatgccgatggcttctgtccggatgccgtctgaaacgtcttcgccgccgagcaggatgcggctgcctgaaaatacggcgggcagtttttttgccagttcggaaacgttttcttcatcgtgccatcccacgccttgtttttgtgcatatagggcagtcaggcggtagagtgcgccggtatcgagataatcgtatcccaatgcggcggcaacgcgggcggcaaccgtgcctttgcccgatgcgcccgggccgtcgatggcgatgactttttgtctgttcataagggggattcctgatggtttggggtatgggttttgccgtctgaaggatgtgtttcccgttggggcggattctacctgttttaaaggacgattgtctaagcagacggaacgccgcctgcccggaaacatccgacagaagccggcaagccggttcggatttcggcgttgcgggtattgtggcgggcatcaaggcaatgctgtctgaaagaggtatgaccttcagacggcatcgattgctgcggattagaacaggttgctgacgaaaatcagcagaatcaccagcggcacaagatatttcacataagcaaaccaaatattgaccgtcgtatggttgcctttataaagcaattcgtccttcgcttcgtccttcatcacaaaaccggcaaacagcgcggaaccgagcgcggtcagcataaacaagatgttgccgctgatgtagtcgaaggcatcgaaaatatttttgccgaacacggaacgtctttccacggaccatagctcagaatggacgggatgttgccgaaaatgaagatggcagccaatacaatcgtaatcgcggcggtacggcggattttggttttttcctgaatggtcgtaatcaacacttcataaatggtcagcgaagttgtcaacgcggcaatcaggagcagcgagaagaaaatcacggcgaacacagatcccgcccacatatgtgagaacacaatcggcaagctttggaacaccaaagtcgggccggaatcgggggcaacgccgaagctgaagagcgacgggaaaatcataaagcccgcaagtatggcgatgatggtattggtaattgccgtgataactgccgtctgaaccagattttcgtttttatccaaatagctggacaaggtaatcatcacgccgaaacccaagctcagggcaaaaaatacctgccccaaaacgaagacgaacagttcggcggtaatcttgctgaaatcaggtttcagatagaaagcaaccccttccattgcgcccggaagggtaacgttgcggacgaccatcgcgattaggaacaaaaacagcagcggcatcagctattttgccgctttttcaatgccgccgataacgcctttgaccaaaatccattggttcacggcgacaaaaagcagcgtataaaacgcaatttcccaagggctgtttcaatgtgttcggcaaagaagccttttgtaaccacaccgtcgacggggctggaaatattcaaatttcctccaataatattaacgatatagctgattacccagccgccgagtaccatgtaataagccatgatgccgaacgcgccgagcagcccatccagccgaccagtttccaaattttggcaatgggtttgccgttcatcgggccgccgaacgcatccagcgcgttcacgcctttgcgccgtccgatgacattttccaccaaaatcatcgggatgccgataaccagcatcgcgatacagaataaaaacacatacgcgcaccaccgttttcaccgaccaaatacgggaaacgccacgtcgcgccgaaaccgacagtcgcgccggcaacggtcaggatataggttaatcggctggaccaggtttgacgattggtatttgaaggggaagacatattgaaaccgtgtccgattgagataaagcggaaattctacacgcgttttttaacaggaactgactgattgcttttcaactgtctagtgattttccatgtaaaaggcatatatttcagtgagtatttctgatgagtataacccgatgaggaagaatcggagtttataaatagattaatttgttattcttctacatcggtgtatggaaatgaaattttgttaattatattaatgatagcatttaaataatgatgaaagagagggaatttgaaatatagtggattaacaaaaatcaggacaaggcgacgaagccgcagacagtacaaatagtacggcaaggcgaggcaacgctgtactggtttaaatttaatccactataaaaaaaccatctatacaaggggagaagtatagatggcaaaacacattacggggaaaacgtcttactcataagcctgcttgaacaggcgttactcagacaaatggattatatcgtaaattgattttttgcgttaaattgggttaaaccatatatttaatgagtatgtggatgaatataaatggaattcttggatgttatttcagaattttggacattcgataaatttccattccccgggtttgaggttttctgtttccagatgtgcgaatcgccggcgatgaaggtgttgcacgcggttgccggcggcggcgatcatgcgtttgacttggtggtattttccttcggtaatggtcagcagcagggtggtcgggtttttcaaaacggcatcggcggcacaaacggtttcgttttcgtcgtggagcagcacgccgtttttcaaggtttcgcagagcgtttctcctgtggggtgtttgagcgttacttcgtacagcttgggaatttttctgctcggcgaagtcaggctgtggttcagtttgccgtcgttggtaatcagcaatacgccggtcgtatctgcatccagcctgccgaccgcctgcatatcgatgttccgcatattgtcggggaacaggctgaatacgctgcggtagtgcttgggtttgtgcgaagtttcgtaatcttcaggcttgttgagcatgatgtagaaatagggttcgggaacgacggttactgcttccccgtcaatatccaacgtttcgacggatgaggaatcgatgtctgcatcggtgtcgtccatgcaggttccgttgatgaaaacataaccgccggcaatcagccattggcactgcttgcggcttcctatgccttgatattgcaggtatttgataagtttcatgatggtatgggaaatgtgggatgaaaaagacaggactgagaaagtcctgtcatgtgccgtatccgaatcagcttccaatcagtttgaccctctgtcccggattgatggtgttcaggttgggattgagccggcggatgtcgtcgatatggatattgaagcgcgcggcgatacttttgaaggtgtcgcctttgcgcgcggtgtaggatactttttcaatacgggtttgggcaggggctgcctgcgccaggcggagtacctgtcctttttggatggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcagcggtatgttgcggagatgcggaaattttgtgttcggcaactgtgtcaggcgtgccgatgacggcggagatggtttcttcagcctgtcggcgcaggttgtttcgggcaacaagctgcatgagttcgtctgccgcctgcatgtcgttttgggggatgatctgcgcgagtgttgcggtttgggtttcagacggcatggcggtctgtttttcggtttgaggttgcgctgcggctgtcgcaagggcaggttcggcaatacggacaaggggatcgggttccgtacggacggttttctgcggcaaaggtgcgacggtaatgtccgctgtctgtgcggcggcgggtcggattcgggcaatgccgacgttcaccgtgcctgccggcatattggaacggtaggtgtcgggcgtattgtcgatgtcgatggaaacgacggattccgatgccgtctgaagggttttgccgttcttggcgacaaggatgctgcgtcctgcgttgacaaggttgccgttcaggttgttgaggcgtttgatgtcggcaatgctcatgccggttgccgtcgagatgtcggacaggctggttttggcggcaggcgtatagacttcccatgaaaacaggctgtcgggtgcggcgttgaggtagttgctttggaaggtttgtacggacgcgacaggaagcagcagtttgcgtttgcttttggggataaacgcggggacgttgaatgcggggtttagggcgagcagctcgctttgcgtgatgccggcaagccgggcgatggcttcgttgtcgagcggacgatccggttcgactgcctgaaaatagggtttgttgtctatgtcgctgatattcatgccgaaagattggggagtggcaataatgttgcgcacggcgagcagcttggggacatagttgcgcgtttcgttgggcatacgcaggttttcgtaggtcggttcgagcccttgggcgcgggcgcggttgatggcgcgtccgacgttgccttcaccccagttgtaggcggcaaaggcaagcggccagtcgccgaacagtccatagaggtattgcagatagttgagtgcggcatcggtggcggcgtaaacgtcgtgcctgccgtcgtaaaccggtgttttttccaggccgtaatgcctgccggtagcgggcataaactgccataatcctgatgcgccgacgtgtgatttggctttggtgacgaacgcgctttcgatgaagggaagcagggcggcttcggcgggcatattgcgttttttgacttcgttggcgatatggtacatatagggtctactccggttgatgaccctgttgaaatagctgtggcttgcgatgaatttgctttcgtggcggcgtaccagttcgggattgacttcgcccatccggaagccttggcgcagctcgccccacaggctgccggattggaaatattgttttgtcgggggcaggtcgagtattgaagagtttaagcgcataatcgccaaaccgatttggtgtgatgaggtgttttgggcgtataggaaacccggacaaacggacagacctgatgcggtcagagcgatggttttgagtttggacatgatttatattcggcggaataaacatattttatcgtccgatggtactgtttgactgaaaaagcgtcaagttttacaggaactttatgcggattcggaaatgggcggccgatgtgttttttgacagaaatcctgtttggaatagaatatcggcaggcaatctgtttgaaacggacgcaatatggatgcatggtttgaagatacggcgatggggcggtatgttgcaaaattggaacaggatttcttcgggcggtatctggattcataccgtttttcgggaatgtgtgcggttcaggtgggcggtccgtggctgagcctgtctgaagatgttgtctgtgtgccgcgagatatgtcgatgtcggcggagaatatggctttggcggatgtttctgcggatatgctgctttttccgcatacgcttgaaggcggtgttccttcgcaaatcctgtcggaagcgcaccggatattgaaaccgtgcggacgcttgatgctgacgggtttcaatccgtattcgctctggggattcagccgttggtttgacggcgaacgcctgccggaaaaacggttttgtctgccgctgcccgagttgaaaagacggcttgcggatgtcggtttcgatattgaatttgggaaatttatggtgtatctgccgccggtttcgtcgctcgggcaaatacgcttttggcggtttatggaaaaggcgggcgaccgttggtggccgcagtgtgccgcagtgtacggtttggttttggtcaaaagggcagcgggcgtaacgcccctgcccgcgtgggacgggtatttgggcggcaaagcccttgcggcgggtgcggcaagggttgcggattagggacagccgtctttcagacggcatctgtcagaagaaatgtcgggaggggttatgcctgaattgccggaagtggaaacgacgttgcgcggcatcgcgccgcatattgaagggaaaacggtggaagccgtggtattgcgccaattgaagctgcgctggcagattaatcccgatttgggggagattttgtccggccggcaggtgttgtcctgcggcaggagggcgaaatacctgcttatccgctttcaaacgggcgtgctgctgattcacttggggatgtcgggcagcttgcggatttttacgccgtcggacggacgtatcggcaggccggacagacacgatcacgtcgatattgtgttttcagacggcacggtcatgcgttaccgcgatccgagaaagttcggcgcgatactttggtatgagggaatcgaagaacatcatccgctgttggaaaaactggggccggagcctttgtcggaggcattttgtgcggattatctgtatgcaaggctgaaggcgcagaagcgcgcggtcaaacttgccctgatggacaatgcggtcgtggtcggtgtgggcaacatttatgccaacgagagcctgttcagagcgggcatttcgccccaccgtcctgccaaccgcctgaaaaagaaagagtgcgcgcttttggttgaaaccgtcaaagcggtgttgcagcgcgccattgaaacgggcggcagtaccttgagggattttgtggacagcgacggcaaaagcggctacttccaacaggaatatacagtgtacgggcggcacaatcagccgtgcccccggtgcggcggtttggttgtgaaagaaactttggggcagcgcggcacgttttattgcccgaactgtcagaaataggactgaaaacggtttcagacggcattttatcggtatgccgtccgaacgtttcaacaacaaacaccgattatcgggaaagaattgctcatgtcttcaaataaagcttcattttttacacgtctgcgccgcttgtgccgtttggcggtctggctgttcaaaaccgggaaaaacctgcgcggtattgacggcggttgccccgagtcgcgcaatcgggcggtaatcgagttgggcaggggggttttggcggctttggatatcggattggaggtgggcagacccgcacccgaacatccgaacggtgtcttggttgccgccaaccacgtgtcctggctggatattttcgcgatgagcgcggtttatccgagcagctttatcgccaagcaggaaatcaaaagctggccggtattgggcaagatggggcagaacgcgggaacggtgttcatcaaccgcaattcgcggcgcgacatcgaaccgattaaccgcgccgtctgcgaaaccttgcaacgcggtcaaaacgtcagttttttccccgaagcgcggacttcctccggattggggcttttgccgttcaaagccgcgctgttccaatccgccatcgatgcgggggcaaaggttttggcggtcgcgctgcgttattatgacgaaacgggaaaaaggacggctcgtccctcatatgccgatgtcggtttgccgacctgcctgtggcgcatcgtgtctatgaaaaaattgacgataagagtcgatttcgtttgcgtggcggatgcggcggaaagcgaagaccgttatgctttaaaagataaaatcgaagaaagcatccgtgccgttgtcgccgacgatgcggatatcgctgtctgaaaccggttgtcggaatgtggcagtatgattcgcttttgtggatgtatagtggattaacaaaaaccagtacagcgttgcctcgccttagctcaaagagaacgattctctaaggtgctgaagcaccaagtgaatcggtttcgtactatctgtactgtctgcggcttcgtcgccttgtcctgatttttgttaatccactatattaaggctgcggcaacgggaggacctcaaacgaaatggcgtaaggatagtttgttgtatctatggaaaatgccgtctgaacctgtgttcagacggcatattttatatgggattaacggcggaaactgccgccgtcgaaatcatcgaaagcctcataagccgcccggcattggattttctgttccgcataaggcagggagcggaatgctttgcgcgcctttttgttttcgcgcaattcctgcacgttgccttgcgatcggtaccacgcggcacggcgttccaaatatttcctgcattcggggtgcagcatctgcttgtttgccttgcggatatgtttggtatcgcggtgggcgggttctgacgtaccggcagcggcagttgtcgataccagtcccaatattgcagacaacagtatggcaagcatctttttgacagacatgacgatcctttcagtttgtcattctttccagtataggatggaaggatggaacgggcaaattgtcggcagtttcagactcattcagccgacaaaacttgccgtttgatatgcagattcaaataacacattaatctcaataataaattccaatcggtaagaaaatggaatttgtcggcggcggcgcggcaaaatcatactttgcaaaatttaacaatttgcaggggcagaaaacaggaagctttcctttttcgtcggaaaatccttatttcaccgccttgtagccggagccggtcaaaaggcaaaaaatttacccgttttttatcggtaaagaattatcagataaaacaaatattataggaaaaatacgacaggcgggttttatcgcgcattgcctgaaactgaaaaatacaaccgttgtcaagactggagaaaatgccaaaaatccactatattgtctgccttaatttatttgaaaagactgtgtcttgaatatcaagagtggaagaggaagcgatgaatacaccgactgatttgaaagtaaccaaacgagacggaagattagaagccattgatttggataagattcaccgtgtcgtcacttgggcggcggacggattggaaaatgtttccgtgtcgcaggtcgagttgaaatcgcacatccagttctacaacggcatccgcaccgacgacatccacgaaaccatcatcaaagccgctgccgatttaatttcggaagataccccggactaccaataccttgccgcgcgtttggcgattttccatcttcgtaaaatagcctacggcgagtacgagccgccgcacctttacgaccacgttaaaaaacttaccgatgccggaaaatacgacaggcatatccttgaggattacagccgcgaagaatttgacgaactgaacgcctatatcgaccacgaacgcgatatgtccttttcctatgccgctgtcaaacagctcgaaggcaaatatctggtacagaaccgcgttacccgccaaatttacgaaacgccgcagtttttatatgttttggtggcgatgtgccttttcagcaaatacccgaaagaggcgcgcttgggttacgtcaaacggttttacgatgccgtttctacatttaaagtatcgctgccgactccgattatgagcggcgtgcgtacgcctacgcgccagttctcaagctgtgtgctgattgaatgcgacgatagtttggattccatcaatgccactaccagcgcgattgtgaaatacgtttcccagcgtgcgggcatcggcatcaatgccggacgtatccgcggtttggacagcgaaatccggggcggcgaagcgcggcataccggctgcattcccttctttaaaatgtttcaggcggcggtcaaatcctgttcgcaaggcggcgtgcgcggcggcgcggcaaccttgttctaccccttgtggcatatcgaagccgaaagcctgctggtgttgaaaaacaaccgcggtgtggaagacaaccgtatccgtcagcttgattacggcgtgcaaatcaaccgcctgctgtacacccgcctgattaagggcggcaacattacgctgttttcgcccaacgaggttccgggattgtacgaagcgttttttgccgaccaagacgaatttgagcggctctatacgaaatacgagcaagaccctgatatccgcaagcgcatcattccggctgccgacctgttttccacgctgatgcaggagcgtgccggaaccgggcgcatctacattcaaaacgtcgatcactgcaatacgcacagcccgttcgatccgcgcgtcgcgcctgttcatcagtccaacttgtgtatggaaatcgccctgccgaccaaaccgctggacaatatcaacgatccgaacggcgaaatcgccctgtgtacactgtctgcctttaacttgggcgcattaaacagcttggacgaattggaagggcttgccgacttgaccgttcgtgcgctcgatgcacttttagattatcagggatatccggtagaagccgcgcgtacctctactatgggccgccgttcgctcggcatcggcgtgattaactatgcttattatctggcgaaaaacggtgtccgctacagcgacggttccgcgctcggtctgacccaccgtacctttgaagccatacagtattacctgctcaaagcatcggcaaaccttgccaaagaatacggtgcgtgcacgctctttaaccaaaccgtttattcgcaaggcaaactgcccatcgacacttacaaaaaagatttggatgccgtctgcggcgagcctttgcattacgactgggaaagcctgcgtgccgaaatcgtcaaatacggcctgcgcaactctactctgaccgcgctcatgccgtctgaaaccagctctcaaatcgccaacgccaccaacggcatcgagccgccgcgcggattggtaacggtcaaagcatcgaaagacggcattttgaaacaagtcgtgccggagtttgaaaccctgaaaaatgcctatgaaaccctgtggcagcttcccggcaacgaaggctacctgaaacttgtcggcgtgatgcaaaaattcgtcgatcaatcgatttccgccaataccgcctacgacccgggcaaattcgaaggcggcaaagtttctatgaaacaaatgctcaaagacctgctgaccgcctacaaatacggcgtcaaaaccctgtactaccataacacccgcgacggtgcggacgatacgcagaccgatattcaggatgacggctgcgcgggcggggcttgtaagatttgatgaaagggggagttttcagatggcctttagattaataaatcatctgaaatataaaatatgaaaaataaaatacaaaatcaattagataatatagttaccttaaataatgagaaatttacttttattgatttatttgcgggaataggtggttttcgcattgcaatggagaatgttggtgggcgatgtgtattttctagtgaatgggatgataaagcccgtcaaacctaccaagtaaattttaatgatattccttatggagatattacattaaaggaaaccaaagcagctattccaagtaagtttgatgtattaacagcaggattcccgtgtcagccattctctatagctggtgtttcaaagaaaaaaagcctaggacgagaaacaggcttcttagataaggcgcagggaactctattttttgatgttgctgaaattattggaaaacatcgacctaaaatttttcttttagagaatgtgaaaaaccttgtttcgcatgacaaaggaaatacatttaaagtaattaaagggactttagaagagcttgactatcagatattttatcaagttatgaatgcaaaatattatgttcctcaaaatagggagcgtatttttattgtaggttttgatagacaatattttaataaggaaataaatttcaattttccttccccaccagaatcacaaccaaaattaaagcaaattttggaagatgatgtagataattcttttactctttctgataacttatggctttaccttcaaaattacgctaaaaaacataaggcaaagggtaatggatttggttttggattagttgatttagatggaatatcacgaactctatctgcacgatattacaaagatggttccgaaatactcatccctcagaaaggaaaaaatcctaggaagctgacacctagggagtgctcgcgtttaatgggatttcctaaagattttgttattgatgcagtatccaagacagctgcatacaagcagtttggcaattcaattgctgtaccgttggttcaagctattgctaaacaaattataaatgagttaaaaaatgaatgacttggcagctcagacaatacaagtagtaaataaatccgatgacttagtagcttcagcaatacagacagcaaataaatcaattgcagtatactgtcgttatattcgtcccaatgatgttggtactactggtagtcaccaatcaggattttatattcaaaaacatttttcagacgacctctttgatgtagtttgccaaaagggaacaaataaaactatttcaatcaaaattaattggcaagatggaagcgtcactaatagcaattttaaatattacggccaaggcacgagaaatgaggcgagaattacgggttttggcaagaattttgaatttttaagtgataaatatagtggttccttattggtattgtgcagagcttgttataaagatttattattccatgcttttgttttatcttcagatgaagatattgaaatatttatcgcagaaactaacattttaccaggaagtttatatttacctaaaaaacaagaagtagaggataacctaacaaaattattttcactatttcctaacttccccaaaactgaagaaatggcagttttggcaagggaaaatattgcattaaataaaactaacgttagtaatgtgttaaaacaatgggtttcaaaggaatatgaattattttccatttttgaaaaacgtgaatttgaaattattaaatcaaaaattactgatttggatagcttcattaattttgcacattcttttacaaatcgcagaaaagcaagagcaggaaaatctttagagttacatttatcaagaatatttgacgaattttccttaaaatttgagacgcaagcgaagacagaagggaaaaagaaaccagattttttatttcctggaagtgaagagtaccatgcgatggatgaatcagggaatttcatatttcaaactgaaaagctgacaatgctaggttcaaagactacttgtaaggatcgctggcgccaagttttaaatgaagcagatcgaattcctcataagcatttatttactctacaagaaggtatatctgatactcaaattcaggaaatgagtgatgagaatttaaccttagttgtccctaaagaatccgtaaaaacatttggaacttttgggaaaacccatgttttaactttagaaaattttattaaatatataaagtctcagcaggttagttaaaacttacagatcatttttaattaatatagagaatagattatgtcctgcgaacacttaactatgtcatacagcacctttcccaaaaccaaaaacgacgcgctgaatgagccgatgttttttggtcagccggttaatgttgcccgttatgaccagcagaaatacgaagtatttgaaaaactgattgaaaaacaattgtctttcttctggcggcctgaagaaatcgatgtctcgcgcgaccgtatcgactacgccaatctgcccgaacacgaaaaacatattttcatcagcaatctgaaataccaaacactgctcgattccatccaagggcgcagtccgaatgttgccttgctgcctttggtttcgattcccgagttggaaacgtggattgaaacgtggagcttcagcgaaaccatacactcgcgcagctatacccacatcatccgcaatattgtgaatgatccgtcggtcgtgtttgatgatattgtcgaaaacgaatacattaccgcccgcgccgaagacattgcctgctattacgatgacttaatcgaatacacccagtattacaacctgttgggcgaaggggtgcacaatgtcggcggcaaacccgttaccgtgtctttgcgcgggttgaagaaaaaactctatctctgcctgatgtgcgtcaacgtgttggaagccatccgtttctacgtttcattcgcctgctcgtttgcttttgccgagcgcgagttgatggaaggcaacgccaaaatcatcaaactgattgcccgcgacgaagccctgcacctgaccggcacgcagcatatgcttaatctgatgcgttctggtgttgatgattctgaaatggcagaaattgccgccgagttgcaggacgaatgtttccaactcttcaaaaaagcggcggaacaggaaaaagaatgggcggcatatttgtttaaagacggttcgatgattggtttgaacaaagaaatcttatcccaatacgtcgaatatattaccaatctgcgtatgcaggcggtggggttgccggccggatttgaaggcgcaaatcaaaacccgattccgtggattaatgcgtggctgtcgtccgacaacgtacaggtcgcgccgcaggaagtggaaatatcctcttatttgatcggtcagatagattctgaagtgaatacggatgatttgggcgattttgagttgtaaatgttttttgaaaaaatgccgtctgaagccggatgtttcagacggcatttgtatgttgtatgatgggaaaaacagcgggtaggatcggttattgttccttttatagtggattatagtggattatagtggattaacaaaaatccggacaaggcgacgaagccgcagacagtacaaatagtacggcaaggcgaggcaacgccgtactggtttaaatttaatccactatatttttgattggtcggaaatggcgcgcattggtacgaataagggtttttttgaactcttggagggcgagactctgttggaaggcttggaacggacggggcatatggtggaatatcagtgccgaagcggatattgcggatcgtgccgagtgaagattttggagggaagcgttacttatcgggagccgcctttggcttttttggggcgggacgagatactgccgtgctgctgttgcgtcgagggggatgtcaggctggattgcggtttgtcgggggaggatgaggggctgtctgacagtttgttgaaataaaagccgtccgaacattggttcggacggctttttgacggtattaccggttatgcctgatgagtcggtaaaaggtttcaccgtcttggatataacccagttctacccgggcgatttccgaaatggcttcttgaccgttttccaaatcatagacttcggcggcaagggaatgattgcgtagggcgagtgtctggtttttttcttcttgaacggcaatctgttctctcagactgctgttgcgtccgatgctgcctttgccgaaccagaggctgtattggcaacagacaagtgcgaaggataaaacgacagttacccacttcataccttaaccttttttatttgcccagttggtagaatgcggctttgctggggtagtcggcggcttccgccaattcttcctcgatacgcagcagttggttgtatttcgccatgcggtcggaacggctcaaagaaccggttttgatctgcatacagttggtggcgactgccaagtcggcaatggtgctgtcttcggtttcgccggagcggtggctcattacgctggcgtagcggttgcgtttggctaagtcgacggctttcagggtctcgctcaaagtaccgatttgattgactttgaccagcaatgcgtttgctacgcctttttcgatgccttcggccaagatttttggattggttacgaacaagtcgtcgccaaccaattgaactctaccgcccagtttttcggtcagcagtttccagccttcccagtcgttttcatccatgccgtcttcgatggagatgatggggaactcgttgaccaggccttccagatattcggcaaattccgcgttggtgtaggagcggccttcggcttccaagtggtatttgccgtctttgtagaactcgctggaggcgcagtccaatgcgaataatacgtcttcgcccgctttgtagccggcggcttcggtcgcctcgaccatcagttgcagggcttctttgtggctgttcaggttgggggcgaaaccgccttcgtcgccgactgtggtcgggaagcctttgctgtcgcacagttttttcaaggcgtggaaaatttccgcaccgcagcgcaacgcttcgcggaaagattttgcgccgacgggcataatcataaactcttggatgttcaggctgttgttggcgtgttcgccgccgttgatgacgttcatcatcggtacgggcagggacatcgggcctgcgccgcccaagtagcggtaaagcggcaggcctgagtcttcggcagcggcgcgtgcaaccgccatagaaaccgccaaagtcgcattcgcacccaaattgcctttgttttcagtaccgtccaattcgatcatgatttggtcgatataagattgctcgttggcatcgataccaatgagggcttgggcgatttggttgttgacgtgttcgaccgccttcaatacgcccttgcccgaataacgggatttgtcgccgtcgcgaagttccaaagcctctttttgaccggtggacgcgccgctcggtacggctgcgcgtcccattacgccggattcgagcaatacatcacactcgactgtggggttgccgcgtgagtccaaaatttcgcgggcgaaaatatcaacgattgcgctcatgaatgttctccaagtgaagtgaagggaggtaaaaaaatgggagggcttcagacggcatctttgccggaaagccgccaacttaaaactgctgaaagtagggcggttgccataaaaacaatactggaaatgccgtgccacattccgaaggatccgcctacaaacgacaacagccaattttcatgtccgtatttcagtgcctcgataacgggtgtaatcaagaatcggttggcggcaagggcggacaataaaaaaagcagcagggcggtttgccgccgggttagggcggcaaaggcggcagccagtaccgcgccccaaacggcaagcccgctccaagagaggatgtcgaacaatacgccggcaatttcgcccgcctgcattttgggcagcattttgaacagcaccggtgcggcgatataacccgccataatctgcataccgagccacaaggttgcgacataccggctgatttttcggaaagtctgcatcataaggcgaaaccgtgttactcgattgttaaaatcggttgtgatttgattaaatcgtccaatgctttgatgcggattaaaaaatcttctaaaaggtgcagcggcagcgcgctggggccgtcgcattttgccagtttcggatcggggtgcgattcgaggaacagaccggcaaggcgggttgccatgcctgcaagtgccaaatccaaagcctgtgcgcgacgaccgccggatgcggcagaaccggcatcgcgggtttgcagggaatgggtaacgtcgaaaataaccggcaggttgccgcaagtctgtttcatcacgccgaaaccgagcatatcgacaacgaggttgtcgtagccgaagctgctgccgcgttcgcataaaatcagtttcccgttgccggcttcgtggaatttttccacaatgtttttcatttgagaggggctgaggaactgaggttttttgatgttgacgacgttgccagtttttgccatggcaaccactaaatcggtctgccgcgcaagaaaggcgggaagctggatgacatcgcacacttcggcgacgggttggcactgatggggttcgtgtacgtcggtaatgacggggatgccgaactctgctttgactttttcaaaaatctttaagccttcttccaagcctacgccgcgataagaatggatggaggaacggtttgccttgtcgaaagaggctttaaagatatagggaataccgagttttcgggtaacttcgacgtaatgcgcgcaggtttggagggtggaatccaagctttccaaaacgttgatgccgccgaataggacgaagggcgagttgttgccgagggtgatgtcgttgattttaatatccataatcgatgtccgtttgcggaattacagcacggtgtgcggcggctcgtaggagatgatgtcgcggattttgttgtttccgtctaccaagacgactttgggttcgtgtgcggcgatttcgggttcggagagttggacgtaagacatgatgatgacgatatcgcctttctgtaccagcctggctgcagcaccgttcagacaaatcacgccgctgccgcgtttccctgcaatggtataggtttcaaaacgttcgccgttgttgttgttgacaatggcgactttttcgttggggtagatgcctgccgcgtctaacaggtcttgatcgacggtaatactgccgacatagttcaaatcggcttcggtaacggtggcgcggtggatttttccgccaagcatggtacggaacatgtatttccttttggtttgtgtgcggtttgacgggcgcgatgccgtctggaaatctgaatgccgtattatagtggagtttccttcaaattcataatggcggctttcggacaaggaaaacggtgtttcagacggcattgcggtgtcggctttatttgggcaggcatctgttttgcaaggtttttaaaacgttttttacggtgttgattctgacctcgatattttccatctctgcggtaaaccgcagcttatcggcgccggcaaggcggtattttttgtcgttctgaatcagcaggatgatttcggttggatcgacattattgtttttaccaaaggttaccgttaccgcttcgccggccgcatcaatggcatcgatacccaattcttttgccataagccgtaagtggtggctttcgataagggttttgacgggttgttcgggcaggccgaagcggtcgacgagttcttcgtgtatggtgttgatttgttgcacggtttcgcagacggcgaggcgtttgtagaggacgagccgttcgtggatgtcggggcagtaatcttcgggcagcagggcggggctgtgcagtttgatttcggtggtgatgcccaacggtgcgtcgaggtcgggctggcggccttttttgaggtcgcgaacggcttgtttgagcatttcggtgtagagcgtgaagccgacctgtatcatttcgccggattgtccttcgccaaggatttcgcctgcaccacggatttccaaatcctgcatggctagggtaaaacctgcgccgagttcgtctgccgccgcaatggcatcgaggcgtttttctgcgtctttagtgatgtattcgggcgtgagcaggtaggcgtaggcttggtgatggctgcggccgacgcgcccgcgaagctggtgcagttgcgccagtccgaatttgtcggcgcggttgatgatgatggtgttggcgttggggatatcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcgcgcatattttcaatcgtatctacttcattgtgcaggaaaaatacctgtcctccgcgtttgagttcgcgcaacacggcttcgcgcacgctgccttcgctaaagggtttgacaaaggttttgacggcgaggcggcggctgggcgcggtggtaatcagcgagaagtcgcgcagtccttccaacgccatacttaaagtacgcggaatcggcgtggcggtcatggtaaggatatcaacattggcgcgcaggcgtttgagctgctctttctgacgcacgccgaagcggtgttcttcgtcgataatcactaaacctaagtttttgaatttgatgtcgtcctgcaccagtttgtgcgtaccgataacaatatcgaccgtgccgtctgccatgccttccagcgcggctttggtggctttgctgttgttgaaacgcgaaaggctggcgactttcacggggaaatcggcgaaacggtcggcgaagttttgcgcgtgctgctcgaccaaaagcgtggtcggagcaagtacggcgacctgtttgccgcccatcaccgccacaaacgcggcgcgcagggcgacttcggttttgccgaagccgacatcgccgcacacaaggcgatccatcggcttcgcttgcgtcaaatctttaatcacggcggcgatggcggcggcctggtcttcggtttcctcgtagccgaagccgtcggcaaacgcctgatagtccaactcgttgatttcaaacttgtgtcccgattgggcggcgcgttgggcgtagaggttgagcaattcggcggcggtgtcgcgcgctttttcggcggctttgcgcttcgccttgttccacgcgccactgccgagcttgtgcagggcaatgttttcatgcgcctgaccggagtagcggctgattaaatgcagttgcgaaacaggcacataaagctgcgcttcgcctgcgtattcgagcaacatcatttcgttggtttcgccgcccaagtccatcgttaccaagcccatataccgcccgatgccgtgttcttcgtgcacgacggggtcgccgatattgatttcggcaaggtcgcgcaacagcccgtctgaaacggcggcgtgtttcttgcggcggttgtggatgcgcgaacgggcgacgtattggtagagatcggattcggtgatgacggcgatggcactttgagcggcaactgctttgccctctccccaaccctcccccacgggggagggggcaggttgctgttggatttgcccgtgcagattacttttaccggggggcaggctgctttcggttgaaacggcggctgctttcagactgtctgaaacgacggctgcactttgttccctctcctgtgggagagggctagggagagggtttgttgcggctgcggaaaattcggtttgagcggcaactgctttgccctctccccaaccctcccccacgggggagggagtaggttgctgtcggatttgcccgtgcagattatttgcgacgggatgcaggctgcttttggttttcaggtcgtctgaaacggcggctgcactttgttccctctcctgtgggagagggctagggagagggtttgttgcggatgcgggaaattcggtttgagcggcaactgctttgccctctccccaaccctcccccacgggggaaggggcaggttgctgtcggatttgcccgtgcagattacttgtaccgaggggcaggctgctttcggttgaaacggcggctgctttcagactgtctgaaacggcggctgcactttgttccctctcctgtgggagagggctagggagagggtttattgcggctgcggaaaattcagtttgagcggcaactgctttgccctctccccaaccctcccccacgggggagggagtaggttgctgttggttcggcgattgcagtccgcccagtttgaacccgtatgccaacggcgccactgtaatcatcagcggctcgtgtgccgataaaaagccctgccagtcggacacgggtttggctttcaaaccgttttgctgcaagaaaccgagcatagtttcgcgccgtcccaaactttcggcgcacagcaaaatccgtccgtcaaacgccgtctgaaaatccttcaatgcctgcaacggctcatctgcttggcggttgacggcaaggtcgggcagggtgtattccttgccggaaacatcgggcagcacctgtccgtagtttttcagacggcctgcgaacacatcggcagagagatacaaatactgtggaagcaaaggcggataggtttcgtcgccctgcgccatcgcgtaacgcgatttgacatcgctccaaaaacggtttgcctcggcatgaacatcgtctaaagagacaaacagcgcatcttcgccgatatagtcaaacagcgtttccaactcgttttcaaaaaacagcggcaggtagtattccacgcccgcgccgaaatgaccgttgctgacggctttgtacacagccgcatcgttcggattaccatcgacttcctcgcggaagcggctgcggaagattttttgcgcctcgctgtcggtggggaactcgtgcgccggcagcaggcggatttcggaaacgggggaaatggtgcgttgcgtttcggtatcgaaggttttgatgctgtcgatttcatcgtcaaacaaatcgatgcggtacggcatttcgctgcccatcgggaacaaatcgactataccgccgcgcacggcaaattcgcccgccgcgacaacgtgggaaacatggttgtagcccgcatccaccaaatcacttttcagacggcctatatccaaagtctgccccgttttcagccaaaacgtgcgccctgccagaaacggcacgggcggcagcttctgcatcgccgtggcaaccggcacgaacaacacatccgccgcgccgcttttaatctgccacaacgccgacagccgctccgacaccaaatcctgatgcggcgaaaaacgctcgtaaggcagcgtttcccagtccggcaggaacaccgccgtgtcgtgcggacggaaaaaccgccatgccgtctgaaggcgcaacgcctgttccgcatcttgggtcagcacgaccttgagccgcttgtgcggcagataacgcgccaaagccaagggcagcgagccttgcgaaagattgggccaacgggatttttcacggggtttggggatggggtaggtcatagtgcggcaatcggcggacagtgatgcaaacggtcattttagcacgggaggggacgcgatgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcattttttcagacggtatcgacctgatgcgatacctgcccgaagacaaatggcttgccttgaagcaggcgggtttgctgttgcccttcctcgacaaaaaatacggcgggcgcaagggcagccagtttgaaatccaagaagtcctgcggattgcggggcattacggcgtgcccgttacgctgcgtaccggcatcgaaggcgcgctggtgttgcagccactgcaagagttcggcgatgaagcgcaagtcgcgcaaggtttggagatgattttcaaaggcgagggcggcggtttgggtgttaccgaacccgaaacctccggcgcggcgattgcacgcgaaatgcagtcctactacgaatatatcgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacatccttgaaaatctggaacgatacgtccgcaacgacatcaaattcgtcgattacgaacgccgcgaaatccggcgccgccatcaggtttccgagattctttaccgctacgtctgccattccgtttcgcctgttgcccccgtcgcccatcagctgatggaggcgaacatcgtcaaaaccctcgccacggaatacacttacgccgccgcgcaaatgttgcaaaaactcttgggtgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcctgaagacatccgcagcttcctgcaggaacacaccctgaccgatgcctgcgccctgcaaaaagtctttatcggcaaaatcatcgcccgactctttgtcttcgtacaggcgaaacacgaagacaccgcagccttcctgctgaacgacatccgcaaagatatattggactgccgatattgcgggtagcgggcaaatacggcggcaggcaatgccgtctgaaaggggaagtgccttcagacggcattttcggcgacgacatacggatttcgggcggtgcaagaggcaacgtgcggcattccgcaaagccgccgattgcggcggatgccgcatttcgcgccgcccccttgtgccgctttcccacttaccctatttgttcggaacatatttatgaaaaagagaaaaatactgccgctggcaatttgtttggcggctttgtctgcctgtacggcgatggaggcacgcccaccccgggcaaatgaagcccaagccccccgcgcggttgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaacgtcggcgatgtcgcggcatcggttgccaattatatgaagcagcacggttggcgcacgggcgggaaaatgctggtgtctgcaacattggcgccgggtgcggatgttcaggcaatcattggcgaaaaaaccgccctgacgcggacggtggcggatttgaaggcgtacggcatcatccccggcgaagagcttgcagatgatgaaaaggcggttttgttcaaactggaaaccgcaccgggcgtgtttgaatattatttgggcttgaacaatttttatacggtatggcagtacaaccacagccggatgtatgtaacggcggtcagggacattgccaattcgcttggcggcccgggattgtaatgttttttaaaatgccgtctgaaccacgtttcggttcggacggcatttttgcatccttttatggggatttcccgcatcagggcggtattcggggcgaatcccgcttcagacggcattgccggtcaaggcttgtccgaaggaggatgtccctgttctttggcgggcgggaggaaaagtatgcagggattgcttttaatctgattccaaaaacttttaatcagattgcggatgctgccgattttcgtgccgcgcgagcgcagggcgacgaagagggcgaggctgaagctgacgcagaggttgaccaggccgatggcgaggacgctgaaaatgccgagtacgaacgtgcccaaaccgacgttgccgctgacggcggcatagccgaggttggcggaggaaaaggcgacgtggcggatgtccagcggcagcccgaggaggtgtccgaaatagccggtcatacccaagagcatcccgaagatgaagttgccgaccagcgagccgtagtgtttgtggatgtaggcggcgaggacgcggcggggcccggggcgcatgattttacgcagcaaggggttgaagggcaggcgttggcgcaggttgaggtagtcggcgcggttgtcgaaaaaacctgcgatgatgccggagcagaacagccacagacctgcaatggcggcataccacagcgtcgggtaagcgatgatgtctatggatttgaactggtaggcggcggtgtgggcatcgagtatgggcagccggtacagatgggcatagccgaacgatatggcgcacgccaaaaggatggcgatggaaacgttgccgaagacggcgacactttgggagcggcatacgtcgatgaggagcttggcgagtttgttgtccaccgctttgccgccttcgttgagatcgacctgttcggcaaagctggcggcagtcatcgcgggctgcttggtggcgacggtgcagtgcagcatatggatgatcataaagccgatgccgtagttgaacccagccgacaaggaagtgaggaaggggctgaggccgagtgagccgatgcggattttgagcagcgccattagggcgatgatgatgccgccgcctgccgccgagtagaacattttgaaatattctttgcggttgcgggtgatgtagtgttcgccgtggtggcttttgttttcggtaatgctgcgggcgagcatacggatgctgctgcggcgcaggtggcgggtgctgtattgttcgaccgccgcgtagatgagggagttcatcagcgcgatggtcaggcggttgctgttgccggcgccggtttggatgtcggtgagcagcttcagacggtctacggtctgccggagccgttcgagcaggtgggcgactttgaccgacgaaccggagccggcgcccgtccctttgcggcgcaaatagtcaatctggctgaaacattggtcgaacatcacttcgaggtgggcggtgtcgtaaggcgtggtgccgttgcggtagtgttcgaccagtttggcggtttcgcgttggagggcgacgaaggaagaatcggcttccagcaggcgcggggcgatgcggatgaggtcgggttcgatggcttcggatgccgtccagacagacagcatttcgatggcgcgcaaacgcgcatcggcaaggcggatgcccgccgtctgcaatttggacggctcggcgtggctccggatgagttcgtataaaaccagccattggcggatattgagcgtttgcagccatttgtcgtcgttttcggaatggaaaagataaaggaagacttcgcccaagttggcaaaatctttatatgacgggctgaagcgttcgtagatgcgtatgcccatttcccgggcaaagctgtggcgcgagaagatgccgagtttgatgagtgccggataaatgtgtatttgcgcgagccaaatgtaaaaacaccggctgaagcgggacagtaattccctgtcttgtttgaatgtgtcgataatcaggtcgaaacgttcccccgcacattttttgccgccacggcgcaaaaatttaatcagtgcgttgaggacgttgacaaaatcggtatgtcccaagctttccgaaagcagggggcgcaggttttgaggggtaattttcttcatatcagccattgtaccgcatcggcaatccggcgttaaacgccccgatagcggggagggcgcgcctgcggtgggcggcgcattttccgccggtttgaaatcaaactatattaatgatataataaatatcgataaatcaatctgatagaataatccgtattgatttttaattttttcgattataacaatttcggccggtttgtgcatttcgtcatccggaagccggtattttaccggcaggttttgaccgctttgcccgatgaccgggtttgtctgtttttaacaaaggagtgagaaggtttgtccctgtctgaatttatagaacgccgaacgtcatttaatccgatggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcagcgtgcaggttttgattatcgccgccgtcatgtccctcgccgtcgtttcggcaatatccggcgtggggaagggcgtgaaggtgttgagcgagttgaacctgggccttgcgtttttgctgctgttttttgttttggcggcgggacccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggttaaccctaccagtgtattttggacgggcggcaagtggaaagaacggctggtgcagataatgagccagacgcaggagcaggatattttaaaattcctcaaacagactgcatcgcccgctatgcacgagttgcaacgggagctttcggaagaatacggcttgagcgtccgggtcgataaaatgtttcatcgggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaaatgccctccctccggtgtttgtcaaaaaaatgcggtgaatcagattcaccgcatttttttgccggacggggcttcggacggcacggcgttcatttgtttccgtcaaactgctccttcaacacccgtttcaataccttgcccgtagcgttgcgcggcagcccgtctttaaagtggatttgtttggggattttgaaatttgccagcacggtacgcaggtggcggcggatttcgttctcgcccaaatccataccttccttcaattggacgaaggcgacgatttcctcgtcggcataacggtctttcacgccgatgacggcggcggcttcgacggcatcgagtttgtagatttcttcttcaatctcgcgcggatagacattttgacctttggaaataatcaaatcttttttgcggtcgacgataaagataaagccgtcttcgtctatggtaacgaaatcgcccgttttcaaccagccgttgacgatggtttcatcggtggcggcaggcatattgaggtagccccgcatcaccgaaccgcccctgacgatcagttcgcccacttcgccgcgcggcacttcgaccaattcttcatcgacggctttggcttccaaaccgggcagggggatgccgacgctgcgggctttttgcctctcgggcgtattgacggcgacgacgggagaggcttcgctcagtccgtagccttccagcaatttggcgcgggggaacttggctttgaaatcgaggatggtttgttccgccaaaggcgcgccgccgctgataaacaggcgaatgcggttgaaccatctgaaataccaagggattttcgccttgctcatcgcggtgtaaatcgcgggtacgcccaaaaacacggtcgcgcgtttgagcagtgtctgtttcaaaacgttggaaaacggaaaaacggatttgaccaaaataatcgaacacgccatataaatcggcagcagcaccatagccgtcagcgtgaagctgtggaacatcggcaggaaaacgataaagcggtcgcgcttggaaattttaaagatgcgttcgatgccgttcaggttggcgaacaggttggcgtaactgattagcgcgcctttgggatgccccgtcgtgccggaggtgtagatgatgtgtgccaaatcatttatccggggttggcggcccaagtcgggtttttcggggaagcggcgcacgtcttcaaaaaaggcatcgccttccgccgtttcgccggtcggacggcttttgtccgtccaaatgattttttcgacgggcgtttgcgccttcaagcccgccaattcttttgacaggccggccgaggcgaacaggaagcgcgccttgcagtcgttcaggatatacgcgtattcgctgtttttcaaaaatgtgttcatcggtacggcgaccgcgccgatggcggagatggcgaaataggcggtaataaattctgtggaattggaaaccgccagcgcgaccgtgtcgccgaacttcacgccgatattttgcagatacgccgcgacggcttcggcctcctgcttgagcgcgcggtaggcggttttttccttgccgtcgaacactgccgtgccgtttccgtttttgcggcaggcggcggcgagcatttcgtagaaattggcataagtccggttcatgaaacttcctttatggttgcggacggagaacgccctcatttgaaaacaatatgccgtctgaaaacggaaggcggcagtttatcatctttgccttcagacggcatatcaaacgccgcctttgcgccgtatgccggaggttcgcctgcgtccttccgatgcctgaggcgaatgccggttgcgtccggcaaaccgtgcgcggggtggctatgccgtctgaagcaatatgaaggtatgcgtttcagacggcatccccctgttgcggaaataccgtccgcctcctgtccgattattgcctgattgcagcggagcggacgagttcttcgaggctgtcggcgagcatttccgccgcgcgccggtagcctttggcggagaagtgtacgccgtctttggcggcccatccttggttgagccagtttttcatgctgcatatgccgcccatggcgttttgccaagaccagaacatcgtctgcccctgacgggcgacgcgccgctgcatctgttggacttcggtcaggcggacggggcgtgtgccgcatacgccgagcgtgtttttcagggattcgggtgcgccgatgatgaggatgccggcggcaggcaggctgtcgcggatttggcggacggtatccagccatttttgttcggtgtcggcaatgtcgatgttgttgttgaaagcttcgttggtgccgtaggaaaggataaccaaatcggcgccggtttgggcgaggtcgttcatacggtcggcacgccatttcgaccactgggttaattgtgcgccgttgatgcccatcgcggaaacggtaatgccgccggcgggattttcgatgttgatgaagccgatgtcccacggcatttcggtgtgtatggtcaggggcagtgccgcgcccgtatccagtacctgccagccgccgccgttggcggagacggtgttgccgttgacggtcagggtttgttcggcaagcaggggtttggcaaacagggaaacgcgctgcttgcttgctatgccgtccgatgcggtcagggtcatgctgccgccgctgccggtgtgggcgaggatgccgccgagcgggaagtctccggtgttgttcctgctggtgaggctttgccagttaccgttgtgccggacggccgccatgcgctgccctttgacgttggcggggtaaacccagcctatgccgccgtcgccccaagttttttgcaggcgtttgcgcaggctgtcggtaaagaagtcgccggcggtatgcgagtcgccgatttgcaggatacggaaggtctcgccgctgccttgtgcgacggattggagttttttcatccaaggcgaggcggaggcgttgccgtagtcggtcagcagcccgtttgtatcggtgtagggggcggacggggaaacggtaacggtgtcgaggctgacggaggcgacaggtagggcttctgcctgcgtggcggcgaatagggcggaaaatgcgatgaggtgtttggggttcatggctgtgtacttgatggttgcgtacttggttcaaaaacgattttttccattatttttgccgccagcagtttttgtccttcggcggtaaagtgtatgccgtccttgctgcggtagcggacgggtttgccgttgacgttgacggagtcggtgtagcggtctttcccgccgctcagggtgtgcgtggtgggaatcaggatgattttgcctttcaaatgttccgaaagcagtttgtctaggtagcgcatctgtccgtcgagcttggcttttttcatgtaggggatgccgagccagacgacttggacgcggtgcgtgtgtgcggcttcaaggatgcggtcgacacgtttcaggtattcttgcgcccattcgtcggaagcgaatttgagatagagtttgccgacggggaaatcccacgggtcgttcggtccgaggaagacggcgagtacgctgatttcgggatgtttttgcagggtttcttcaatcgttttcggccagtcgaagaatgaggggtaggacagccccgtgctttgtttgctgaggttgacggattcgatgccgtattgctgtttcaggcttttttgcacgaagggggcaacgccctgcatcagcgagtcgccgacaaaaaagactttgtcgccgctgcggacggcggcggcttcggtgtcttgtttccattctgtttcaccggtttgagggacggcttcggatgcggcggcttcagacggcatatctgccgaaccgccgtcttgagccgtcggcggcgtttcgccggacaggaaggctttgatgccgtctgaaagggcgtaggcgttttcttgcaacgccgcaccgctccgccaccatccgtaggcggcaagcggttcgagcgggctgttgcggtggtaggtctgctgccagtaggcgttgatggggttttggctgaaccacacggcaatcagggcagacatcagtatggaggagaaaagggaaagaaagtttttcatgtccaaacccttaaaaattggcataaataaagccgggtatccccgagggggcgaggacgataatcagcagcaggacggcggaaacggggataaaccacagccacatcgggattttttccaaacctttgaccgcgccgtcgaaagcgcgttgcaggtaagggtagagcagcatcacggatgcaaacgaggcaagcaacagcatgtttgcctgttgcggcgcattccagccgttggcattggcaaagagggcactgaaaactgcgcctgcatcgtcgggatttgcggtattgaagacgacaaagctaaggcagacgaaatggaaggtaatgagccatgagagcggcgcgaagtatttcagacggcatagcgcgtcgcgtccgaaatagcggtcgcccgtgttgagcagcaccagtgccgtgccgtgcagcgcgccccaaatgaggaagttccagccgtagccgtgccagatgcctgagagcaccattgccgccatcaggttgagctgtgtccgtaaaaagccttttttgctgccgcccaaggggatgtagatgtagtcgcgtatccaggtggaaaggctgatgtgccatttgtcccaaaatgcgcggatgtttaaagcacgaagcggtgcggagaaatttttgggcagcctaaagcccagcagcatcgccatgccgataaccaaatcggaatatccggaaaagtctaaaaagagttggaaggtatagccgtacacgccgcccaatacgccccagccgtcgaattgggcgggattttcaaatacgggcgacacccagttttccgccagcatccccgccagccaccattttttggcaatacccagcagaatcagggaaacggcgagtgcggggcggacgggcgaacgcgctcggcgggtacggatttgcgccaatgcgcctgcctgctcgccgtctgcgcttttgaatgcggcggcgcggataatcgggccggaggtaacggtggggaaaaaactcaggtgcagcagcagctcgtgccagctgaaacgcgcggcgtgcggggcgcggaagcagtaaaccagataggcgagcgactggaaggtgtaatacgaaagccccagcggcatcaggatgtcgattgcgccgccttttccggcatattgggcaatcatcgggcggaaaaagtcgaaatatttgaaaaagcccaagacggtcagcgaggcggcaatgccgcaccccagccagaaacggcgcgtattttcgcgatcggaacggagcagttcgcccaaaaggtacacgcaggaggaataaaggacgatgattgccgcaaatacagggccgatatggtagagccagcccataccggcagccaaaagcagcaggttttggacggacgggtatttcgccaagccccagtaaatcggcaggaaggcgagaaagaacagtgcgaactcgacagacagcagcggcataaaccatccttggaacaaaaaataggcgttaaaacacggcaaagcccgttattttaagcaggggtggatatttcttcaatcaaaatgccgtctgaagggcgggaggggcttcagacggcatcgtgcggtcaggttcggatatggcggttcaggttcaggcagacccacaaacctgccgccgccgtcagcatacccgcaacgccgatgcaggaaatgcccgagtattgcgtaacccaatgccccagcagcgcgccgccgccgataccgacgttgtatagtggattaacaaaaatcaggacaaggcaacgaagccgcagacagtacaaatagtacggaaccgattcacttggtgcttcagcaccttagagaatcgttctctttgagctaaggcgaggcaacgacgtactggtttttgttaatccactataaatgcgccgattgccaaggcaatgatgctcaaccagggtttttgcgaagcgttcattgttgttgtcctgatgggaattgccgccattatgcgcaagcgtccgtattttttcaaaccgccgcaccgtttccgcgtttgcccaagttcacgccccgacttacaataacgcccgtcagaatgcagtaccaacgaaaggaaaaatcatggaaacccttatcctcgacatcggcggcatgagctgcggcggctgcgtcaaaagcgttacccggatattggaaggcgtaaaaggcgtggcaagcgtcgaagtcagccttgaaaacaaaagtgcgaccgtcggatacgaccccgcgcaaaccgatgcaggggcgttgattgaagccgttgaagacggcggctatgatgccgcgttgaaataaagcggcaaaaatgccgtctgaagccttcgcgcctcccagatgccgtctgaagtacgctccgcgccttcagatggcatttgatttagttgaacgggtaggatgaattggttaaacttgcgggcaatagtgccttcagacaaacaaaatatgccgaacaagaagaaaaaagccgcctttgcgcgtgctgcaacggagaacggtgtgccggacgtgtccaacatcaaaaattcatatgatgatttgatgtacgaatccggcgcattctctcaaaccgccatcaataatttggaggcgcgcgcccgcctgatgggtttgcagcccgcgcccgccgccaatgccaaggtcttggagctgggctgttcgatgggcggaaacatcatcacgcaggcactttattacccggatgcggaatttgtcggtatcgacctgtccggcaggcaggttgcacagggcaacgccatcattgaaaaaatgggcttgaaaaatgtgcgtctggaagaaaaagatattttgaccatcgatgagtcattcgggaagtttgactatatcatcgtccacggcatttggtcgtgggtgcctgacgcagttaaagacaaaattttttcgatttgctggaacaacctgaccaaacacggcattgcctatatttcatacaatgtttaccccggctggaaacggcaggagcagttgcgcgaaattatgtactttgccggcagggatgtgcttgaagaacccttggaagcgcggacgcggaaaggcttggacgcgctcaaggcgctggcggaaattttggaaaacgacaagggcttggacggcggcggcaaacttccggcgattcaaaaaatattgaatcataatttttattacatcgcacacgaatatatggaggcgtttaacgacccgatttacgtcaacggcttcatcgaatgggctaaccgccacaggctcgcatatatcggggataccaatttgcacgtgtcttttgtttcttggatggcggagcatacgcgggagcggattctggcattggcaggggacgattatattgccaaagaattttacagtgatattttatccgaccgccaattccgccgttcgcttttatgccgtgaggaagtcggggatactgtcaggcgtgatgagtcggttgccgtcgaagtgatagaaagtttgaatttccgcccggcaagaggggaaacaatcaactttgatgaaaacgatatcctgctttcgggcatacgcgatgtgatgaaaaccggagaggcgtttaaaacggaagatgttgcggaaaatctcgcccgccgatttcccggtttggaatttgaccgcatgaaaatcaattcccagcttttattgcaaaccattctcgggcgtttttctgtttcatcagacaatgcgggcaaaccattttttgaagaccataaaacctatgtgccggcgcgctttacaaactatgccgccgcctttgtggaacacggcgcggaagcgtttgtccggcctgccaaccgttacaacgaaagcaccccctcattcggatacgggcatttgtacattatgcgccaattgtcgcggccgacgagcaaacaggcattgattgaaacggttgccgaaaacttgaacatcgtcagcaccacgcccgacggtttgacattccatccgcctgccgaagtgtatgtggaagaaatattggcagacttggcagacaggcattttctcgtttcggcggattgacgggcaagtcccggcggcaatccgtccgatatattttcagacaggaaagacacacactgcgaaaagcggtgcacgacacatatgaaccagacatttaccttgcccgatacgcgcccgtatccccaaaatccgattaaaaaccacctgctgctcaatgcctaccagttggcgcataattcttcccaggcttcgcgcaaactctcgtccggccaacttcaaaccgaaatcaggggaatgcttgagcaaaaccactatatcaacctttccctcgcgctgacgatgtcgcccgatgccggaacttatgccgcgctgctttccagtgtgaacgcggtactcgattgcgagaaagaaggcgaagtgcagtggttcgccctgccggtcgtgctggtgtccggctgcaaaaaagaacgtgcaatcgagatgaagctgccgacggaggcattgtttgcctgcctgcaaaactatccgcacctgcgcgcgttgacgcaagagacgcaatggctgccttatcttgtgcattcttccgatttgagcgcggtcgcgccggatgagtggtggcgtgccaaacaaaataccgaagcggcggcgcaacacttgcgccgtttcgccccgcgccctttgctgttgcccgaagggcagtccgtccacgtcgtttacgcgctgggtttcggcagcggcaaagttcagacggcattgggtcagaaccttcttcaggcaggtctgcccctgatgcaggtatggcaggaaaatcttgcatcggaaggcgttacgctgtttgccaatccgctttccccggattctccggtacgcgcgctttcagacggcagccacacgcgccaacgtatggcgatggatgtgtttgcggcaaacgcgatacgcgccgtccgtatgcagagtccgcgcgtcggcgtggtcgctgcggcaaaggcgggcggacagattttattcgggtttaatgcgaccgacggcgcgtttgaagtcgtgccgcaggtgttttcgtggcagctttcctttaccgacaacatcgccgtcatccagcaaaatttcctcgacctgatggcggagtgccgcgtggaacacgtttacctgttgcacaatcccttgggcgaacaggaaagcatcccgagctatgcggaagcattgaaacgggaagggcacaatccgtttttcagcgcatagtgatttgtagtagtgataggctttctcatttatataataaatcaaaataaagagcacaacactttttcattctgtgttgtgccttgagtgaaacgaaaggatgaattataaatatgaagattgtaattgcaccggattcgtttaaggaaagcttgacagctcaacaggtagctgaagcaataaaaagaggcttccaacaatcgatagcagatgtggaatgtctcctctgtcctgtcggtgatgggggagaaggcactgtagatgctatccgacattctcttgacctagaagaaaaatgtctccaagtgacaggaccttttggacaaaaagaagtcatgcgctattttcaaaaagaacaactagccctattcgaagttgctgatttggttggtcttggaaaaatcccgctagagaaacgaaatccattacaaatccaaactcgtggtattggagaattgattcgccacctcattagtcaagaaattaaagaaatctatattggcgttggcggtacggccagtaatgatggaggtattgggattgctgctggtttaggttatcaattttatgatgaggatggaaatgccttacccgtttgcggtcaatccttactaaacctagcttctgtttcaacagaaaatcgctatgaaattcctgaagatgttcacattcgtattttagcagatgttgtgagtcccttatgtggacaccaaggtgcgacctatacgtttggcaagcaaaaagggttggattctactatgtttgaggccgtagatcaggcaatacaagatttttatgaaaaagtctcccctgcaacattaaaacttaaaggagcaggagctggtggaggcatcgctggtggtttgtgcgcctttgctcaggcaagtatcgtatctggaattgacacctgcctggacttgattgactttgataagaaagtgtcagatgttgacttggttatcgttggtgaaggaagactagatcgtcaaagtttagcagggaaagcgcctattggtgtagcaaaaagaacccctgtcggagttcctgttgtcgctatttgtggcagtctcgttgaagatttgccttccctgccatttgaaaatatccaagctgccttttctattttggagaaaagtgaacctttagaagatagtttgaaaaatgccagcctctatttggagcatacggcttctaatattggacacttattaaatatgcctaagatttagccaaaccatttcttccagatggatgttttggctggttctgccttatgcggttacgattaaccgaccgatgccgtctgaaagggtttccgcttcagacggcatcgcgccggaacagggaggggatatgaaaaaaccgaaaatcctttttgtctgcctcggcaacatctgccgttcgccgatggcggaatacattttgcgccgccgcgccgccgaagcgggcattccccttgaagcggacagcgcggggacatcgggctggcacgacggcgaagatatgcaccgcgagacggcaaagatattgaaaaaacacggtatcgatgcttcaggctttaccagccgcaaaatccgccaaagcgatgcggcggcgtttgactgcatcatcgcgatggacggcaagaatttgtccgaattggaaagaaccttcggcaggcggccggaaaaaatattcaagctgaccgacctgatacccgaaagcggttacgaccatgtccccgatccgtggtatacgggcgattttgaagaaaccttcaggcttgcggatgcgggctgtcgggcattgttggaaaagatttccaaataaagcaattgaatacaaatataaaaccgcctcctgccgtatcggttgttcagacggcataaacagagaatttatgaaaacaaatttcaaacagaaaattatcgaacaggcacgcagcgaaggcttgcaggtaaccgctttgcgcgagcaggtattagatattgtcttgcagcaaagcggcgtgattaaagcctacaacgtcttgtcgcagatgcagcagcaaagcgagggcgtgcttgcaccgcctaccgcctaccgcgcccttgatttttgggcggagcagggcgttttgcacaaagtggcggcggtcaacggctatattttgtgcagccacgcgcagcacgagtgcgacgaccattgccacgaccacgaagaagccgaagcgcaccacagcgcgtttattttggtctgcaccgaatgtggcacggcggacgagcaaaccctgagccacgagtgggcggcactgcgcgcaggcgttgccgaaagcggctttgcgctgaaagaagaacacgttgttttaaccgggatttgtaaaaaatgtcagcagtaatcggtggtttgcattgataataagcctttcgaaaggagcagataatgaaaccgtctcttttgttgcaaagcagaaagaaagaaatattggcagttttcgggaaatatccattgatttgcaatccaagggtattcggttcggtttctcgcggagatgatacggaaaacagcgacattgatttgttggtggatgcaaaaacagggacaacattattggatttgggcgggctgcaagaggaattgcagaaactcttgggcataaaggtcgatttgctgacacccgatgacatctcggcccactttagagataaggtgttgactgaggctgtcgcattatgaaaatgcagaaagaattgtcggtctatttgaaacagatattgcaggcagcgcaatatatccggctatataccgacaaaatggattatgggcaattttctgccgacacaaagactgtgcaggcagtcgtttttaatttgttccttatcggtgaaaacgcaacccatatccttaaatcgtatccggaatttgccgaggaaaccaaatatttgaattggatagggatgagggggtattgcgcaataggattgcccatggctactttgaaatgaacctgtctgtcgtttgggagacggttttgaacgtcataccggcgatgtcagccgatatatcgaatttgctggaacaattgtcaattgatgaagaacatgataacagctgccatcacttttaacattatttaatcatttaaaacaccctatcttcaaattttaaagtgggacatcacatagaaatgaaaaaaaccaaagtccacctgatttcaggttttctgggaacaggcaaaaccaccgcgctcaaaagcctgatggcgcaaaaagacccgaacgaaaaatgggtcatcatcgtcaacgagttcggcgaaatcggcattgacggcgcggtattgagcgacaacggcatccctgtggcagaaatcgccggcggctgtttgtgttgcaccgccggcccgcaaatgggcgtaaccgtgcagaaaatgctgcgcgacgccaagcccgaccgcctgatgattgaagcaagcggactggcgcacgccgccagtgtcattgatgaactgaaaaccaaaccgctggacagccttttggaaatcggcgcagtctttaccgtcgtcgatccgcgccagttcatcaaccccgattacgcgcagcaggcattgtataaagaccaaatcggcatctgcgacgtattggttgccagcaaaaccgatttatgcacccccgaacagcttgccgaatttcacgacaaagccgcaaaactgttcccgcccaaggctaaagtggtcgaagttcaaaacgcacaactcgatatccaatggcttgacatccccgtcatcgaaaaatcacgctaccgcctcaaagccctgccggacaacacgatgggcttccagtcgcaaggtttcacattccccgccggacgcgatttcgacggtgaaaaattgaccaacttcttcaatgatttgcccaatatgaccgaaggactcgtccgtgccaaaggcgtgttccaagtattgggaacgtgggtgtggctcaactgggtggacgggcaatggggtgcgaaccaagtgtcttggcggcgcgactcgcgttttgaattgattgccaaatcgtttgatgcggatttaatcgaacaaaaactcaaagacgcattggaatagcgttaacgagccttcagacggcataggaaatgaaaatgctgtctgaaggtctgaggaggacgggatgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggacaacgcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaacacgcagacagacgttcagacggcgtcgcccgtttcccaaaaaacgccgtttaaagtaaaaaaatattttaaaacagacagttgatattgacaaattcaaaccgaggattttaaaatgctgccaacccaacccaacccaacccaacccaacccaacccaacccaacccaacccaacccaacccaacccaacccaacccaacccaagccctgatctaagcgacacagccggggcgaacacgg

SEQ ID NO: 37783 - DNA, 19231 bp, Neisseria meningitidis
gacttttctactgttttgaagcaggatatcgatgttcgcaattatttgcgtcaaaaattggccaatgcttcggttggtcgagtggwtattgaacgccctgcaaaatctgcacgcattaccattcactccgctcgtccgggtgtggttatcggtaaaaaaggtgaggatatcgaggttttgaaacgtgacttgcaagtcttgatgggtgtacctgttcatgtaaatattgaagagattcgccgtcctgagttggatgctcaaattattgctgacggtattgcccagcagttggaaaagcgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcatatcaaacgtggtggtcgtatttggattcgtgtattccctgataaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaataatgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaagtaatgagcgaaactaaaaatgttcgtactttgcaaggcaaagtagtaagcgacaaaatggataaaaccgtaacagtattggttgagcgtaaagtaaaacatccgctgtatggtaagattattcgattatctactaaaatccatgcccatgatgaaaataatcaatatggaattggtgatgtggttgttatatcggaatcccgtccattgtcaaaaactaaatcttgggttgtcagtgagctggttgagaaagcacgttctatttaagaattaaagcaacgtgcttggaatgggaaacgaagtattgcagcaaatttaatttgcgtgtaaacttcgtttcctgtctttcagtttcttctggaagtttcttccctttcggggtccaagactggtttacttgaaccgcaaggtttcatttaataagcagcggctttgctgtaagttatctgaaagtggtaaattaagttggttaatttaaaggtaataacatgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggctccgcgtggccgtgtcaaaaaaggcgatgtatataatgcggtagttgttcgtactgctaagggtgtacgtcgtcctgatggtgcgttaattaaattcgataacaatgccgccgtgttactgaataataaacttgaacctttgggtactcgtatctttggtccggtaacccgtgaattgcgtactgagcgatttatgaaaatcgtttcattggcacctgaagtattataaggaatggcacgatgaataaaatcattaaaggcgatagggttgtagtaattgctggtaaggataaaggtaagcagggtcaagtagttcgagtgttgggtgataaagttgttgttgagggcgttaatgttgtaaaacgccatcaaaaacctaatccaatgcgtggcattgagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggggcataaggagataacatggctcggttgagagagttttataaagagacagttgttcctgaattggttaaacaatttggttacaaatcagtaatggaagtcccgcgtattgaaaaaattaccttgaatatgggtgtgggtgaggctgttgctgataaaaaagttatggaacatgctgtttccgatttagagaaaattgccggtcaaaaaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggccgtggcaattacaatatgggtgttcgtgagcaaattatttttccggaaattgaatacgataaaattgatgctttgcgtggtttgaatattactattactactacagcaaaaaccgatgaggaagcgaaagctttattgtcattgtttaaatttccgttcaaaggataatcatggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctggtaataggagtaattaagaatgagtatgcatgatcctatttccgatatgttgactcgtatccgcaatgcgcaacgtgctaataaagcagcggttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctattgttagtacttctaaaggtgtaatgactgatcgtaaagcacgttctcaaggtgttggtggtgagttgttatgcattgtagcctagtggaggaaaagaaatgtcacgtgtcgcaaaaaacccagtgactgttcccgctggtgtagaagtaaaatttggagcagaggcattagttattaagggtaagaacggtgaattgtcttttcctttgcattctgatgtagccattgaatttaatgatggcaaattgacttttgttgcgaataacagcagtaaacaagcaaatgcaatgtctggtactgctcgcgcattagtcagcaatatggttaaaggtgtttcagaaggttttgagaaaagattgcaattgataggtgtgggttatcgtgctcaagcacaaggtaaaatcttgaatctgtctttgggtttttctcatccgatcgtatatgaaatgcctgaaggtgtctccgttcaaactcctagccaaacagagattgttttaaccggctcggataaacaagttgttggtcaagttgctgctgagattcgtgcgttccgtgctcctgagccttataaaggtaaaggtgttcgctatgtaggagaagtagtggtaatgaaagaagccaagaaaaaataattgaggttcactaatggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtatcgctgaaaaagctaaagcagcaggtgtagaaaaggttgcttttgatcgttcaggtttccaatatcacggtcgtgtgaaggctttggctgaagctgctcgtgaaaatggtttaagcttctaaatatttggagactttcagatggcaaaacatgaaattgaagaacgcggtgacggtctgattgaaaagatggtcgctgttaatcgcgtaactaaagtagttaaaggtggccgtatcatggctttctcagcactgactgttgttggtgatggtgatggtcgcattggtatgggcaaaggtaaatcaaaagaagtaccagttgctgttcaaaaagcaatggatcaagctcgacgctctatgattaaagtacctttgaaaaacggtactattcatcatgaggttattggccgtcatggtgctactaaagtatttatgcagcctgctaaagagggtagtggcgtaaaagccggtggacctatgcgtttggtttttgatgctatgggcattcataatatctccgccaaagtgcacggatctactaacccatataatatcgtacgtgcaacattagatggtttgtctaagttgcatactcctgctgatatcgcagccaaacgtggcttgacagtggaagacattttgggagttaaccatggctgaacaaaaaaagattagggttacattggttaaaagcctgattggtacaattgaatctcatcgtgcatgtgcacgcggtttaggtttgcgtcgtcgcgagcatacggtagaggttttagatacccctgaaaaccgtggtatgattaataaaatcagctacttgttgaaagtggagtcttgatatgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagcatcagctaatgcacagcttcgtttaagtgaactggaatcaattgctgttaatgagattgatattttggtcttaaagcaagcgggtctgattgcatctacagtctctaatgttaaagttattgcttctggtgaaatttctaaggcagttgctttgaagggtattaaagttaccaaaggtgcgagagctgctatcgaggctgttggtggtaagattgaaatgtaaggtttaatattgtggctaatcaacaaacgtcatcaggttcatccaaatttggagatcttaagaaacgtcttttgtttctatttggagcattgattgtttttcgaattggtgcccatatacccgtacctggagttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgtttattgtatttggtgccttattattaatttatttggttgtatactttgaaagtgcacagcggaagattcctattcattatgcaaaacgccagtttaatggtagggcgggtagtcaaaatacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagccctaaagaaatggcagagaatttaaaaaagagtggtgcttttgttcctgggattagacctggtgagcagacctctaggtatttagaaaaagttgtattacgtttgacattgtttggagctctttatattacaactatttgtttaattccagagttcttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctccgtcacaaacagcgtcaaggttaatggaatatttcttttaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgaccaagttgccaagtatgaagtagaaggtgatttgcgtcgtgaggtaactatgagtatcaagcgattgatggacatgggctgctatcgtggcttccgtcatcgtcgcggcttaccatgccgcggtcaacgcactcgtacaaatgcgcgtacccgcaaaggtccgcgtaaagcgattgctggtaagaaataaattttaaggaattttattaatggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgtgaatcctctgtacgtgctttgaatgctcttggtttcaagattaccagcattactgacgttaccccgttgcctcataacggttgccgtccgcctaaaaaacgtcgtatttaatattggagtgatttgaaacatggcacgttatattggccctaaatgtaagttggcacgtcgcgaaggtacggatttgtttttgaagagtgcgcgccgctctttggattctaaatgtaaaattgattccgctcctggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgtcgtaaaggttctaccggcgagttgctgttgcagttgctggaatctcgtttggataatgtcgtttatcgtatgggtttcggttctacccgagctgaagcaagacagcttgtttctcataaggcgatagttgtgaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcggataaacttgagggtgtgttcaaaaacatgccggatcgctcggaattgaccggtgatattaatgaacagctggtggtagagttctactctaaataatgctagctcagtgagggacagttaaatgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattacacgaatattctactgttgatggtattcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgagatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtacgcctgtggaggaggttgaagaaaaagcacctcctatcgaccctgttcttttgcgtccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagccttaatgaagaattaaaggataattgatatgcgtcatcgtaatggcaatcgcaaattaaaccgtaccagcagtcatcgtgctgcaatgctgcgtaatatggcgaattcattattgactcacgaagctattgtaacaactctgcctaaggccaaggaattgcgccgtgtagtagagccgttgattacattgggtaaaaagccgtcattggcaaaccgccgtttggcatttgaccgtactcgcgaccgtgatgttgtagtaaaactgtttggcgatttgggtcctcgttttactgctcgtaacggtggttatgttcgggtgttgaaatacggattccgtaaaggtgataatgcacctctggcactggttgaattggttgacaaaccggctgctgagtaattttagtcatataacgccatctgccgaaaagcaggtggcgttatttttgcaatatctgataggtaatagggtattggctatcatgtttaaaatattaattgaatagctaaggtttgcgcggtaaacttacatcattaaaaaattctatgatggtttatataatgaatgctttcgatataaagtcgacaaagatggacgtattgtctatatctttgcatacgtcagacttgtttgatttggaagatgtgctggtcaaattgggcaagaagtttcaagagtctggtgttgttccatttgtgctggatgttcaagagtttgattatcccgagtctttggatcttgctgcattggtttcgttgttttcaaggcatggtatgcaaattttgggtctgaagcattctaatgaacgttgggctgctgcggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcggatggcaatatacatatttatgcgccgatgagggggcgtgctttggccggtgccaagggtgatacttctgcccgcatatttatccactccatgcaggcagaactggtttctgtggcgggtatttaccgtaattttgaacaggatttgccgaaccatctgcacaagcagccggtacagatattgttgcaggataaccgattggttatcagtgcaattggctcagagtaattgtttgatatttaaaaaggaaatattgtggcaaaaattattgtagtaacttcaggtaagggcggtgtcggtaaaacgactaccagtgccagtattgcgacaggtttggcattacgcggatataaaactgcggtaattgattttgatgtgggtttgcgtaacctcgacctcattatgggttgcgagcgtcgtgtcgtttatgacctgatcaatgtcattcagggggaggcgacgctcaaccaagctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgccggtattgagcagggtgcattgatggcgttgtattttgctgatgaagccattgtaacgaccaatcctgaggtttccagtgtgcgtgactccgacaggattttgggaattttgcaaagcaaatcccataaggcagagcaaggcggttcggttaaagaacatctgttgattacgcgttattctcccgaacgtgtggcaaaaggcgaaatgctgtctgtacaggatatttgcgatattctgcatattcctttgctgggtgtgattcctgaatcccaaaacgtcttgcaggcatccaattccggagaaccggtcatccatcaggacagcgtggcggcttccgaggcatataaggacgttattgcccgtcttttgggcgagaaccgtgaaatgcgtttcttggaagctgagaaaaaaagcttcttcaaacgtctgtttggaggataaggtatgtcattaatcgaatttttattcggcagaaagcagaaaacggcaaccgttgcccgcgaccgccttcaaatcatcattgcccaagagcgcgcccaagaaggtcaggctccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggtataggacatgaccttaaccgaattgcggtacatcgtcgcagtcgcccaagaacgtcatttcggcagggcggcgcggcgttgttttgtcagccagcccactttgtctattgccattaagaaattggaagaagagcttgccgtctctttgtttgaccggagcagtaacgatattattacgaccgaggcgggggaacgtatcgttgcacaggcgcgtaaggtattggaagaggcggagcttatcaggcatttggcaaatgaagaacaaaacgagctggagggtgcgttcaaactcgggctgatttttacggttgcgccgtacctgctgccgaaactgattgtttcgttgcgccgtactgcaccgaaaatgcctttgatgttggaagagaattacacgcatactttgaccgagtcgctcaaacgcggggacgttgatgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacaacgtatacaggggttgaccaatacattgcagggcagctcgattaatacaatccgccatatggttgccagcggtttggcaatcagcgtgttgccggcaaccgcactgaccgaaaacgatcatatgctgttcagcattattccgtttgagggtacgccgccaagccggcgggtcgtattggcgtaccgccgcaattttgtccgtccgaaggcgttgtcggcgatgaaggcggcgattatgcagtcgcagcttcacggggtaagttttatctgcgactaggcgcaggcattgttttcaaaacgccatttccctgagccgacaacacggtatgccaagatattgccgtcatcatcgattttgagtatagcatcgccacggaaactgccgtcctgaagatattcgacttttgcatcactgtgaatgttttcatcagtgccgatgcaatgccatgtatagtggattaacaaaaaccagtacggcgttgcctcgccttgccgtactatttgtactgtctgcggcttcgtcgccttgtcctgatttttgttaatccactataaaagaggccgtctgaaaaacatttttcagacggccttgtttattcaatcaaatcagtctttcaacttcgccaactgattttgaacttttgccattttgtcttccaattccgccaaatcggctttgtctttttccaccagatgcgcaggggctttttcggtgtagccgggtttggagagtttggcgttgagtttgtccaaggctttttgcagcttctcggcttctttgctcaaacgggcggtttcggcggctttgtcgatttcgactttcaacatcaggcgcgcgccgttgcagacggcgacgggcgcgtcttcgctttcgggtagggcggcgacttgctgtgcttcggtcaggcgggtcatcatcggcaggtatttgaggtagtccgccaagtcgtccgtgctttcgacaaacagcggggcttttacgttgggctggatgcccatttcgccgcgcaggttgcggactgcgccaatcaaatcctgcaacacggtcatttgctcgaatgccgtctgaacaatctcgccgctgtcggcttcggggaagcgggcgagcatgatgctgtcggcggttttcgcgtcgcacataggagcgacggtttgccacagttcttcggtgatgaacgggataatcgggtgcagcaggcgcagggcggcttcgagtacgcgcaataaggtatggcgtgtggcgcgttggcggctggcgcagccggtttgaagctgcactttggcgagttccaaataccagtcgcaatagtcgttccatacgaagctgtacagggtttccgccgccaaatcaaagcggtaggtttcgtaggcttgcgtaacctgttcgatggtctgattcagacggcctacaatccacatatcggggaaggagtagccgcgcggttcggcagcggttgcgccgtaaccgcagtcttggttttcggtgttcatcaagacgaagttggtggcgttccagattttgttgcagaagttgcggtagccttcggcgcgtttgaagtcgaagttgaccgaacgccccaagctggcgtagctcgccatagtgaagcgcaaagcgtccgcgcccatactcggaatgccttcggggaagagttttttcgtggcttcttccactttcggcgcggtttcgggtttgcgcaggccggtggtgcgttttaccagcagtttttccaagccgatgccgtcgatcaaatccacagggtcaatgacgttgccttcggatttggacatttttttgccttcgtggtcgcgcacgatgccgtggatgtacacgtctttaaacggtactttgccggtgaagtgggtggtcatcataatcatacgcgccacccagaagaagatgatttcgtagccggttactaagacattggacggcaggaaggctttgagttcgtcggtttcagacggccagccgagtgtggagaacggcacaagcgcggaggagaaccatgtatccaatacgtcttcttcgcgagtcaagcctgttttgccggcttgtttttcggcttcttcctgattgcgggcaacatacacattgccttcgttgtcgtaccatgcagggatttgatggccccaccacagttggcgtgagatacaccagtcttggatgttgttcatccattggttgtaagtgttgacccagttttcagggataaagcgtaccgcgccgctatcaacggcttttttggctttatcggcgaggctcaagcctttgaactcgctgtccggctcgccgccgtttggggtggcggacatggcgacaaaccattggctggtcagcataggttcaatcaccgaacctgtacggtcgcctttcggcgtcatcagcgtgtgtggtttgatttcgaccaagaaaccttgttcctgcaaatcggcaaccatttgtttgcgcgcggcaaagcggtctaagcctgcgtatttttcaggcagggcaaagcctagttgcgcttcgcctttgaagttgaacacttcggcgtttgccagcactttggcttccaagttgaacacattaatcaggcgcgtgtcgtggcgtttgccgacttcgtagtcgttgaagtcgtgtgcaggcgtgattttcacgcagcctgtgccgaagtctttttcaacgtattcgtcggcaatcacggggatagtacggccggtcagcggcaggattaattccttgccgattaagtgggtataacgttcgtcttcaggattgacggcaacggcaacgtcgcccagcagcgtttcaggacgggtggtcgccacgataacggcttcggcgggattgtccgccagcggatagcggatgtgccacatagagccttgttcttccacgctttccacttccaaatccgataccgccgtgccaagcacgggatcccagttcaccaagcgtttgccgcggtaaatcaagccttgctcatacaggcgcacgaacacttcggttacggtttcggcgcgcacgtcgtccatcgtgaaatactcgcgcgtccagtcggcagagcagcccacgcggcgcatttgttgggtaatcgtgccgccggaaacttctttccattcccacactttctccaaaaatttttcgcgacccaagtcatggcgggacacgttttgcgcagcaagctgacgctcaaccacaatctgcgtggcgatgcccgcgtggtctgtgccgggaatccaggcggtgttgcagcctttcatgcggtagtagcgggtcagaccgtccataatggtttggttgaaggcatgacccatgtgcagcgtgccggttacgttgggcggcggcagttggatggagaaagacggtttcgtcaaatccatatcaggttggaaatagccctgctcttcccagttttgataatgtttggattcgatttcggctggattgtatttgtctaacatgatggaactttgtgaaattaaggttatttttgatgtgcggattataacgcaaaaaggccgtctgaatcatttcagacggcctttggcatacaggttttaaaaatggaacaataccaggctgacggcaatcaccgccatacccgttgtcaggccgtaaacggtttcatggccgtctgaatagcgtttggcagccggcagcagctcgtccaacgccaaaaacaccatcacaccggctatcacgccgaataccgaaccaaacacggcaggcgacaaaaacggctgcaaaaccaaatagcccaaagccgcccccaacggctcggccaagccggatagcagacacgcccacaccgttttcttacggctgcgggtggcaaaataaaccggcgcggcgatggaaatgccctccggaatattatggatggcaatcgccaaggccaaaggcatcccgactgctggattttccaatgtggcaaaaaacgtcgccaagccttcggggaaattgtgcgcagtaatcgcaaacgccgccatcatgccgactcgcgcgatatggcggcgtttgctttcttgaaacgacgggtcttgcgcgtctaaagtttcatgcgggttcggcaccagacggtcaatcagcgcaatgccgcccatcccggccaaaaatgccatggtcgccgccgcaaacgcgtggtctttatcataaatttcagcgaacgcctcgctggacttactgaaaatctccgtcagggaaacatataccatcgcaccgccggcaaacgccaaaccaaacgacaacacacgcggattgggcgttttggaaaacatcaccaagccactgcctaatacggtaaacaaaccggcagccaatgtgatggaaaaggcaacggccaaattggacatcgaaaaatcgggcatgagaaaacctgcgctaaaagctgggacaggttcagactaacactttttaatgtatatgataatagttattatttattttattgattggatacacggattttgaaacaaaaggccgtctgaaaaatgattttcagacggcctttaaatttgaaatgccgctaaaccttagtgctttccagcttaagcctgataacgcgacaggctcaaatcgtcgctgcggatttcggtgtctttgccgctcacgatatcggcggttaattttgccgaacccagcgacatggtccagcctaaagtaccgtggccggtattcagaaacaggttgtcaaagcgggtgcgaccgattaacggcgtgctgtcgggcgtcatcggtctgaggccgctccagaacgatgcttggctcaaatcgccgccttccgggaacaagtcgttgacgaccaaagccaaggtttcgcggcgtttttcgggcagtttgatttcgtagcccgacaattccgccataccgccgacgcggattctgttgtcaaagcgcgtgatggcgactttgtagctttcatctaaaacggtggacaccggtgcgccgtctgaattggtgaccggcagggtcaaggaatagcctttgacgggataaatgggcagattgagatccaactgcgccaaaaccgtcctgctgaagcaaccgagcgcgcagacaacggcatctgcttcaaaccgccctgtttcggtttcaacggttttgatgcgcagcccgttgtggtcgatgcggctgatgttttggttgaaatgaaaccgtacgcccttttcctgacacaatttgtataggttttcagtgaagaggcggcagtcgccggtcgcatctgcaggcaggtgcaggccgccggcaattttggcggtaacgcgtgccagcgcaggctcaaattctgcacattcttcgggtttcagacggcggtacggcacgccgtagcgttccaaaacggcaatgtcttgttttgccgcttcgacttctttggtttggcggaaaatctgcaacgtcccttttttgcgtccctcaaaattcatgccggtttgcgcttcaaaacggcggaacatttcacggctgtattcggaaatcctgaccatgcgctctttattggtttgatagtgcgctgccgtgcagttttgcagcatttgccacagccattcgatttgatacaggctgccgtcggggcgaaacagcaaaggcggatggcttttaaacagccatttcagcgctttggtcgggataccgggtgcagcccaaggcgtggtatagccgtaagaaagctggcctgcgttggcaaaactggtttccatcgccacaccctcggcgcggtcgatgaccgttacttcatgtccggcctctgccagataccacgcggaagacacgccggcaacacccgcacctaaaacaagcactttcatgtttctccctccggctttttcaaaacagacttaatatgccgtgccgtctgaatattcggattcagacggcctcggatattaatgcggcaattcgccgtttgtgattttttgtttgaagtcgcgcgtttcattgacgatgactttcgccatcaataaaagtgcaatcaggttgggcaatgccatcaagccgttgaatgtgtccgaagccagccacaccaaatcaaggctcaacacggtacccagcataacggaagaaacataacccacgcggtacaaaccggcaaatttctcgccgaaaacatacaccgcgcatttttcgccgtaatagcaccagcccaaaatggttgagtaggcaaagaaaatcaggccgatggtaacaatccagccgccgatgccgggcagcattttttggaatgtgacggttgtcagtgccgcgccgctcacttcaggtttgacaaactcgccgcccgcgccgagcagtcccattaccaacacgatgccggtaatcgagcaaacgacgatggtatctaaaagggtacc

SEQ ID NO: 37784 - DNA, 49914 bp, Neisseria meningitidis
ccgcaatgccaaacgtgcatcatcaacgatgtgtgcgaatatcccgccaaagcctgactgccgccgcctgtcaaaatgaaacgcttgaaagttcggacggacgttgtagaatttcaacgtataccgtctgaagccgacaaaatgcgcttcagacggcattaaagccggtaccggcatccgacaaaggacaaaacgtgttcaaaaaataccaatacctcgctttggcagcactgtgtgccgcctcgctggcaggctgcgacaaggcaggcagctttttcggtgcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataacacacataatttaaccaaaatattttttaaatgataaaatgcccgtcaataccgattaacgggcattttacaaaaatcagttggttgattttaaacaaatattttttacgacaaaaaatatttccgcccattttgccaacaaaacccaaaccggaggcggacagatacgctcccatccggacgcttaacacccccataaccatgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaaatcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgattgcccgccccgttaccgacaagtttaaagtttcccgcaccaaactcgcctacatcctcgactccactgccgctcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttttccttcgacatcggctcgatggcacgtttcgaacaagccgcgttgaacgaagcccacgatgaaactgccgtttcagacgctaccaaaggtcgtgtttacgcactgattattcccgttttggccttaatcgcctcaacggtttccgccatgatctacaccggcgcgcaggcaagcgaaaccttcagcattttgggggcatttgaaaacacggacgtaaacacttcgctggtattcggcggcacttgcggcgtccttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaacgcgccaacgcctgacccctttccctgttcagacggcatatgccgtctgaagctttttggagcaaaccgcaatgaccgtcccccatattccgcgcggccccgtcatggcagacattgccgccttccgcctgaccgaagaggaaaagcaacgcctgctcgatcccgccgtaggcggcatcatcctcttccgccgcaacttccaaaacatcgaacaactcaaaacactcaccgccgaaatcaaagccctgcgcacacccgaactcattatcgccgtcgatcacgaaggcggcagggtgcaacgtttcatcgaaggcttcacccgcctgcccgcaatgagtacgctcggcgagatttgggacaaagacggcgcgtccgccgccgaaaccgccgccggacaagtcggccgggttttggcaaccgagctttccgcctgcggcatcgatttgtccttcacgcccgtcttagatttggactggggaaactgccccgtcatcggcaaccgcagtttccaccgcaatcccgaagcggtcgcccgcctcgccctcgcccttcaaaaaggtttgacaaaaggcggtatgaaatcctgcggcaaacattttcccggacacggatttgtcgaaggagacagccatctggtcttgccggaagactggcgcagcctgtccgaactcgaaaccgccgacctcgcccccttccgcattatgagccgcgaaggtatggcggcggttatgcccgcccacgtcgtttatccacaagtggacacaaagcccgcagggttttccgaaatctggctcaaacaaattttgcgccgcgacatcgggttcaaaggcgtgattttctcggacgatttgactatggagggcgcgtgcggggcaggcggcatcaaagaacgcgcccgcatttcctttgaggcaggttgcgacatcgtcctcgtctgcaaccgtcccgaccttgtggatgaactgcgcgaagatttccgcattcctgacaatcccactttggcgcaacgttggcaatatatggccaacacgctcggcagtgccgccgcgcaagccgtgatgcagacggcggatttccaagcggcgcaagcctttgttgccggccttgcctcgccgcaggacacggcgggcggcgtgaaagtcggcgaagccttttaaaccggctgcgtttcaacaatctgccgatttcatcaaccgtttgtcagggaaaggcaatgattttttcggtcaggtagaaagttatcttattgaattacttaaagataatgatgattatcaacactgtattcaaacacaacgttttaaatccgcccgacacgcggcaaaaaggcaaaacggtataggcacgccgcactttttgcgctataatcacgccttacttaattcggaatgtagcgcagcccggtagcgcacttcgttcgggacgaagggggcggaggttcgaatcctctcattccgaccatattcaaaccgcctcggcatccattgccgaggcggtttttccttttggcggcaacagaaaaatgccgtctgaaacagaatgctgtttcagacggcatttcgttttccctaaccctgccatttgcgcgcactggcacagagtatcggcaaggttcaaaagaccatcggaatttaggaagccgagcttgtacccaacggcagcatcttattcagtaaggctccgtcctgattgggcggtggaaatgccggcatttccacgcagaagcggcacactttccccgtatgtcaaacatcggtaaaaccgtacgccgtccctttgagttacactgcttaaactactctattcccgcccatttgtgcgtctgcacgctcaactgccaatgcacggatgcgtcggggcgactgtttaaaataccgatttggcggatggtgtcgtagatgttcatcgcaccgtcttgctcacagggcgaaaggtagtaatgatgtgcgcggattttgcgttccatgttttcgcagaacgcaaggacatcaccatcggcaacaatccgcacttcgtcggctgtttcgatacagctattttcatatttggcggcgtagcaggctttggggctggtggcgacgtagtcgatttgcggcggcgcgggattgagtccgttggtttcgagacagaggaaatagccttccgccttgagcgtgtccagcagcatatcgagatgcggctgtatggtcggctcgccgccggtgatgatgatgttgcgggcggcgtaggttttcagacggcctaagatatcggacaagcccatcataccgaatgtcaaataatcggtatcacaccagccgcacgccagattgcatttgcccaagcggacgaaaacggcgggcatgcccgtgttccagccttcgccttgcaggctctcgaaaatttcgacgatacggtattgcggattttcgggggcaacattgatttttttcataccgccaacaccgctgccgccgccagcatcgcgggcagtccttgtttgacgagtatgcctttgttgccggacgaaaacgcgccccacgcggcggcaatcaatacgaaaccgagaaacagagtcgtcgcgccgtaaacggcgttgtccggcgcggcaaaccgcgaccacaccagcccgatgccgagaaagccgttatacagcccttgattactgaacaaggtctgcacttgcttttgttccataaattcataaggcagcttgaatatttccgccgctttttcgctgggaatctgtgtcatttcaagccaggcgatgtagaaatgttcgacggcgacgaagaggactaggaggatgaagaggagtttcatgggtattccttttaatgggtgtatttgatatggaaggtcgtctgaaaaaacggggaatccgtacaggagaaaaaaccgttttacggtaaattcaaataaggacgctctaaaccgtcctttccgcgcaggcgggaatccagagagttggaattgctgcaatttttaaatattcctgataaatcaaggtctggattcccgcctgcgcgggaatgacgcggttgggcatgtcttattggaatttactatatcgatacgttcaagatattccctactccccttcatactccgcacacgatgtcggcgtttcccacaatttcacgcggcacacgttcagccccgcgtttttcagacggccgtacatttcgaccgccatattttcggcagtggtgcggcagggcaggcgcagggttttcatgttccagccctccaaaagcgcggcgatttggcattcgcggctgttgccgccgtggtagatgaaggcgtggtcgaaggggtcggtaatgtgttgtttgacaatggctttcaagtcggtaaagtccatcaccataccgtctttcgcgccgcctttgataatgccgtctgaaacggtgatttcgagtttgtaggtatgtccgtgcaggttttggcatttgccgtcatgcccgtcgagcatatgcgaggagtcgaaggtgaagattttggtgattttcatgggttctcaaatgggcaaatagccttgaaagccgatttcggcgggtttgccgtgcggattcggggtcaggcggatatggaaattgccgatgcggtcgagcgcaagcaggttgtccacgtcttttaagttgtctttatgctgctgaacatagctgtcggtcaacagggtttgcagggctttttgtttggcttcggcaggcgtggcggcggcgaacagcccgaaagcgtgtgcctcggcaagctgacccgcgcgataaccgccgacattggcgaaatacaggcgcggggcgtgttcagacggcattttcgttttgggcgtttcggatacggcgatgtcgtaaccgtccgcccattcgacaatctgccagccgtcgatgtggattttgtccgcatcgccgaaccacgcggctttgagcgcggggacggcctcgcggtagttgtcgcacacggcaaattggatgtcgtgcacttcgatattcgacctgccggcattgccgccgaggtaaaacatatggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcacgcccatttcgtccgccaacgcccacgtttgcgccttggtcagatacatcagcggcgtgtggatttgaaaatcatagtccatcgccaaattaagggtaacgttcatcgatttgacaaacacgtcgcggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggcttgttggtttgacatatcgaatcctagttttggtaacgcgggaggtttgcgaaccgcgaagttggacagtaaagatgcggattatacaggcaaacgtgttcagacggcatctgaacgccatgccgtctgaacacgcggcttatgccgacttgacggcgagttccgccaagcgtttgctttgtgcgaaggcgatattgttttcttcggcggtcaggacgggagccgctgtcgggaatatcttttttgacggcttcgcagacggcggagactttggggacggtgcgcaatacggcttcgcaaccttcaacgctgtcgatgccgcgagcgattcggagtgcgggattgcgggtgctgccgttttggaaatagtagaggacgaggattttgagggggatttgggttcatgggcggattccgttaaaatggttcggtcttcagacggcataacagttgttccgatgccgtctgaaacagccgcagttcaggcatttgttcctgacggcaaaattggctataacatcgggcatcaatgcccaacttactgaccgggcaagaaattatgacctttttacaacgtttgcaaggtttggcagacaataaaatctgtgcgtttgcatggttcgtcgtccgccgctttgatgaagaacgcgtaccgcaggcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcagggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatggtcggctcggtacaggatgccgcgcttgcctcaggtgcgccgcagtggtcgggcgcgttgcgaacggcggcgacgctgaccttcatgacgcttttgctgtgggggctgtaccgcttcgtgccaaaccgcttcgttcccgcgcggcaggcgtttgtcggggctttggcaacagcgttttgtctggaaaccgcgcgctccctcttcacttggtatatgggcaatttcgacggctaccgctcgatttacggcgcgtttgccgccgtgccgttttttctgttgtggctgaacctgttgtggacgctggtcttgggcggcgcggtgctgacttcttcactctcctactggcagggagaagcgttccgcaggggcttcgactcgcgcggacggtttgacgacgtgttgaaaatcctgctgcttctggatgcggcgcaaaaagaaggcaaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgacaccgtgtttgcagactttgaacatgacgctggcagagtttgacgctcaggcgaaaaaacggcagtagtcttgagtatttttgaaactgtatttttatcctaaagacattttcctatctgctgattccaccgtttcctttctgtgtgccgccataatttttatgatagacaagccattcaagtttgcattgactgctttttcattggcaatatccaaatggctggtcgctgcatctaaaaataggattttcggttcgcaatattaaggcccgcgccaatacgatgcgttgtttttgtccgcctgacagtgcgctgcccatatcgccgatcaaggtttcatagcccataggcatggcggagatttcttcgtgaatcatagcaaggcaggcgcaatgttcgatttttcctctatccggttccgtatcgaaaaaacaaggggctgtactagattagccctaaatcccacaccaatcccgcaggattttaagctgttgagacggtgtgccgaagttaaatcgaaattcgcattctttcaagaacagcgggaaagatttacgatcgattccgttgtattttcgcaagacgcgtttagtctagagtctgtatattacatttatttttagggtctgctagccaatttcttgttcccttcattattttatcttctgaaagaaaattatttttttccatgctattaatattaatgatatgatttttatttaaaataatttttccatataaaatttccggtttgtaatagcaagagtctgaagcaaatccttgcccgtcaatataagaaaaataaatgttatcatcctccttataatattctaaaaccaatccggatattattttatcaaaattcccttcatttccatctttcatgactaaaatataattagcaggccaacctttatcgtaaacatattcaaactgatagttcccgaaactctcgatatccgaactaaaaaagaagaaaagcaaattaatagccaatacaaaaacaaataagaacaaaaatagcaaaattttcaacttagttaacaatatttacctctcctttaaattcaatcctgaaaggtaccccttaccctgggctaccaattatagtttccatatttctaaatattgtttttacattacttttttctccccccaaaggaatgcattttaaaatcatgcttttcaggtgctaatcgatacttaccattaacatctttaatcacagatatatttccatgtatagcccaacgtgaaaaatctgagtattatatacagttataccttactgaaacaaagctagctgtacatatctgtaccatatttttactaaaaacaaaaaatatttataattattaaggataagataaaaacccccaacgccagattaattcttaataatttcaaataaaaaatatttgagattttttattttccaaataatatattgaaatatttaaagttaaggtagcttgatttaattagaaaatcaaaaaaaccattaattaatttttcttctttaaatattttatatgatattataaaattaaataacattgcgaaaacatatgaaatcatcaaaataccaaatatatagtgggaatgcattattatttagctccttcttttggctttgacaaattgacagtccattgatatccaatgcttgcatttgcaattgctgacgcacctgcccctgttttccctgttagtatcaatggttcttttcttgcaagatgtgcacctgcacaaccacctaatactaaaccaccacctattgtaaatccttcctgttgtatctctaatgataacattttcttctcgtgccgcccttaatacagattgtggaattggattgacctgagcaggaacttctaaaataagttttcctgtaagttttcttcctcttagcggagcaggtgtacttggaacattggaaatgacaaagtgagtacgcaaaccacctgaaggcgatgtgtttgaacctgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaacctgttgaaggccgccaacaggctaagtgcgcccgcgccgcctaaaaggcagcccggatgcctgattatcgggtatccggggaggattaaggggatatttgggtaaaattaggaggtatttggtacgaaaacagccgaaatcctgtgtttgggtttcggatgtcggggaagggcttttttgcaaaggtctcaactcatgttattgcaaagatctcatgccttgttttgccagcaggttgagttcttctccggcaatcagcgtggtaaagcctcgccacaacacagatctatgtactatggaagggcttcaatttatagctttcgaaaatctttcagctttaagacggcctaaagttgtaatctataaaacaggagctcagagttttacggctcactctcgcttcgcgttaccaaataccagcttatcggttttgaacgtatagtaatctatccaatcctgcagatattcatacggataagacaagtcatactgtttcataaaatcgaagatgtcttgatattcgtctgccggcagcggatcgtaaacagtcaaatccctcggcgcgatttcgtggtctatgcccaaatcgaaaccgtgcatggatgcgattttggcgtaggtaacgatttgcggctgcaggtagaaatcgaaataggacaatgtttctttggcagccatacgcgcggtttttttatcaaaaagcggctctaaggcggccttcatcgcctcggcatcctgttcggcgaaagcgaggaagaagcggtaatcgtacaaccgcttttgcagccatttgctaggggtgggatgcgccaagactttctcgctacgttgtttcaaccgatcaagctgcttaccctccaccatcagcagagtattgtaaatcatatgacggttgaggtcgtatcggtttacgaaggcttctgtatcgttggcgatgttgtcgatattgcgcaccaaaaactcgcgcagctgcgggctgtcgctcatcagcatcagaaacatcggatcttgaatgttgagcatgtcgcagggaaagaagaagggttcggggtcttcatcatctacactctgcaaaatacccaactttcctgcaacataagcatattgcttgaatttcttaagatcatgttcaaatagataggcatgggaagccgcagcttcagtgtacattaaaatgtatttcatcgctgcaagcggcacgccttttttttcatctacataatctatagattcggggcaaccgctattgaaattagcagtattgcctatgattacattagtaatatgttcataccatttttgggtggtcatcatattgtgccccattgttatctccttatattggttttagaaggaactttgacagaaagaataacggccttacctgtttgacgatcaacgcctgctattgccgtttttaatttgccgttctgatttgcttttaagacaactgccttagcaggactaccatcaggtaaactttttacaacttgtttaatccattcacgactcatctgcgtatatccacccgcaccattcggattcagctgtaccgtaccgttcctaatctgcttactttctacaatcaaaacaacactaccatcggcagcctgccatacatgatcaaaaccgttatttccgccgtatttgccgcccgaaagcactctgaagccattttgtttagctaaagagtcaaataactgctcggtcattttacctgtcgtgtccttccttcgccaatagctttcagcaattgtttgtcagttgctgcagtaacccttaattcagtttgaccgattttgattttggttttactgacatagccctgtgcagtggcaacggttgctgccttgtccaaggcttttttcatgccttgtaaattttttgccgctttcgctactttataggcctgtatcgattcaccgatacccggaaccacacccagcaaagcaaacaggtgatcggcagcggtctgtgcttgtacaaaactctgtatatcaccgataattggaataaatcctgtctgaaaaagctgtttttcagacgggatttattccaaacattggtattttatcccgcccagtattcgctaccgtcttcgggatctatccatacggcgtaggcaggagcctcgaccgtaagccacattccaatatcaaatggggcatagccgggaagtggattgggttcgatttcatattcaggccatacttccctaaatatttgttcccattcttcgggcgtatgcccgataatttgcccgtcgcgttgcagtttcagatgacctctgcgcagcagctctttgaaaagaataaagaacgcttcagttttttcctcaaaatcgctggaaaagtctttgatggttgaccacaaacaactcaaaggaagctcatagttgatagtgaactctacatcctcttctaaacgatcttgataccgtttatgaacatcgtgattattcaattttctcatttgaattttatttccctataacctattcttgcttacttaattagaatcagcgcaaagattttcagggtatccccatactaaaataaatttattaatttcagggtatatattgattgatatagactctccttttctacatagaaaaccatgtccatagccgtcaagtggtaaataattatcttttttcaggtcatttatgaaatttaaaaaagtagtattactatattctgaaaaaataaatttatattttgtatatcctcctcgcatgtatttatctttactctctaagcgaaatttttctttttgggcatatagcaagatatttgatatagatttcttttctaattcagcatattgccttatttgataatagtcataaaatgtcccaattattagtatgactaacacccaactcattaattcaaatgttttttttagaaaactaatcatatatttcatactaactcctatttttttatgtttgcactaataaatttatcaatatcttttatgttacctatgtatattgttttttctactcctgcagcaacaccacttcccaaaccgatttccccaataatttttgaatctttaaaaggagatttagatttagatattgttgaacttaccgaaaagcaggctcttgtcagacaaagactaccaccaacactctcacctaccaaagtctgggaaatcatttctgcataggctttattttgattactatttctgaaatcattcatagatgcttcttttaaataatcattaggggaaacatttaaaacccaaccgacagataccccacttatatttgattttgttgattttacagtactccatattttacctacagagaaatatacattgccatttctagtgttaataattaattttccattaaccatacgattcccgaatttattaggtaatttcatttctcctgaaacacttacaaagtgtggcaagcccagtggtcgataagactcacaaaagctttctgctcctcctgcactcatacataaagcataatttccactcaacaaacgatcctgtatatcatttaaagaattattctctaccgccacagcagccgcattcgccgccgtactcacatcccccttactcaacgccgcaaccgcccctgctgccagcttcgccttagcaatgatttttgccctgtccttcacattcaggctgccagggtctctgccgtccagtagggtttcgccaaggatttcaccgaccgccgcaccgatcgcaccatcttgacacttgcccttattcgccgccgctgccgcacagcccgctatggcatgggcaatcttatgggcaatgtagtgctgatccaactgtttgattttacttgctgcctctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgaacgatacggaagcctggctggccaaagaggcaaatgctgcatcggttgcggcggcggccgcaccgtttaatcccaatacggctccggttcctgcgcctgaggtgaccacggtaacggccagtgcgataattgcggctccggctccggttaggccttcctgtttatagtcccatttgtcgtaagcgagctgtacttggttccagttcacgtccttgaccgtctgaagctgtttcagataggcatattcgggctgtttggccagcttttcgatttcggttttgaggttgcctttggggatgtcggcgatatagccgccgggagcggtcagcttaggcagtgccggcccttcaaagctcggtagcttcagcgtttcaaccgtgctgccgcttccggcctgcttttgccatacggtcgagttggattccagcttttcttcggtttggatgcggttaacgatgccttttaggataattttcgcatcggctcgggctttttcacccacccctgcctgtatgtcggctccggaaagggtggttttgaattcggtgccttcgagtacggtatcccagccggaacgggttttggctgtttgggcgataacgcgtacgggcagtttggtttcgttcagctcgtttttgctgtaattgcttttacccactttgatgccgatgaaacgggtacttttctgaacattcaattggtgttggtgaatgccttcggctgccagcagttgcattgaggccgtctgaaaaacggatattcagacggcctattgctactttaaataatatttgggtttaaaatatcatcgtatttcccaaattcggggaacagaaaatcaattatttaaatttttcatcctcataatatgggtgatcaaaaagctctccttcccacatatttatttcttctatgcctttatctttcataaactcatgataatcataaaaatcttttccatattgtccgtaaaaaattttcatatccccaagccacatagcataacattcatcgcataaaatgacctccccagagaaatatttaggctttgcatgataaaggtagccttgctcacatcttgggcaaattttaatttctttatccataagagattcctttcttaattatttctgaggatatgcagaaatgattttatttgttcctttttgcacaacaatccgcacttttgtttctccttttgttccaataggtttcttcatatctacaagatatacggatgaatcatttggcaaaggatttcctttcattctccaagcttcatcaaccaaaggcaaaacttctttacgggacacattaaaaacagaatgaacaggtttgtttggatttggaattgtatgggctaaaacatgtttaatcctattaccatgcttagcatctaacccataatctaaccccgccggtgttgtccaaaccttattaaccttatcataagtaagcttgattccggtctgcttctgaatttcctgtatggctttagccgtatcaactgcttcgtctcccgccttcagaacataagccccgcctcggctgattttagtcgcacctgccggaacaaagggaacggcagctgcggcggcatccacaccaaaatcaatcgccgcttctcgagccatctgcttatcgccaatagatttggcgtaaatccatttaccgccgtcccatacgaggttgccaatatcccaaataatatctaatgcattatttttaacagctgtttcggaagcatttgccgccacatcaacattgcctcctgtaacacctacagtcgctccggctaccaattttgcatacgcagtaatattcgctttagctttttcaatttcagaagcagtcataccgctgaaatcggtattcttaaccaaagcctccccgacaatctcccccacgaccgcaccaatcgcgccgtcctgacacttgcccttattcgccgccgctgccgcacagcccgctatggcatgggcaatcttgtgggtggtatatcgctgccagccctctctgttgataatcttgcgtatgattacgccgtttgatggctaatcgtacctacgcaggcttaaaatttccatcaatccatatcatttgagttttcatcttcataatatggatgatcaaacaaatctccttcccaaatacattcactcgttataccttgggattccatgaaaggaacataagaataaaaatctttttcatattctccataaaatatattcatacctttgagccatactgcatcgcattcatcacacagaataatttcatcatgaagatatttaggtttcgaatggtagagatagccttgttgacaagcaggacacattttcattctcttattcatgattactccatataatcgatttatttttgtgggtaagcagtagtgatttgattgctgcctttagtctgtacaacaatacgtatatagcaacctgataatttcctggtttttatcagctttatcctcagattccaaacccaataataaaagccgtctgaaattttttcagacggccttaaaactcaattaaataatgtccggatttaacaccaaatcatattcgccaaactttggaaatagaattaccttatctttttgggaatataattctgttttttcatatcgctcattattaataaaatcctctttcaaaacatagcaatcatccgtattttcattgaagaaataagtatatccttctgctaagtcatgagattccaaagttatataatctctccatacagccatagaaagaaaataataattcgaattggaatatttttgaaattgatgggttaaataatcccttccaaatttatcgaaaaaatgtaccgaaaaaaaacctacttcctctcgcaaggtaattacatattcaggttgtgtcgccgaacctattacggcagtatataactcccctttaagatgtttttcctcagcttgtttctcagaaaaaggcttatgaagtttcttataaccataagaccactgctcacaataaaaaatatctttcttcatttgtaaatccttcctgttgtatctctaatgataacattttcttcttgtgccgcccttaatacagattgtggaattggattgacctgagcaggaacttctaaaataagttttccttcaagctttcttcctcttatcgtagtaggtgtacttggaacattggaaatgacagcaccagggctatattttctaacagcctccttgatataaccaatccccgtactttcttggatttgagaaaattgggtaaattttcttgaaataatttcctctgtcgcaggattatacgaatctaccctaaaataccccgtcgccgatttaggattggctacataaagctcattataagggtattttgatgacatgatacggttaaattcattgccgttgtttatcctgattctataaattgggtcaacagcaaagcctctggattcccttaattgattataatattgcctgtatgtttgtacatcatgtcttgtccacggctctctaggattcctcataatagcaatcccgttaaatttcggatccagccttcggatttgattggtaatggcctggatttcaagaatggcatattcatgttccaattcttgtcgcgaagtccaacgtatatttaccctcctgcgagctaaaagactattattctccactgccacagtagccgcattcgccgccgtattcacatcccctttaaccaatgccactgcgctgcctgcgataatctgcgagtaggctatgactttttggcgttcttggggtgacagtttgcctacatcgcgtccgtccaacagggtttctcccaccatctcgccgactgccgcgccgattgcgccgtcccgacatttgcctttatttgctaccgccgatgcacagcctgctacggcatgggctatcttgtgggcaatgtagtcttcgctgagattaaatttgattttgctcgctacttctccgtgtacggtactgactatcgcacccagtgcggcatcgcccaagttgtctttcaggctgccgccgttgatggcggtatggacacttgcggcagcggtgctgttgatcaggttagcggtcagtttgcctgctgcgggactgtgaaaatgtttgctgacggcttcggctgcttgggtgttcagcccgcttatgccctgcagtacgcctgcggttacggcggcggtggcggcctgtctgacggtgctgcttttgcccagttctttcagggtatggtttatgtctcctttgttgttgatgagggaaactgcggcttggctggcgagactggccagtgcggctttgcctgcggctgtggtgatagctgcagctgatgtgcctgctgctactccggttgtggctgccgttcctgctgctactccagttccggctgccgttcctgctgcggctcctcccgctcctgcgcctgccgcgcccgccgttccggcggctgccggggcggacagtgcgccgtaggtcaatacggttacgacgataacgacgacagctgctgctgcgggtgtcatgccctcctgtttgtagtcccatttatcgtaagcaagctgcacctgattccagttgatgtttttcgcaacttgaagttgtttcaaataagcatactcgggctgcttggtgagggtttcgatttgggttttcagattgcctttcggaatatcgacaatgtaaccgccgggtgcggacagtacgggcgcaacgggaccggtgaaactcggcaattgcaaggtttcgatgttactgccccgtcctgcctgtttttgccatagagtagatttgctgctgctcacggtttctgtgtggatgctgcttttgatcccttcgaggataatcttggcatcggcccgtgcctgctcgcctacgcctgcgcgtatggttgcgccacccagtgtggtttcaaactgtgtgccttgcagtttggtatcccaacctgattgcagattggcagattctgcaactacccttgagggcagcgcggttttcatgacttgggtggtggtgtcgtgtgctttgctgtagctgatgccgagaaatctgcgccttttttggctgtcaagtttgtcgtagttgagctcttctacggcatagagtgtcaatttccgcccggcttcgatgttaatgctgcctttgggggcatcgaatgcggtggcgtaggcgtcgatgctgccaccagatttgatgtcgatgccttgggatgcgctgagggttactgcgtcgggcttggcgtttttgtgttctttgacttcggtaatgtgtttgcggttgtaccatttgccagttttgtagctgcggcgttcaaaggtatagagttcgctctgtctcgcatagtaatattggtcaccgtaagattgaattttgattttgccgttttccgaactgatatccgtggtgctgagcaggatgcgactgttctcattggcatacggtgcgctaatgctcacaccggttttacccgaaagttctgcagcaagcgtagggggtgtcttcagcacgcacgcgtctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagtttgtttgagaatatgttttttgtatttctttacactttttttgatattcagggtgagctattaagaaatcagatattgcaatattaaagtaatgatatgctaaattaataggtataattaattcttcaggattgaaatcatctccaactgaaaaataaatagaaggagctttatcaatatactcaaatccatttacctcttcataatctccaatccatctggtagcatctattttttcatattgagcacctattactccaaaatgtccggtagttgtaatatttttaaaacactctaaaagcgtatctttagtttcaaattggtaaattgtttcaaaaaaaatcgaaataacaaaatggttgttatttatagattttttatttaagtttagaaaaatattatttttcataatttttcctttaaattattctgggtgaatgtttgtaattcttcctgtatttacatcaaaatatgatctaaatttgattccgtcaaaggtttctgagaattgaatgacattttttctttccgatattgatttagttctttcattttgagcaattttagaggcttttgaatatccttgtgaagcagcattttgagccatttgaagtattttatcatcagaaaattttttaggattataaacagtttttatacttgaaatttccttaaatccaccatcaggtttacctgtcctgtctagtgtaggaatctcatatttaattcgggtaatgccttcaatatcagtttgggtttcagattttacgcgtcctcctcgtgaatttagttctgccataaaattggtgcggttatgggctcctttaatgccctgtttttgactaaaaccatcagcatttgccagatgtctttttaggtttgtatcgaaactgatgccttccgggtatttgacattagtaataggtgtattttgttttacaaaccctcttggtattggaatgaatctaggattaactcctgaaataagtgtataaccttggtcggacatccattcggataaaggctttgtattgcccgattgaagccaagatttagcagcagtattcaaatgataagactgtaaagccaaatctgcttgggtgtaagatttgctgaataatttataccattcatcatctttaccaattagacctgcttcccaagatgaatgaaggcttctactatcgatcaaatgttgttttctgattgttctacattcagtactacgggatatatccgtacatattgcaatcgaagcagcaagtcttttatcagcaacattttgatacttttttacagtattttttctgcacagttgaggattattctgtttggcgcatgcagtcatttcgttatcaaattctctaccctctttgtcgctaagctgattatttttcaccgctacctcagccgcattcgccgccgcatttacatcgccgccgaccacaccgcttaccgtaccggcaaccagtttgctgtatgccaaaatctgttcgcgttctttagctgtcaaagtgtcaggatttttgccgtttgtcaaagcctccccgactatctcgcccacagccgcacctatcgcaccatcctgacacttgcccttattcgccgccgcagccgcacagcccgctatggcatgggcaatcttgtgggtaatgtagtgctgatccaactgtttgattttactggctgcttctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgagcgatacggaagcctggctggccagcgaggcgaatgcggcatcggttgccgctgcggccgcgccgtttaagcccagtgcggctccggctcccgcgcccgcagtaaccacggtaacagccagcgcaataatcgctgctccggctccggttaagccttcctgtttatagtcccatttgtcgtacgccagttgtacctggttccagttgacgtctttggtgacttggagctgtttcaaatagcaagcgtagggggtgtcttcagcacgcacgcatctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagcttgctgctattcatcaaattgcggccattgaaagtctgttgttttactttcacctctcaacagtctaatcatatcgcttttgagaaactcaaaaaaatttttaatattaccaacatagagcatagcttcacatagtgaactacatgcagatttaatgtcttcattgtcaatagcatattgatattccttcatatgctgaaaaaaagaatcaaagtcttcttctaattcatcattccaatcagatgaatagttagaaagccattgtaagtcaagaggatcttcactattcaatttttcagttgtggctttctcataaagatcaaatccttgtttaattcctaactctcttaaactttcttttactacattaaaatttttcatctgaatcaccttatttaagattcaattttcgcccttgccctgctaatgtcttagcttaattttgagcgagttttaggtttcatgcagactacagcttactcagcacacacgagtctaaacagtatacagggaatctaaatatttactttcataacaaatgccgtctgaaaaaattgagcttttcagacggcatatggccgtaaatcatggaacgcgtatactgaagcccacaccttatgcatgggttttagatttcatgcaggctacaacttgctttctattcatcaagagatggccatgaaaaactattctttttatactcagcactcaataatgttgatatatcagtttttattgaatcaaatataagagatagattacctgcgtaaatcatagccataaataaagaattactggcaattttgaaatttttatcgtttagggctaattggcatacttccatataatctaaaaagttttttaaatcctccttaaattcattatcccaattcccgtctgaagtataatctttaatccatttcatattagctgtttcatgattaacttcttctgatacttttggatctgtcaaatcaaacccttgataaagccccacattaatcaagattttttttatatcattcaatgtttccataaaatttcctattttaagtttaatttacgaccttttgctgccccagttttcatttggttaagcgaaccatccatatttagaacaaacttaaagttcccatttttatcaaaaacctctaaatgatttttatgttggccatctaaataaaacctatcaccggtttttaataacccttggtttctttttaccaagaagacagactgcccttgctgcgtcggaagcgttgtcttttctgaaatttgagccagctgttttccaaaaggattatttttcatgtatgtactcatattcggtacagcacctttattagggatataaggacgatttttttctaaaacttccttgaccttttgtgccgcttcccctttattagcgcgattcagctctgttccgacgacaatatcaataacggctttggcatcgttccaatccaatgtttcgtcgaataaggtggtcaggttgtcggctaaattataaccttcgtctttcaacgtctgttttaaatctctaacgttgattttcccgttttttaatccttttctggctaccttataaaccacttttgcagcagttacaacagctttaaccgcattattttctaccgcgttttgtgcggtttgtgcagcagtattgacatctcctcccgttacgcctgcaactgtacctgccgcaagtttggcataggcggtaattttcttaacttccagatctaattgttccggggtcatatcgctaaaatcggtatttttaaccaaagcctccccgacaatctcacccacagccgcaccgatcgcgccgtcctgacatttgcccttattcgccgctgcagccgcacagcccgctacggcatgagcgattttgtgggcgacatagtgctgatccagtcctttgatcttactcgccgcctccccatgcgcggtattcaccaatgccgccaggatatttgcctccagattgtctttcaggctgccgccgttaacagcggtgttgatcagcgcggcactgcccgcattggccaggttaacgttgaggttgtttacccaaggggtttcgctccaagtggcaagggaagaggcaccgagtttgttggatacgcctgccgttgccgccgctacaaccagattttttaccgtgcggcttctgcccagttccttcagggttttgccgacatcgcctttattgttgatgagcgatacggaagcctgagaagcgagtgaggcaaaggcggcatcggccgctgctgcggctgcgccgtttaagcctagtgcggctccgactcccgcgcccgcagtaaccacggtaacagccagcgcgataatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcagattgcctttggggatgtcgacaatgtagccgccgggagcagagagcttgggcacaacggggtcggtgaagctcggcaggagccgcggagcttcaaacaaggggggcttaacactcccgcgtctgtacagcatacagggaatctgaatatttacttgcataacaaatgccgtctgaaaaattgtgagcttttcagacggcattgagccgtaaatcatggaacgcatgcgtgctggcgcacacacgctacacgtggattttagggttcatgcaggctacggcttgtttatttaaattcatcacgtttcattggaatggttaaaggggtttttaataaaaattgtgaattatcgttataaaaagcacatccacattgagtacagagatacaccgtttcatgcgtattttgttcttctaatttttgcatttcaccccattcgcagtaaggacagactctttcaatatgttcaataaataaatattctaaaatatctctaatatattgtacaaagtattgaaatttaaaatttcctgatgatattttacgataaatattgtttttgagataaataatttcctctctattcaatatagatttttcaaccggatagtcatcgggattcatttcgatatatttactaaagtcataacctaaaattttaaatttatcaatgacaatatcgtttgataaccatgaaatcaaaactttcaataaatcaaatgaggtagagttatgatttaaatggcttaaagcatcatttaattctaaaatatattttttttcaaagttactcatatttagttagtttccttttactgggtatgtagtaatcaaatttcctgacttatctgtaaatactttaattgtagttgtgggttgtccaccttctttaatagaagtagtaccaataacttttcctacatcgacagtccgcatatattggccatcaggagtcatcgatacgggagaagaaactactttattactttgaagtataaccttcaattcatttggggagatggtaaaaactgaacggttattcgcaataggcctatggaagtgcccctcaagaacatgctcaaagccagcagataccggttgtcccgtttgtctcattggtgtatatcgagtagtactattcgctatattaattcgtgtatttacagcacctatattttttgattcttgtagtaagccatcaagttctttaactgtctgggttggtatagcctgcttggccgccttcgctttcgacaacgcccccacaggcgcttcccaagcgttgcctaccgttaccgcacccgtggcgattcccgcgcccgcttcggcagcctgagtgaccatgacagtacaaccagaaggattagccatgcaggtgctgatagctaatttacccgctgtaccgatcagcggagctgtccaacctgcagcataaaccccatagctggtaatcacaatcgggcctgtgatgccattacggatattgcttatccaaatggcagcatccttatcctgcggattagtcatcgcacctgctgcatgtgcaggcataataccttggataattttttccagtgcggttttgtcgggcttctgcggttgatgctttttcgcattggtaggggtactgtcaaaattcaaagcattattcactaccgccacctcagccgcattcgccgcagtattcacatcgccgccgttgagtgccgccacgctgccggcaataatcttcgagtaactgataaccttatgcttttccgcatcgctgagtgtagcagggtttctgccgccaagcatggagtcggctacgatttccccaactgctgcgccaattgccccgtctttacattttccttgtaccaatccgctaacacacccagccaaagcgtgggcgaactgtttggcaacataatcgtcgctgaaggttgttttgattttgctggcggcttctccttggaagctattaaccaatgctcctaatgcggcattgcctaagttgtctttcaggctgccgccgttgacggcggtattgataccagctgagatacctgcattactgagattggtagccagtctgcctccaaggttggcaatagtttgattgcccgtactgctgaacagttcggttcttaccttgctgttcaattgggcaatatctgcgcccatctgatttaatgcacccgccgtcagggcagaagtgacaatctgcttgaccgtatcactggtgccgagatctttcaacgctttgccgacatcacctttattattgatgatggatacagctgcttggctatacaaggaggctaaagcagcggtttgcatggcagtcgctgtagaaacggtagtagctgctgctgtcgttgtggcggctgttccggcagctgcggctgtactacttcctgaagcggctacaccgcccgctgcggttgcgccgtatccataagtcagtgcggttacgattatggtaacaatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcaaattgcctttcggaatgtcgacgatatagccaccgggggcggtcagtttgggcggagtagggctttcgaagctgggcagtttcagcgtttcgatagtgctgccgcgtccggcctgtttctgccatacggttgagttggtttctaatttttcttccgactggatacggttcacaatgcctttgaggataattttcgcatcggcacgggctttttcgcctacacctgcctgaatgtccgcaccggccagcgtggttttgaattcggtaccttcgagcacggtatcccagcctgaacgggtggctgcagtttgggcgacgacgcggacaggcaatttggtttcgttcagttcgtttttactgtaattgctcttgcctaccttgatgccgataaagcggcggcttttttggacatccaactcgtgcttgtggatgccttcttctgccagcagttgcagctcttcacccgcaaccagggtaactttacctgcaggggcattgaagcgggtggtattagcttcgatgttgccgcctgcctgaagcgttatgccgttggcggtcagctcgacgggggctggcataatcaggtggtcgcgggtgctggtaaacttggtttttctgatgattttgccgcttttacctttggtttttaagaaggtataggcatcgttttgtccagcctccagtacaatatcactatgggctttgatgtctatgctgcctgagggagctttgatttcggatgcaccgataataatacgtgcatcatcgagtgccgcagctgcatgaatacttacccctgtacgtccggtcaaacgtgaaggcttgttcagagcagctttgtcgtagtgactcttgtaggtgggcttgccaatttcatattggtcggttatgccgtcaatcagaatagcagccgcctctgaatctgctgcctttggcaatacgcctgcggcgtgaaggttcagttttttggaagcggtaatatcggaaccgctgatttcgatgccttgtgcggaaatcaagtcaatattttgtgcagaaagcttggcttgcaggtattctttgcctttgggttttttacctttaacttccttgttgatggcttgaatatagaaagcgagacggtcgcgttcttcttgcagggttggaatcagcttgcttttaggcgagctttttttcaactgcgcaatctgctgttccaattctttggatttttggttgagttcagccgctttttgtgtaggaaaataattgctgaatgagttgtttacggcttcgatattcaacttgcctttggtggtggcgacaaccaagtttttaccggctgtaattttagaacctcttaaatctgtttctcctgtaaccagacggatattgccttttgcttccaatgaggaaacttgagcactaggcgcacctgcatttcctccttttgcagacaacagcaattttccgcctgttttgatgctcaggtcggtatgcgcactgatgcggttggcaggttcgatggttaatgtgccgctacctgcttcaatattcagccgtccggccaatggttttaattcggcattatcttccaaagttttggtcgaaacggtactccaattgatgttgccgcgcttgactagggcggtaccggcagtaaggttgattgcacccgctctcagcgtggtgttgtcggcaatttgggaatagcgcgcattgagtgccaatacaccgttagccaccagcttgttggcagaaggcagtttgtcgttttgccaaatctggctgccggtaatgcttagatgacggtgtgcgtaggcatctacttggttgagcgttacccgctcgtgttgtgcattaagatgcgtattatgggtagactccagcttggtattttctatgctcaatgcccggtcggaatgaatgttcaatgccccgcttttggcatggacgttaaggttttttaagtcggcattaccaccgttgtttttgatgctgatgtgttttccgttgattgaattgcgttgttttccgtcaccaagctgaataccgttgccggcaaccaacgtaatatctcctgaagatgaagtgatattggtattgtctgctttcagacggcctttaccaaccgatcctgcattgacatcggccttggctgtcagggtattgtgaccggtaaagtcggcattaccgttggccaataaggatacatgaccgtctgcagaaacagcatgaaggccgtctgaaacgatattgccctgcaatgcggtggtttcgagagccttggctgcgttcagcttggtattgcgaagctgaatattgcctttggctgcctgaatgtgcagattacccgagttggtacgcagattggtattggtaacattcagcgagcctgcctccacacccatgtcttttgaggcagtgagggttttactggtgccggtaatatgggcagcgttatccgatttcaaatggatgctggcggcagacaaatctttatcaacattcaaattcagatctttacctgtatgaacatacagattgccgggagtattcagattggtagttttggcagtaatgttatcgtctgccagtaaagcaagctgcttgccgcccttgatactgcctccgtttaagcggatatcggaggtaactgttgaagcttccaaagaaagcggtttgcctgcttcgatgtgtgcggtgtctttggcatctattacggcggaactgctgatggtgccgttggataatacggtaacatctgccccggtaatgcgtgtgttattgcctaattcggcgttgcctttgctggaactgtatacggtagtgccagtctgaatactggcctccttgatgacggtacggccgtcggccgacagagtagccgggcctttggcattgttcacattagttttgctctcaatcaccaaattatgaccagcatttaataccgtggtagctgggcgactgccgttattctgcaccacggctccgttacgcaagctgatatcttctcccgtctcaataaccaataagcctttgctctcgatccgaccaccattggagataaatgtgcctgccgctcctttttcggtggtttcgatggagagataagtcggtgaagcttcggtgccgtcggcagtggtggcgatgcggccgctgttttcaatgcggcctgacgaagtcacaatcaattgcttggccgcttcgagtgtgccggcatttttgacgcctacgcctttttcattggcaatcagtgtgatgctgtcggcgtacataccgcccagtgcggcagtatcaagggcaatagtcggtttcgtacccgctgccgtacctgcactgatttcgccgctggcgtaatctactttctgaggaccggtagaaaccgccaggtttttaccctgtaatttcccctgcaaagcaactgcacgagcaagtaccccggtgtagtcggctccgcctttatcattccaacctgctgctcctacggtcaatgtgccttgacgcacatcaaatcctgtcagtgcaccgtctttgccgatttggggcgcaccggtagttaagatgccccgaccgacatttttaaagccgccgccattaacggtaatgccgttggggttggcaataatcacgtcggccttttgaccgcctacggtaacgatgccgttgagtttgctagccgtaccgcgtacctcgttcaaaatcaattgcgcactgcctttgaccacaaacggattattgttacggtcgttgtttaacactgcccctttgttgtcaacatcaaactgcgtatagcggttgtggctcaatccgcgtccattcggagtttggatattcaccaagggggcaccagtgttggttttaaggataacgacctgctggtttttaggtgctgatttgtcggtggtaatttgggcatgggcaggcaataccatactcagggaaaccaaagagcagaccaaagttttaagggtggttttgagtttgccgcaaaggtcgcctgaagttttcagtgaaacagaaaccgaactgcctgcctgtttacctttgccctggctgttggcagtttcggctactgcaaccatggtgctgtgctttttactaaagataatgcgatgtaaacctttattcatgtctattccattttgaagatgaacgtactgcgcgccaagtacgtaggtaaagtttgacggtctgaggataaggaaagaccgtctaaatatcagtaaaaaattcagaggttagaaactgtaattcaagttgaagccgtaaacggtgttggtcgtctgaaagcctttgggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttaataatttccataccaaccgtaatacggcgtataaggctttgaaagatgcctgtaacaacctttttgaacgccaattcagttttatcgaaaaaacaccaaaaggggaaaaggtagtacggacaaggtgggtatctcaagtcgcctatattgaacaacaggcaacggtagagttagtttttgcaccaaatgttgcccctttgattacgatgctagaaaaaaacttcacaagctacgagcttgatcaggtctcatcgttgagcagtaaatacgcggtgcggctctacgaaattattatttcatggcgtgcagccggtaagacaccgatgttcagtacaatggagttgcgcgaacgtttgggtatgatgcctgacgagtatcaaaaaatggagctattcaaacgtaaggttttggatttcgccgtcaagcagatcaatgataaaacggatatttccattacctacgagcagcataaagaaggacgaaaaattgtaggttttacattctcaatcctacataaaatagggtcgaaagacatccctcttgaaaatcaatcggaactttttgccggaatgactgatttggaagccggaacgatacgggtcagggcggaagcatatatcgcttcgctcattgcaaaaggtcagaacgtgactaaagcccataggctgaatattctgaaaaaagccgtagaggaacgttggggatttgaagatgtggctaaagataatggggccaaaaatcctgaaaacaaaaatgcaaaagtcgttttaaacgaatgggaaaagatttctaatggcacacgttttaaggacaaggatggaacaatttgggttaaagattcaggtatgcttaggactgaagggacaaacaggtggatagccgattctcagattgccaaattatttcctatgttaactgtgatggttgaggaaggtatttaacccggcaactcgcgtattctacctgttttgcggtacggaaaccaattgaacctgctttacgctacaatagaagattgcaattttgtcggatgtaccatgaacgattacacagccatgccgtctgaagacggaggaatcggctcattatcgcttccgccgcactcaatggaggcggaacaatccgttttgggcgggttgatgctggaaaatccggcttgggacaggattgccgatgtggtttcgggagaggatttctaccgccacgaacaccgcctgattttccgatccattgccaaactgatcaatgagagccgtcctgccgatgtcatcacggttcaggaagatttgcagcggaacgaagagctggaagcggcggggggattcgaatatctgattacgctggcgcaaaatactccgtctgccgccaacatccggcgccatgccgaaatcgtgcgcgagcgttccattatgcgccaactcgccgaagtgggaacggaaattgcccgcagcgccatacccaaaatatcggcagcggaacgggcggtagcttggagtacgaaaaattcaagcagtttcttttgaactctattgtttaatttacaattggttatctttattttcgtagcctggcataactgttaatctacgtcagcccctaaaaattaatctaatttacgattataaaaatattattaagaaagcccttactatgaaccgcaccctgtacaaagttgtatttaacaaacatcgaaactgcatgatagccgttgctgaaaatgccaaacgcgagggcaaaaacacagccgacacccaagctgtaggtattttgccaaatgatattgcgggctttgcgggttttatccattctatctctgttatctcattctccctttcattactgctcggttctgcccttatcctgacttcttcttctgctactgcccaaggtatcgttgccgacaaatccgcacctgcacagcaacagcctaccatcctgcaaacaggtaacggcataccgcaagtcaatattcaaacccctacttcggcaggggtttctgttaatcaatacgcccagtttgatgtgggtaatcgcggggcgattttaaacaacagtcgcagcaacacccaaacacagctaggcggttggattcaaggcaatccttggttggcaaggggcgaagcacgtgtggttgtaaaccaaatcaacagcagccattcttcacaactgaatggctatattgaagtgggcggacgacgtgcagaagtcgttattgccaatccggcagggattgcagtcaatggtggtggttttatcaatgcttcccgtgccactttgacgacagcccaaccgcaatatcaagcaggagaccttagcggctttaagataaggcaaggcaatgttgtaatcgccggacacggtttggatgcacgtgataccgattacacacgtattctcagttatcattccaaaattgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaatcaagggcaatggtttgcctcagccggcaatgtggcagtgaatgctgagggtaaactggtcaacacgggcatgattgcagcgacgggagaaaatcatgcggtttcacttcatgcccgcaatgttcataatagcggtacggttgcctcacaggatgatgccaatattcacagccagacgctggacaattcaggtacggtcttatcctcaggtcgattgactgttcgtaatttaggccgtctgaaaaaccaaaacaacggtacgatccaggctgcccgcttagatatgtcaacaggtggtttggataacacaggtaatattactcaaacaggttcacaagcattggatttggtatctgccggcaaattcgataacagtggcaagattggtgtaagtgacgttccacagaccggtttgaatcccaatccatcagtcataccacagattccgagtactgcaacaggttcaggcagcagcactgtctcggtatctaagcctggttcaaacaatcccgtttcacctacagcacctgcaaaaaactacgccgtaggacgcattcaaacaacaggagcatttgacaatgcaggatcaattaatgcgggtgggcaaattgacattgccgcccaaaacggtttgggaaattcgggtagtctgaatgcggctaaactacgagtatcaggcgattcatttaacaatacggtaaaaggcaaactccaggcacacgatctggctgttaacactcaaactgctaaaaacagcggtcacttattaactcaaaccggcaagattgataaccgtgaactgcataatgccggagaaattgccgccaacaatctgacactcattcattcgggccgcttgagcaatgataaaaaaggcaatattcgagctgcacatttacagcttgataccgccggtttacataatgcaggtaacattcttgccgatagtggaaccgttaccaccaagaataatcttcgcaatacaggaaaagtttctgttgcacgactgaataccgaaggtcagactctagataatacgcgcggacgtatagaggctgaaacggttaacatccaaagtcagcaactgactaaccaaagcggccatattactgctaccgaacaactgactatcaatagtcgaaatgtagacaaccaaaacggcaaactcctatctgcaaaccaagcacaattagctgtttcagacggcctatacaaccaacatggtgaaattgccaccaaccggcagttgtctattcacgataaaaatcaaaacactttggcgttaaacaatgcggatggcacgattcaatctgccggtaatgtatcgctacaagccaaatcactcgccaacaatggcacattaacagccggtaacaaactggatattgctttgacggacgatttcgtcgtagagcgcgacctcactgcaggcaaacaattaaatctaagcataaaaggccgtctgaaaaatacccataccctacaagcaggccatacgctcaaactcaatgccggcaatatagataaccaagttacaggcaaaattattggtggagaacaaacggacatcacatccgaacagcatgttgacaacaggggcttgatcaacagcgacggtttgacccacatcggtgcaggtcaaaccctgaccaacaccgggacaggcaaaatctatggcaaccatattgccctggacgcgcaaatactgcttaaccgggaagaaacgacggaaggcagtaccaaagcgggggcaatagctgcaaggaaacgtttggatattggagcgaaagagattcataaccaagaaggtgccctactatccagcgaaggtatttttgccgtaggtaatcgactggatgaacaacatcatgcggcaggcatggccgatacctttgttaatggcagtgccggtttggaagtacaaggtgatgcattgatgtccgttcggaatatgcagaatatcaataatcactttaaaacagagacatacttagccaaagcggaaaagcaagtccgcgactacaccgtactggggcaaaatacctactatcaggcgggaaaagacggtttattcgacaactcgcaaggacaaaaagaccaaactactgctacgttccatttaaaaaatggttctcgtattgaggccaaccaatggcatgtccgagactaccacatcgagacttataaagaacgcatcatcgaaaaccggccggcacacattactgtgggcggtgatttgactgcctcaggtcaaaattggctgaacaaagacagccggattgtagtaggcgggcgtattatcactgatgatttaaaccagaaagaaattaccaatcaaagtacaacaggcaaaggtcgcacagatgctgtcggcacacagtgggattcagttacaaaaaaaggatggtacagcggtagaaaaagacaacgccgtactgaaagaaaccatactccttaccatgatacccaactatttacccacgacttcgacacgcctgtatccgtcatccaacagaatgccgcctccccttcctttcaacccgccgcatctgcaatcaaactgattgacggagtatccacggcagccgtcaatggtcagcgcatccataccggtaatgtggtctcgttaaataacgctactgttactctgcctaacagcagcctctataccacccatcctgacaataaaggctggttggttgaaaccgatcctcaatttgcagactaccgccgctggttgggcagcgactacatgttgcaacaactgcaattggacaccaatcatctacacaaacggcttggcgacggctactacgaacaaaaacttgttaatgaacaaatccatcagttaacaggctaccgccgactcgacggctacaggagtgatgaagaacaattcaaagctctgatggacaacggccttactgctgccaaaacattcggtctcaccccaggtatcgccttgagtgcagagcaagttgcccgcttaacttcagatatcgtttggatggaaaatcaaaccgtcaccctgtctgacggttcgactcaaaccgtactggttcctaaagtctatgccctggcgcgcaaaggtgatctcaatacctccggtggcctgattagtgccgaacaagtcttacttaaactgcaaaacggcaacctgactaacagcggtaccattgcggggcgacaggccgtactcatccaggcacggaatattaacagcaacggtaacattcaagccgaccaaatcggcttaaaagctgaaaaaagtatcaatatcgacggcgggcaggtacaagcaggcagactgctgactgcccaagcgcaaaatatcaaccttaacggtacaacccaaacttccggtaatgaacgtaacggcaataccgccatcgatcgtatggccggcattaacgtggtcggaagccatactgaacaagtagataacagaacttcagacggcatcctatccctgcatgccagcaacgatatcaacctcaatgcggccaccgtctctaaccaagttaaagacggcactacccaaattaccgccggcaataatctcaacctcggcaccatccgtaccgaacatcgcgaagcctatggtacattagatgacgagaaccatcgccatgtccgccaaagtaccgaagtcggcagcagtatccgcacgcaaaacggcgcactgcttagagccggtaacgacttaaaaatccgccaaggcgaactggaggccgaagaaggcaaaaccgtccttgccgcaggacgtgatgtcactatcagcgaaggacgccaaataaccgaactggatacctcggtaagcggaaaaagcaaaggcatcctttccagtaccaaaacacacgaccgctaccgcttcagtcatgatgaagcagtcggcagcaacatcggcggcggcaaaatgattgttgcagccgggcaggatatcaatgtacgcggcagcaaccttatttctgataagggcattgttttaaaagcaggacacgacatcgatatttctactgcccataatcgctataccggcaatgaataccacgagagcaaaaaatcaggcgtcatgggtactggcggattgggctttactatcggtaaccggaaaactaccgatgacactgatcgtaccaatattgtccatacaggcagcattataggcagcctgaatggagacaccgttacagttgcaggaaaccgctaccgacaaaccggcagtaccgtctccagccccgaggggcgcaataccgtcacagccaaaagcatagatgtagagttcgcaaacaaccggtatgccactgactacgcccatacccaggaacaaaaaggccttaccgtcgccctcaatgtcccggttgtccaagctgcacaaaacttcatacaagcagcccaaaatgtgggcaaaagtaaaaataaacgcgttaatgccatggctgcagccaatgctgcatggcagagttatcaagcaacccaacaaatgcaacaatttgctccaagcagcagtgcgggacaaggtcaaaacaacaatcaaagccccagtatcagtgtgtccattacctacggcgaacagaaaagtcgtaacgagcaaaaaagacattacaccgaagcggcagcaagtcaaattatcggcaaagggcaaaccacacttgcggcaacaggaagtggggagcagtccaatatcaatattacaggttccgatgtcatcggccatgcaggtactgccctcattgccgacaaccatatcagactccaatctgccaaacaggacggcagcgagcaaagcaaaaacaaaagcagtggttggaatgcaggcgtagccgtcaaaataggcaacggcatcaggtttggaattaccgccggaggaaatatcggtaaaggtaaagagcaagggggaagtactacccaccgccacacccatgtcggcagcacaaccggcaaaactaccatccgaagcggcggggataccaccctcaaaggtgtgcagctcatcggcaaaggcatacaggcagatacgcgcaacctgcatatagaaagtgttcaagatactgaaacctatcagagcaaacagcaaaacggcaatgtccaagttactgtcggttacggattcagtgcaagcggcagttaccgccaaagcaaagtcaaagcagaccatgcctccgtaaccgggcaaagcggtatttatgccggagaagacggctatcaaatcaaagtcagagacaacacagacctcaagggcggtatcatcacgtctagccaaagcgcagaagataagggcaaaaacctttttcagacggccacccttactgccagcgacattcaaaaccacagccgctacgaaggcagaagcttcggcataggcggcagtttcgacctgaacggcggctgggacggcacggttaccgacaaacaaggcaggcctaccgacaggataagcccggcagccggctacggcagcgacggagacagcaaaaacagcaccacccgcagcggcgtcaacacccacaacatacacatcaccgacgaagcgggacaacttgcccgaacaggcaggactgcaaaagaaaccgaagcgcgtatctacaccggcatcgacaccgaaactgcggatcaacactcaggccatctgaaaaacagcttcgacaaagacgcggtcgccaaagagatcaacctgcaaagggaagtaacgaaggagttcggcagaaacgccgcccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggcaggcggactgacgaccggcagcctcggcggcatactggccggcggcggcacttcccttgccgcaccgtatttggacaaagcggcggaaaacctcggtccggcgggcaaagcggcggtcaacgcactgggcggtgcggccatcggctatgcaactggtggtagtggtggtgctgtggtgggtgcgaatgtagattggaacaataggcagctgcatccgaaagaaatggcgttggccgacaaatatgccgaagccctcaagcgcgaagttgaaaaacgcgaaggcagaaaaatcagcagccaagaagcggcaatgagaatccgcaggcagatactgcgttgggtggacaaaggttcccaagacggctataccgaccaaagcgtcatatcccttatcggaatgaaaggcgaagacaaagccttgggttatacttgggactaccgcgactacggcgcaagaaatccgcaaacctacaacgatccgaagctgtttgaggaataccgccgacaggacaaacccgaataccgcaacctgacctggctgcacagcgggacgaaagacaccaaaatcaggcagggagagcggaaaaacgaagagtttgcactgaacgttgccgaaggactgacgagccttgtcaaccccaatccgaggataaaagtcccgattcttgcaggcatccgcaacctgaaaaacatcaagccgacagttaccggcagcgatcccttattggcgggtgcggggaatatccgtatccctgcaaacggcaatgttgcgaagggggacaggattccggatacggcattggctagcaagggaatcaaacataaaaatcgtaaagatcaactggaaaaaaataaaaaatctggtgaggattttgagatggaaatttatcagaagaaagttaaacaaggctttaaaccgcaaagacagattacagttaaaacaaaaagtggtgtaaaaacyaggcttgatattatttcgaaagaaggtggtcttgatgtttgtacagagtgtaaggcttcaataactgcgccacttactaaaaatcagaaaaaagcttttcctgaaattgaaagaacgggagcaacagtggtcggtaagggaaaaccgggctatccaaaggggaccaaaattgaacctactaaagttataattgaaaggaaaagataatgtctattttggaagagaatgtaattgattcagcctctattgaaaacggaatactcatattaactatttctgatcacttaaaatgggataacgagcatttgtttttgttgcaagaaaaaataaattcatatattcaatatattgaatcaggtcaaatttttgaagattttggagaaagtagctatgagactattgaaatacagcttatatataaatataaaccaaatgaaaattatagaaaatttttatatcgcctagaaggtgctttattaaaacttaaattacggttttcccatggaactatctcatatttttatagttgaaaagtaaatactctctttatcacttcgagcccaggcaagccataacttatataaaccctgaaatcaaaagaagcaactcgtaacacgcggcgtcatatcctttaagtcatacttatactgaaatatataagcctgaggaatttacgctatggttaagaaagtaaatatattgaatattgcagaaaattttttatgagagtgaaaaataaaatttagatatagtcgttatctgtctgccgatggaacaaaatggataagacatggtttgttctatgcatcttacgaaaatggtaatattgtttaggcaaaaaaattatggcaattttttattttagttcaaaaaaaatagaaagaaatattatctcatcaaatctgaatcgaaaacaagttcgtgcaatatttagttctgatgtacaagaaatttataagtcatcatactctcgggttcctatggatgtttttcccgaattgaatatccattgtttttatgatgataaaaatcagcttgaagcgatagagatatttgaaccaaataagttttttttagaagatatttcttttaattggcttggaaaaattaatgatgaaataataagctatctttataagagtggaattaatgattttgaaattgatgatttgggtattaggcttcttaatattcctgtttcaactataatcaattcaataggtaaagtagaatgttgttatttagatttttcaaatagagacacgaaattttatgtaaaacaagtgtaggtttgaggtcaagacccaatctacgcttactccggtatcagcgtctccatcatctacgacgaacaaaaaatccgccatctgaccaagtaaacgcctaccttgccgaaaaccaaagccgcggccacacctggaaaaaagacggcatagcaagccgtagctcatgtgaaacctaaactcaatacgtaggatgtgcggaacgcacatatgtagttttcaaggtttgagccaggaggctgtctgaaacaacaaatacgtttcagacagcctttctttcaacaagccaccacagcaatcagacaaaagcaacccaccgccacacccatgtcggcagcacaaccggtaaaactaccattcgaagcggcggggataccaccctcaaaggtgcgcagctcatcggcaaaggcatacaggcagatacgcgcaacctgcatatagaaagtgttcaagatactgaaacctatcaaagcaaacaacaaaacgccagtgcacaagtgaccgtaggttatggcttcagtgccagtggcgattacagccaaagcaaaatccgagccgaccatgcttcggtaaccgagcaaagcggtatttatgccggagaagacggctatcaaatcaaagtcagagacaacacagacctcaagggcggtatcatcacgtctagccaaagcgcagaagataagggcaaaaacctttttcagacggccaccctcacccatagcgacattcaaaaccacagccgctacgaaggcaaaagcttcggcataggcggcagtttcgacctgaacggcggctgggacggcacggttaccgacaaacaaggcagacctaccgacaggataagcctggcagccggctacggcagcgacagcgacagtcaaagcagcatcacgaaaagcggcatcaacacccgcaacatacacatcaccgacgaagcgggacaacttgcccgaacaggcaggactgcaaaagaaaccgaagcgcgtatctacaccggcatcgacaccgaaactgcggatcaacactcaggccgtctgaaaaacagcttcgacaaagacgcggtcgccaaagagatcaacctgcaaagggaagtaacgaaggagttcggcagaaacgccacccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggggcggcaatcggctatgcggcgggcgggaatgtcggtacggcggcagtaggggcgaatgtcgattggaacaataggcagctgcatccgaaagaaacacaaatccttaacaaactgtcaaaaggcaaatcggctgaagaacagtaccgcctaaaagccgctgcatgtgcattaacccggtgcgcggaaggcgtacctgacttcgaccctctttataaaggactaaaaaacctccaagatgccggtaaacagtttgtagcggaacaaaacgtattgatgcggacggatgcatttaaatatggaacatggaacagcctgaatgatatacgcagcagttacgaccgtgctgccaccaaaattaagggtgcgggcaatatgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataaatgactttcaatcaagaacaagattattgggctggctataaggcaaatgaaagagccttgattattcaaacatggtcaggatttgggcgatatgctccagaccacctatatcccccccatatcctgccattggataccgacaatgaaactttaggcacaacggtcttgcaagcattggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtagatatttggctgcacaacggctgcctgaaaatcagcccgagccgccatgtcaagctggaagcgtgggatgccattgatgcagacgatgtaattttatcattggataacagccctgaagaaatcggagcaggtttaaagttggcattgagccgctgccgataatattacaaaaggtcgtctgaaagccggaaacttttttcattagataataaattaagcacgcatgcggttctcaaggtctaagccaagaggccgtctaaaaacagaaaaaccgtttcagacggccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagacttttttcaacggcgaat

SEQ ID NO: 37785 - DNA, 16526 bp, Neisseria meningitidis
tgttaactgtttaatcctaacgtcaaatatgccgtctgaaaagccgaagccgcgcacaaasgcaaaaacggcacggataaaccgtgccgcagcaaccggggcgtgttcagactttgcggtagggattttccaaaccttcaatcagcgcgagcaggtaatcgcgcaactgacgttcgccgcaacccatcagcagcgcgtcttcaaacgcgtcttgtgccgtctgatacagctcggccatattttcggacatcactttgaccttttcggtacaggacacgatctgtccgtcatcgtcgtaccatttgggcatttcgggcatactcattgcgtattccttgggaaatcagttcagaaagcgggacgggtcgtttttcttgacccggcgggcgaacgcgtatttgccgctccaatatttgtggctcaggctggtgatttcgatatttttccccgtgcgcggcgcgtggatgaagcggttgttgccgatataaagtccgacatgggaaatgcggctgccgccgagcgtgcggaaaaacaccatatctccgggctgcaattcgcttcgggcaaccggcgtacccatccgtgcctgttctgccgacgtgcgcggcaggttgatgcccatggcgcgtttgaagatgtgctgcatgaagccgctgcagtcaaaaccggtagaaaccgatgtgccgccgtagcggtaggcaatacccaaaagtcccatcgcgttgccgatgagttcgtcggcattgcccgcccgccgggcgggggctcggttgacgggtaaaacgggctgttcgttaagccccatcgcgttgccgatgagttcgtcggcattgcccgcccgccgggcggggactcggttgacgggtaaaacgggctgttcgttaagccccatcgcgctgccgatgagttcgtcggcattgcccgcccgccgggcgggggctcggttgatgggtaaaacgggctgttcgtcttcggcaaactgtctgagaatctgctcgcggctgctgagcargttggtcaactcgtcggcaagggcggggcggacggcaaacatcagccacaaaaccgcccaaactgccggtttgaaaaaagaatccatatcggtgtttccgcgcaggaggcatcgtgccgccgtgcgatgttatgctgtatcagtcgaaaatatcttgttgattgtatataaaaaaacggctgtttggcaaaaaacggcttgttagattgagttaatatgttgatttttatataatttattgataatttgggaagcgcatccgccgtccgtcttgttttcgcgccgaccgcaaccatatagccgccatccgaacaatcagtcagagaaaatcatgaatcaaaccgccatcaaccgcgccgatgtgcgtacccgctttatcttcgacgatatgcccgtgcgcgggctgcacgtccgtctggaaaacgtgtggcagcacattgtaaaacagaaaaactatcccgccgccatccgccgcgctttgggtgagttgttggcggcgggtgtgttgctgtcgggcaacctcaaaaacgaaggcacgctgattgtgcaggttcaggggcgggggcggctgaaaatgctggttgcggaagcggcttccgaccgtaccgtccgtgcaaccgcgcgttgggacgaaaccgcagaaatagccgatgacgaaagcctcggcgaccttttgggcgagggcggcgtattcgtgctgacgctgcagcccaaagacggcgaaccctggcagggcgtagtgcctttggaaggcggcggtatcgcgcaaatgttggtgaactatatgaaacgttccgaacagcttgatacgcacatcgtcctgtctgcaagcgacgaagcggcgggcggtctgctggtgcagcgtctgcctgaagaggtattggatgaagaggcatgggaacacgtcagtacgctggcgcgcacgctgacggcggaggagctggcaggactggacgcgcaacacgttttataccgcctgttccacgaaacgccgccgcgcgtgttcgagccggaaacgtttgaattttcatgcacctgttcgcgcggcaaagtcagcgatatgctgttgatgctgggcggggaagaagtcggcggcgtggtggtggaacaaggcagcatcgaagtcgattgcgatttctgccacagcaaatatgtgtttgacgaaaccgatgtcaacgcgctgttcggggaggatgtggtcggcgttgccaaagggctgccccggcataccgtccaataatcttgtgcaacaaggataaatagtcaaatgccgtctgaagcagcttccgcttcagacggcatttttgcgcgggttcagacggcatttaaagcaggaatagggtggcgagccccaagaaaatcaggaagccgccggagtcggtaacggcggtaatcagcaccgagctgcccagtgcgggatcgcgtccgaacttttccattaccacgggaattaatacgccgacggttgccgccagcaggaggttgagcgtcatcgcggcaatcataaccagcccgatgccgaggctgccgtaaagcagccaagatactgcgcccatgaccgttccccaaatgatgccgttgaccaaggcgacaccgacttcttttttcagcaaacgccccgcctgcatatccgtcagctgccccatcgccatcgcgcggacaatcatggtaatcgtctggttgcccgagttaccgcctatgccggcgacgatgggcatcagcgcggcgagtgcgacgattttttcgatgctgccttcaaacgcgccgataacacggctggcgaggaaggcggtgcagaggttgacggcgagccacatccagcggtttttcaccgaatcccacacgggggcgaacaggtcttcctcttcctgcaaacccgccatattcagcatatccgcttccgattcttcgcggatcacgtccaccatctcgtcgatggtaatcctgccgatgagctttttgttttcatcgacgacgggcgcggtaaccaagtcgtagcgttcaaacgcctgcgccgcttcttccacgtcatcttcggcgcggaaacgcacgacatctttcgccatcacgttttccaccaagtcttcgggatcggcgaccaaaagtttgcggatgggcagcacgccctgcagtacgtcgttttcatcgaccacaaaaatcttgtcggtatggtcgggcaggctgtcgaagcggcgcagatagcgcagcaccacttcacaggcgacatcggcgcggatgctgaccaactcgaagtccataatcgcaccgacttggttgtcttcgtaggacattgccgctttgacttgggcgcgttcttcctcatcgcgggtttgtagcgcttcgtaaaccacttggtgcggcaaatcgtctgccagttccgccaattcgtccgcgtccaaatcatcgaccgctgccaacaattcgtctttgtccatcgactcgatcagcgtttcgcgcaccgcgtcggatacttccagcaatacttcgccgtcgtcttccggtttgaccagaatccagacgatattgcgttcgcgcggcggtagcgattccaataccgccgccacgtcggcagggtgcagctcgctcaagaggacggtcagctcggtcagcttgtcgcgcagcggcgcgtcttcgagcggtgtaccgttttcgatttgttcaaaagcaggttcgaggatttcgcagagggagtggacacggtcgaaatcggcggaaacgcgttctacatcgttttcgataccgtcgttttcaaggttcggaggggttggttcgatgctcataaatgctccgcccgccgtgtgcggggaggcattccggcgggatggttattgcgggtttgaatcggatggggtgttcagtaaaaacgaactgggaaggtccataataaaagcctgacggtacaggcgcagggttggaaacggcactattctactcccttttggaacggtttactatttttaacgcaaatgccgtctgaaacgcgggttccagacggcatttttatcggcttgttaccagttgtagcctattttgattcctgcctgtttgtggcgggcggtgttgctgtctttgccgtaagcggcatgaagtttggcgttccagcctttgtatccggcgtcgatttgcagggtatgcagtgtgccgtgggcggcttgctgcagtaaggtacggtcgttgacgctgagggcggaaccgctgttttggcgggtatggtagtaatcgctgctgaaggcgggggtcagcttggcttgacccagttcgacggttttatcgagacggatgccggcatgccatgtggtttggatttgcgccgggctgtttatctctgcgccgtcgagtacgtaccggttgccgttgctgcggtttatacggatgccggcatagggtctgaggttgatgccggtatcgattttgatgccggtgttgatgcctgcatcccatgcgtggcggcggacggcagccccgtcataatcggtaaatcgggtacggctgttgctgtagcctaaatctgccgcggcaaagagtgcgccgttttcccctttgacgaacagatgtgcgccgttgctgcggtttcgggcggatacgccttcatcaaaacggttgtttgtgcgctcatcggttaaaatcgtaccgacactgagacggtcggtgatgccggtttggatgccgatatgtgcatagttggtagtttgttggtagggacggtgtgtgccgctatggtagtcggtttgttgcgtaccggtttccagccagatgttttgctgctgcggatcggtaaggtggcggtcgatgcggcgtcccgcctgttgccggccggtattgtaggcggcctgttcggaaacggcggtgttggccgaccggctgatcagttcggccaggttcggcatacggatgccggcaacgccggttttcaaactgtggatttgtcgggacagacggttgagtgcgttcaggtaggcgtgccgggctgtttcgacggcttgcgcatcgccgccttgccgtgctttgtcaagttcggattcggccatttctacacgttctatatacgtatccagttcggtttcgaagagtgtcaggtcgttcgtgtcggcggctttggcaacctgacggcagatatcggcactgtatccttgtgcggcacacaggttttgggcacgcgtcagaatgccggtcagcgggtctgtctgtttcaattgggcggacagatattggacttggctgtcgatgcgggcaagttcggtttgactgttctgccaggcctgtagtgcctgcctggtcgcgtcagagtcatgttgaacctgtctgctgatgtcggttgcctgtaattggttgtatgcctgttggttgcgctcatgttccgcacgcgtggcttcaatttgaagttcggcctctttgagcgggttgtacaggctgtatccgttgttgtttttgcggaggatgtagcggtaggcacccaaatcggcatagccgttttggagggtgaatcgggcttggtggctgtgtttcggattgaggctcacaagtgcaagcgattcggttgtttgaggttcttgtccggtgtttttgacgtggatttggaatgcgccgcggctgtccccttccagtttgagggggggggcattttgttttcggacgatgccggtcaggaatcggaatgtgccgaacccgtcaagtgtgccgttgacggtcagtgtgttgaagcggttgttgtgtgtattattggcgaaatcggggttcagggtaatttgtgcgccgtcaagcgtcagtgcgccggtgtggctggactgggaaagtgtccagttgctgtctgcttccatgcggactgcggtgtctttgccggcacggatgctgccgtacaggtgtgctttgcccaggcggagctctgaacggtcgttaagggtaatgtcgccgcgtacttgcgttgcaggtagtgcacgatagttttcggcttttaaaacggcgttgggtgtgcagtgggtgctgccgctatggtaggagcggtagcattccggtgttttgccttgggtaaagccgaggtcgatgccggacagatcgtatgcggttatgtcgccgtccagatgcgcggtattgcgccctgccgtcagtcgggcatggtttcgcagggtgaaccgtgcagccttgaagctgccgtcggtccattcgttttcaagaacgggttcgcgtttggcctggtggtcgtaggcatggggtacgggcctgcctgacacaatcatattgccgccctcaatcaagacttccccgttaaggttcatgccgccgttgagcaacagcgtgctgtcggtgcgtttgggacgatagtgcaggttgagtgcgccgttgtaacggtattcgggccggccgtatacggcggcatttgcgatatggcgggttttttctatggctgcttcattggttttgctgtaactcggcgcggctttgcccgtttgcgcgttttcacccaagtatccgccgaaggtaatcaggtcggggcgggcattttcggcttgggcgacttgttcggcggcctgttgcctgttgttgccgataaattgccagcttgttgagtttttcatatttaacgggaaaaattcgcgcgggttgccgccgggtttgagtatgaagtagtcggtccgacggttgcggtgcgggttgatgtattcgtaaaccgccgcgttgccttgcggacggttgccccattgcacccactcgacatgctcgggactgaggacggggttgccggtcagcgtcagtgtcgcggcttggtcagggttgtgattgacgatttgcgcgccgccgtccgcatggcggatatgggtaaaggcaaggttgttgccgttgaggtcgagccgtccgcccctgaagccgaaatagaggttttcgggtttgatttgctggctgtcggcgaggacggccgtgcccctgccgctggtgatgccgacttggttgaatgcttgtttgctgccgtctgaagcagctttttgggcgagtacgacagtgccttccccgatgctgatgtcgccctggttgatgccttgtccgttggcgataagcgtgcctgcgcccagtttggagagccggtcgcctttggggttgctgacttgccagaagacgcgtttgccgtcggctacgataacgcctgcaccttgccatgtgtggtttttaccgacgacggtgaagttgctgtcgaactgcaatgcgcctgcgccttggttgatattgtctgccagcatcagtgttttgttgtcgaacctgctggataggatgagcgttttgccggcatcttcagacggcatgtgcctgctgtcgttttgtggggcaagcgaagggtttgcaatgggcagggtgatgcgttcgttgagcccttgcagggtgctgttgccattaccgttgtcgcgccatatgagttcgttggtggtcagcccgacatccagccgggtttcgtattggcggatggtggaacggatgaattcgggttgcgtgacgatgtatttgttgaagaaattatcgaagccggcgtaggtgctgagtacgcccgcaagcacccagcggttttcatgcttgtcgaaggcaaacaggggggaaccgctgtctccggcgattgcgtaggtgttaaggggttggtcggtcaggctgccgccgacgagtaagccgtggttttggaaccccaatactttcagcggcgtgccgccggtcaggtattggtatgccggggcggttcgtgtacgcgtgccgtctgctttgcggacttgttgcgtgcctgagccgagtcgtacaaagtaggggaagcggtcggtatcgaggtaggcattggcctttggctggccgtttccaagcaagggtacgctgctgagtgcggtaggtgagatttcggtaaccagtttgttgaggcggggaaggtggtagtcgtagtccgggtgcgggttgcgtgatacgaggcggtaggtataggcttgttcttctggattttgggtgtcgttgccgaattgtatggaaccgtagccgacgttgtgtttgacactgttgacgtattgggggtgaaccagggtggcgatggcggtttggcggttgctgacgcggaagtcgggcatggggatgccgttgagaaccctgcctaatattttgccttgcttgtcttggatggaaatattgcttgcacctacggtgaacgcgcctttattttcggcaaagtcgcgaaaatattggtaatcgacatcgttgcggacaatggatgagtaagcaggggaaacggcaaaaagaccgagggtggacaatacggaacaaaatggggtggtgtgtgtgaagcgcatgatgattatccgtgtaatagagaaaatcaacgattcttgcggacaagaatcaccgatcccgttttgtgctggatttatatagtggattaacaatatagtggattaacaaaaaccagtacagcgttgcctcgccttgccgtactatctgcggcttcgtcgccttgtcctgatttaaattcaatccactatattatatattttgtttttgtttgattataaggcaacggtgtcctttcgtctattggcgatgattgtatgattttatttaagattttaataaaaatcctaggaatggctgcgttttcccgttgttttatttcgtccggtattggtttttaagttcacgcagcgcgacaaaggtatcgaggctgctgtttaacgttttcccgctcaatgcctcggcgcggtctctgacgtgcggcaggtcgacgcgcaaaaacggattgacgcggcgttcgtgcgcgagggtaacgggcagggtaggcgtatgcgccgccgctttcagtgccgtctgaatgtcggcgttgtccggctcgatatgggcggcgaaacgcaggttggcggcggtgtattcgtgcgccggatagaacagggtgttttcaggcaggcggttgaagcgttggaagctgtcgtaaagctgttcgattgtgccggtaaacacgcgtccgcagccggcggaaaaaagggtgtcgccgcaaaagacgtgtatgccgtctgaagtttcgagaaggtagctggtgtggcggtctgtgtggccgggtgttgcccaaacggtaacctgtccgtcgccgaaggtgaattgggtgccggcggttacggtgtgggttgctgcttcgatgtcggattcgccgtaaacgggcgattccatgtagccgcgccagagtgccgccgcaccgccctcgtggtcgggatgggggtgagttacccatgtttgggcaagcatgaggcggttgcggacgaggaattccaagacgggcgagggttcggaagggtcgacgcagacggcatggttgccgtgctgtatcatccagatgtagttgtcggttagggctttgacgggggtgattttcatgagtgttcctcggtggacggataccgtttaaaggatggtatgccggaacgccgtctgaaatattcttcagacggcattggtttgagtagggcggttagcccaaggctttacgtgcgccggcaaagaggcggtaccagccggacagttccgtccagccttccggtttccagctcatttgcgcggcacggtacacgcgttcggggtggggcatcatgatggtgatgcggccgtcggcgttagtaacgccggcgatgccttgaggcgagccgttggggttgagcggataagtttgggtcacttggttttgtccgtcgatgtattgcagcgcaatgcccaaatcggcggaaatattgccgccgtgaagcgcgaagtcggcgcggccttcgccgtggctgaccacgacaggcaggctggagccttgcatttcgttcagaatcagcgacgctgatttcggaacgtgaaccatgctcaggcgtgcttcaaactgttcgctcaggttgcgtttgaacttcggccagcctgccgtgccggggatgatttcggcaaggttgctgaccatttggcagccgttgcacacgcccaatgtcagcgtgtccgggtcggcgaagaaggcggcaaactggtcgcgcagagcagggtggaacagaatcgatttcgcccagccttcgcccgcgccgagtacgtcgccgtagctgaagccgccgcacgccgccagcattttgaagtcggcgaggtggatgcggcctgccatcaggtcggacatatgcacgtcgtaagcatcgaatccggcgcgggtaaaggcggcggccatttcgatttgcccgtttacgccctgttcgcgcaggatggcgattttgggtttcgcgccgctgttgataaacggcgcggcgatgtcttcgttcacgtcgaacttcacgtcggcaaacaatgcgctgcgttcgttgtcgccaatcagtgcgaactcgctgtcggcgcaggcagggttgtcgcgcaggcgttggatttgatggctggtttcttgccaggtttgttgcagtttgattaggttgtcagaaataaggtgcgtttgcccgtcgcggatgattaacgtgttctcatcagttaacgtaccgatttcaaagacattatgatgcagctgttgttgatagaataaattgataatatcggcaacatcttgttttctaacttggataacagcacccaactcttcattaaataatgtgcgggcaatggtttcttgccattcagccaacgcttttacctcttcagtccgcaatgattgagacagagcggtatggttggtaataaatgtttgtgcaagcaataaatttaaatctatatccaagccgcaccgccccgcaaacgccatttctaccaaaacggcaaacaagccgccgtcgctgcggtcgtgatacgccaagagtttgttttcggcaacaagctgctgaatcacactgtaaaaggctttcagacgacctgtatcgtccaaatcgggcgcgtcgccgctcatattgttgtacacctgaccaaacgccgaaccgcccatacgcgctttgccgaagcccaaatcgacaaacaacaatacgctgtcttcgacgtttttcaactcaggcgtaacagtcttgcgtacgtctttcacaggcgcgaacgctgagataatcaggctcaacggtgaaaccacggattttttctcctcgccgtcctgccaaacggttttcatcgacaggctgtctttgcccacggggatgctcaaatccaatgcctgacaggctttggaaacggcttcgacagtgcggtagagtttttcgtcttcgccttcgttgccgcacgccgccatccagttggcggagagtttgatgttgccgatgtctccgatgttgaccgccgcgatgttggtgatggcttcgccgacgcacattctgcccgaagcaggcgcatcaaacagggcgacggtcggtttttcgcccatagacatcgcttcaccgcgataggtgttgaagcccatcatggtaacggcgcagtcggctactggagtttgatatttgccgaccatttggtcgcggtgcgtcaaaccgccgacgctgcggtcgccgatggtaatcaggaagtttttggcggctacggcaggcaggcgcaaaacgcggtaggcggcttcggtaatgtcgatatcgcccgcgtgaaacggttttttggacggtgcaaccgttttgtcggtgcgcgtggttttgggcagtttgccgagcaagacgttcaacggcaaatcgacgggattgttggcgaacaaatcgtcgcgtactttcaaatgaccgtcgtcagtcgccgtgccgactacggcaaacgggcagcgttcgcgttcgcagatggcgcggaaagcatccaaatctttttccaaaatcgacaacacataacgctcttgcgattcgttgcaccagatttgcagcgggttgaggccgtgttcttcaagcggcacttcgcgcagcttgaatactgcgccgcgtctggcatcgttgaccagttcggggaaggcgttggacaggccgcccgcgcctacgtcgtggatggagataatcgggtttttgccgccgagctgccagcagcggtcgatgacttcctgcgcgcggcgttcgatttcggggttgccgcgttgcacggagttgaagtccaaagacgcgtcgtttgtgccggtatccatcgaagaagccgcgccgccgcccaagccgataagcatacccgggccgcccagttggatcagcaatgcgccttcggggatttcgtctttatgcgtctgctgcgcctgaatgctgcccaagccgccggcaatcataatcggtttgtgatagccgcgaacctgaccgtcaaatttttcttcaaaagtgcggaagtagcccaagaggttggggcggccgaattcgttgttgaacgccgcgccgccgatcgggccttcaatcatgatgtccagcggcgaggaaatatgttccggcttgccgtagtcttgttcccacggctgtttgaggtcgggaatattgaggttggacacggtaaagccggtcaggcccgctttcggacgcgaacctttgcccgtcgcgccttcgtcgcggatttcgccgcccgcgcccgtcgccgcacccgcaaacggcgcgatggcggtcgggtggttgtgcgtttccactttcatgatgatatgcgtgtcttcctcgtggaaacggtagccttggttttccgccgcattcggatagaaacgctcgattttcgcgccttcgattacggacgaattgtctttataggcaacgaccgtgccttcgggatgcgcgttgtgtgtgtcgcgtatcataccgaagagggatttgggctgcttttcgccgttgaggatgaaatcggcgttgaagattttgtggcggcagtgttcgctgtttgcctgcgcgaacatcatcaattcaacatcggacggattgcgctgcaaagcctgatagttttcgaccagataatcgatttcgtcggcggaaagtgccaagcccatttcggtattggctttgaccaaagcttctttaccgccgcccaaaacatcgacgccggagaaagtttcggattcgagatggtggaataatttggaggccgtctgaaaatcgggcagcacgctttcggtcatgcggtcgtgcagcaaagccgcccattgctgtttctgttcatcgttcagacgaccttccagccacaccgccataccgcgctcgatgcgttcgatgcctgccaaaccgcagttttccgcgatattggtcgccttggaagcccacggcgaaatcgtacccaaacggggcgtgaccaaaaacaaatgcaagccctcgcgcgcttttggcgtttgttcaacgctttgcgccgccaacaaggcttgcagtttttcgacagtcgcggcatcaagtgctttctcgctgccgacgaaataccaaaattcgctgcttaatttgacttcgggcagaccgagtgcggcggctttttgcaagagtttttcaacacggaaatcggaaagggcggtaacgccgcgcaagggcaaaacgacagacatggattcggctctcaaatgcggttggaaaatctgtcattatacgcgcaacggggctgtattgcttgggtattttggcttaaaatgttgacaatctgacgggaggttcccgtttttcggatgtgtttgtattgtttgttcaaaggaaattttatgaaaaaaatcgaggcgattgtcaaaccgttcaaactcgacgacgtgcgcgaggcgttgacggaaatcggcattacgggcatgaccgtcagcgaggtcaaagggttcggcaggcagaaggggcatacggaaatctatcgcggcgcggaatacgccgtcgatttcctgcccaaaatcaaaatcgagctggtgttggcggatgatgctgtggaacgcgcgattgacgtgatttcgaggtggcgcgttcgggaaaaatcggcgacggcaagatttttgtgctgccggttgaggaggcaatccgtatccgcacgggcgaacgttcggacgcggcagtctgacggccggatagaaaataaaaaccgcagccttgcagggctgcggtttctttatcgggagatgctgcttaccactcgtaattgacgccgacatggtaggctgcggaagaaccggacgaagtgccgactgccacgcctgctttggcggcaaagttttcggtaaagcggaagccggtaccgatggcgactgccgattcggatttgtagccgccgactgcagccgttacattgaaccgacccacgttgtaaggttggaacaggccggagagcgcggcttgttctgcaaggccttggcgggtttctttgcgcagattagctacgtttttgtccaagctgtcgatgcgtgctgagtttttagcaatatcagctttgttcgtagcgatatcagctttgatgtcggtaacttttgcagcgacagcttcggccttgtcggctgcagtattagctgtgccagcggcagcttcggctttgcctgctgcagtttctgcagcttttactttggcatcgacgttttgtttggtttcttcggccgtctgtttggcttcattggcggttttgacggcttcgtctgccttagtgttggtttcatccaatgaatcggcgatatcgttgaatgcttcggcatgcttgtcgacggtatcagccacggcttctaatttttcatcaatttttacgatatttgtcttagtctcttcagcaaatgtcgttatattttctcccaatttattcaaggcgttggtggtttcatccagagcggcatcagtatctgctaaagcggcatcagtgtctgctaacttggttgttaacttttctatttcagattctgcagcttttactttggcatcgacgttttgtttgttttcattgacggttttggtcaggttagtcacgacttttttcagacccagacctttaaagtcgtcggcttcaacatcggctgcagttgcgtctttttgggtaattgtgccgtcttcaccaatgtcgtagatggtctctccagctttgaaaccgttgatttcttggccattgttgtaggcagcaacaatggccacagtggcagcttttttaacatcgtcgtcgcttgtggctgccagtgcgccgctacagaaagtggcaaggatggctgtggtcagtactttggctggaaagtgtttcatgctcattacctttgtgagtggataaaaaatggggcggaaatcttttgtaagtattttatccccaccaagtttgtttacatattaaagtatatatgaaaggaggcatatatacaatacattgtcgcaatttatttatttatttatttatttatttatttatttaattcttgcagttaggtagttcggcattaatatctgttaatatgtgcatattatgctgatgtcaattctgccggtgtcgtgtcttaattttgtcaggatatgggttgccgtctgaatgttcagacggcctttttgtcggatttagatatggtggataaccaattttttgccttcgtaatcgaggacgtcgacgtccatatcgaatagggttttgatgtttgcggcggtgaaaatatcgttgggtttgccctgcatggcgacttggccgtttttcatggcgacgacgtggtcggcgtaggctgctgcctggttgatgtcgtgcaatacgacgacggtggtgcgcttgtgttcgtcggtcagccggcgcaggatttgcatgagcgagcgggcgtgatacatatcgaggttgttcagcggttcgtccaaaaggacgtagtcggtgctttggcagaacaccatcgcaatcatggcgcgttggcgttggccgccggaaagctcggtcaggtagcggtcggagaggtcttgcaggtggaattcttcgattgcaccgttaacgatacggcggcattcggcagtcggtctgccttgatggtaggggtaacggccgaacatcagcaggtcgcgcacggtgatgcggctcatgatgctgttttcttgggtgaggatggacagggttttggcgagttcggcggtgggggtatcggcaagatttttgcctcggtaggcgatgctgccgctttcaagcggtcgcagccgcgccataaaggaaaacagggtggatttgcccgcaccgttggggccgacgagggcggtaatgccgccttcggggatgtcgaggctgacgttgtcgaggatggggcgtgtgccgatgcggtagctgacgttgcggatggtaatcatggcggatgcttgtcgggcgtaggtttgttgttgtttggcggggttcagacggcatttgaaattcggaatgccgtctgaacgctcacacttcgcggacgatgacgaactgcgggtcgtccgccgattcggttaaaaatgctttaacgcgtgcctgccagagttgtccgaagcgttcgagttcttctgcgcttgcgctgccgctgacggctttgggcatgatgtcgcgcatttcgggtgcgaagggttgcagggcggcgttgaggccgacggcgacggttttgccgttgtctttgcggcgcggtgctaatggcacagggaaaacaagattagctgtttatattgaagaacaattaaaggaaaaagcacacagaatt

SEQ ID NO: 37786 - DNA, 92934 bp, Neisseria meningitidis
acatatttagccaaaaccttattcagcagcatagtcatacwccacgaccagcggtcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcccggcacatcgggataaagcgtgcgccacatatccgtccaaccgagcttgtggataaccttgcctatccactcgcgctcttcaggcaggaaacctgaatttttctggttgcctttccagtttttcaggtcgatgttttggtgggcgatgttccagtcgccgcagacgacaatgtcgcgcccttcgtttttcatcgcttcgagcatagggtaaaacgcatcaaggaaacggtatttcacctgctggcgttcttccgcgctgctgccgctgggcaaataaagcgagataacgctcaacctgccgaaatcgcaacgcacaaaccgcccttccctgtcgaattcttcaatgcccataccgatttgcacattgtcgggtttgcgtttgctgtacaccgccacgccgctgtaaccgcgcttctcggcgcaatgccaatgaccgtgcatcccgtgcggatttttcatatcggcagacaaatcagcctcctgcgctttgagttcctgcacgcagacaatgtccgcgcccgatgcggcgatgtattcgtaaaaaccttttttgtaggcggagcggatgccgttgacgttggcggaaatgattttaagcataataaaaataagttctcacaataaaaatgccgtctgaacaaaaaagggcaaaatgcggcacatttacccttttcgatggattttaaccgcgccgccaagtcgtgccgccggcgttgtcttccaaaatgattttgtgttcgttcagaaggtcgcggatgcggtcggattccgcccagtttttatcggcgcgcgcctgtttccgccgggcgatcaagtcttcgatttcttcgttggagagaccgtctgaagccgcgccgccttgcaggaactcggtcggatcgcgttgcagcagtccgatgatgccgcccaaggctttcagacggcctgccagttgcgcgtcattggttttgttcacttcgccggcaagttcgaacaacaccgccaccgctttcaccgtatcaaaatcatcattcatcgcaacataaaagcggcgcgtgtagtcatcgccggcttcagacggcatcggatcggcgggcggcgtatttttcaaagtcgtatacaaacgcgtcaacgcgccttttgcatcatccaaatgcgcgtcggaatagttcaacgggctgcggtagtgggcgcgcaggatgaagaagcgcacgacttccggatcgtattgtttcaacacttcgcggatggtgaagaagttgcccagcgatttggacatcttttcgccgtccacgcggataaagccgttgtgcagccagtatttgacgtggctggcgatgctttgcccgtggtgggtttgcgcgtgatgatgaccgcaggtatgccccgtcgcgccgacgctttgggcaatttcgttttcgtggtgcggaaactgcaaatccgcgccgccgccgtggatgtcgaaggtatcgccgaacaggttttcactcatggcagagcattcaatgtgccaacccggacggccgttgccccacgggctttcccacgccggttcgcctgctttggcggctttccacaacacaaaatcaagcggatcgcgtttgaaaccgtccacttccacgcgttcgcccgcacgcaggtcgtccaacgatttgcccgacaattgtccgtaagcggcaaactcgcgcacggcgtagtaaacgtcgccatttgcggcaggatatgccttgccgttttgaatcagggtttcaatcatggcaatcatttgcggaatgttttccgttgccttcggctcaatatccggacgcaacacgcccaaagcatcggcatcttcgtgcatggcttggatgaaacgcgcagtcagtttgccgatggtctcgccgttttcagccgcgcgggcaatgattttatcgtcgatgtcggtgatgttgcgtacataagtgagcggatagccgcactcgcgcaaccaacgggcaatcatgtcgaacaccaccatcacgcgggcgtgtcccaaatggcagtaatcgtaaacggtcataccgcagacgtacatacgcacgttttcagggtcgatgggggaaaagggttctttttgacgggttagggtgttgtagatggtggtcatgggattatggattaatctttgttgctcggatgataatttctgttctgttcctgtagatacggaccaaggaacattacgtagttgcggattattaatatggctgatatttgtgaaaattggttctgcataacagtttgcaaaattttttgtaaattctgataatttaaacttatcttttaataagtttgctaaatctgatgacgagggataaagtttacttcttatactaggcatttcaatatgaaggactatttttatttcgttacaatctaaagccaagcgagaaaaatctttttcttcctgtttttctgctttaaatttagcagaaaccaatcctgccaatgaatctcgaatttttcttgcgattaaatatggtaggtcagaaagtttttcatctattgattgggcatttggctcaagcccaagtcggtaataatctttaatttcgattagccaaagtgtcgattcatgaagggctattatatctacacctgagctgccattatcgtcatctacactttgatttatcccgttctttcccttttcatttgtatcaattttattacgtaaattacaactgttctgaaaaattttataatgttcccattcgtcatacttggtaacgtaataatcttcaggaaaagcaaaggttaatctcttttctgtgattgtagtcatagcttaacctcaaatattcagatacctgtctgcctgcataatgttttcatctaacaatatcaatgtgttcaaatcattaatactgttcccttgctccacttttgttccatcatcggaagcaatcaacgagaaaaaacgtacaggtaaatccgtgttattttcaagcttcaaaagttccaattctctcaataagaataaagagtgtgttgcaataaaaacctgaataccctgttgagataaagaccaaataatacgggcagccactttgatcaatttaggattcagattagcttccggttcatcccaaaatagatagcctttatccagcaatgcccctgttgcgattaaccgggcaatcatgacaaatttccgcaaaccctctgctaccaaaggtgcttcaatcttaccgcccgtatttgtcagcgatagataaaaccttccttgttcttcagatacttttccgcccatcgcgttctcaataggttcgagcaattctcgaatttttgtttctctggggcctttggcaagcgggtgatttaattgcatacaggtatcaaaccaagtttcttcgaaagggatgctttggttttgatacaaagaagtgaaccaagggcaaagtgtaattaattcgcggctgggtaagaagataggtgtcggagtatattcattttctttcaatccgatgctttgaacattgacttgcgatgatgagttactggaaaaattcagactactatgcgtagtgccgttttgcagttttaaaacgatttccgtacgcccgcgcccctgcaaacgtttgctcaacctacccaaggaatcgggacggaaaacattcagtaatttatcggcaaaacttttttgcaattctgttttcagtaatctgtttttggtgttagatgttacttctagcaggctgtataaaatttttaacaaatgtgttttgccacaaccgttttcggcaacaataacattgagattttcagaaaattcaaaagtatcgtttggaagaacggtaaagtttgtcaactcaagcgactggatatattggttagatgacatttttaatccatttcaatcttgctttaaaattgtttcaaacaaccttttgtagaacaaatatcgtctgaaaccctttcttttttcactccggcttaaacacgcctgtatccgttttaggctgctgttcgataatttcaacatttgccgctgctttctccgcttctgctttttcagcttcgatacgttttttctcggtcaggtattggttgatttggtgtaccaattcctgcgtgccttggtgggtcagcgcactgatttggaagaggcgcggggtttccatgtcaaattggaaacggtcgtcgggtttggggtagtcccagccgacggcttcgaggaaggcggcagtgcgcgtttgggcttcttcttcgtcaagcatatcgagtttgttcagtaccagccagcgcggtttgccgtagagttcttcgtcgtatttgcgtaattcgttgatgatggcgagtgcttcttcggcggggttgacggtttcgtcgaagggcgccaaatcgacgacgtgcagcagcaggccggtacgtgataagtgtttgaggaaacgatggccgaggcctgcgccttctgccgcgccttcaatcaggccggggatgtcggccatcacgaagctgtggttttcgtcgatgcgtaccacgcctaagtttggatgcagggtggtgaaggggtagttggcgattttggggcgtgcggcggatacggcggtaatcagggtggatttgccggcgttgggcatacccaataagccgacatcggcgaggactttaagttcgagttgcagggaacgggcttcgccttcttcgccgggggtggattgtttcggggcgcggttgacggacgatttgaagtggatgttgcccaagccgcctttgccgcctttggcgaggcagacgcgctgtccgtgataagtgaggtcggcaacggtttcgccggtgtcgaggtcgcggataagggtgccgacgggcattttgaggacgatgtcgtccgcacctgcgccgtaacggtcggaaccgtggcctttttcgccgtttttggcttggtagcgtttaacgaagcggtattcgacgagggtgttggtgttttcgtcggcttctgcccagacgctgccgcctttgccgccgtcgccgccgtccgggccgccgcgcggtacgaatttttcgcggcggaaactggttgcgccattaccgcctttgcctgcggcgacttcgatttttgcttcgtcgatgaatttcattcaatgctcttgtttgttggtttcaaatggggggttcagacggattaccgtgtgttttgatgccgtccgaacagaatttcggacgctattataagggataagcggtatttcaacacgccgtacccaaactatttgttccgcccatcttaatgaatttttaagcaaatcttcagcctgcaaacaaaattatgtccaacttctttggtacaatcgcgcctttttgacattccgacccgacggaatgtccgttcaaaccgttacatataataagttttttatgaacacaaaccaacctgccgtttacgacccgttgacacgcgcgctgcactggctgaccgttgccggcttcatcggcattctgaccaccattgtcctgtggacgatttatagtggattaacaaaaatcaggacaaggcgacgaagccgcagacagtacaaatagtacggcaaggcgaggcaacgccgtactggtttttgttaatccactatacgaagaggcggaatgggtgggcagcctgttcggcctgcacaaatctttcggtttccttacgctgacggtgattacattgcgcatcgtgtgggcggttgccaaccgcgccaagcgtccgcaaagcgactgcaaggctgcggcggcaggccacggcattctgtatctgctcatgcttgctgttcccgttatcggcatgatccgccaatacggcagcggccgcggcccgttgaaagtgttcggcgttgaagtgatgcaagggttcgccggaaaaaatcgagtggatggcaaacttgggcaacacgttccacggcaatttgggcttgctgctgtttgccgccgtcgccggacacgtcgccatggtcgtcgcccaccgtgttcagggtagagatgttctgtgccgcatgacgggtcgtgtccgctgattccgttcacactatggtgccggctcgtccggcactatttgtttttccaagacagagccagatcgtacaaagctttctttccctcgcccgtgattttggcagcaagctccgccgcctgtttggtcggcagctcggctgtgaggattttcatgatgttttgcgcggactcggacaagccttcgtgtttttcatcctgcgccggataaagcaccaacaccatctcgccgcgcgattggttgccgtcggcagacaatgccgtctgaatttccccaaccgtgccgcttaagaacgtttcaaacgttttcgtaatttcgcgcgccagcattaatcggcgttcggggaacagttccgccatatcggcaagcgtcgcaccgatgcggtgcggcgtttcaaacatgacgataggaaacgccgcccgcacccatttggcaaacagtttcctgcgttctcccgatttcggcggtacaaaaccgttgaaataaaaatcggatccttccacaccggccacgctcaaagccgccatcaccgcgcttgcgcccacgacgggaacgactttaaacccggcctcacgcacgcggcgggcgagtttcgcgcccgggtcgcacacggccggcgtacccgcatcggaaacctgtgccacaaccatgccgtctgaaagatagccgacaatcttgtccgccatctgccgttcgttgtgttcgcgcacactgacgagtttgccctgaatgccgtacgcgctcaaaagctgtgcggtaacgcgcgtgtcttcggcacagatgatgtccgccttttgcaataccgccaaagcgcgcagggtaatgtccgccaaattgccgatgggcgtggcaaccacgtataatgtccctccgacgacgctgtcggaggctttctgcaaatgtttctgaaacataagaatgccgtctgaaaaacaaacattataaaggttaaaccgattatgcgcctaaaccacaaacagggcgaggcaggggaagatgccgcgcttgccttcctccaatcccaaggctgcacgctgcttgcccgcaactggcactgcgcctacggcgaaatcgacctgattgtcaaaaacggcggcatgattctgtttgttgaagtaaaataccgcaaaaatcggcaattcggcggtgtcgcatacagcatttccccatccaaattattgaaactgcaacgaagtgtagagtattatctgcaacagaacaggttgacaaacgtaccgtgccgcctcgatgcggtacttatcgaaggcagccgcccgcccgagtggatacagaatattacaggttgacgatatgacgacattacaagaacgcgttgccgcccattttgccgaaagcatccgtgccaagcaggaagccggaaaagtattggtcgagccgaccgtacaggctgccgagctgatgctgcaatgcctgatgaatgacggcaaaatcctggcctgcggcaacggcggttcggctgccgacgcgcaacacttcgccgccgaaatgaccggccgttttgaaaaagaacgcatggaactcgccgctgtcgcgctgacaacagacacttccgcgctgacagccatcggcaacgactacggtttcgaccacgtattcagcaaacaggtgcgcgcgctcggacgtgcaggcgatgtattggtcggcatttccacctccggcaattccgccaacgtcatcgaagccgtcaaagccgcacacgaacgcgatatgcacgtcatcgccttgaccggccgcgacggcggcaaaatcgccgccatactcaaagacaccgacgttttgctcaacgttccccatccgcgcaccgcccgtattcaagaaaaccacatcctgctgatacacgccatgtgcgactgtatcgactccgtactgctggaaggaatgtaacccttttcagacggcatggcgcaaagcaatgccgtctgaaacgcccaagaaaggaagcacccgatgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctgactcggcaatgccgtctgaaccgccttcagacggcattgcccgacaccccaaaagcacaatcaaaatggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaacctcttctgacccggcacggcaggcacacccgcaatccaaggaagcattatgaacggcatcatcatcaaaacccccgaagaaatcgaaaaaatgcgcgagctgggcaaactcgtcgccgaagccctcgactacatcggacaattcgtcaaacccggcgtaaccaccgacgaaatcgacaaactcgtttacgactaccacgtcaacgtccaaggcggctatcccgcccccctgcactacggcaacccgccctaccccaaatcctgctgcacctccgtcaaccacgtcatctgccacggcattcccgacgacaagccgctcaaagaaggcgacattatcaacatcgacctcaccatcaaaaaagacggcttccacggcgactccagccgtatgtttaccgtcggcaaagtctcccccatcgcccaacgcctgatcgacgtaacccacgcctccatgatggcgggcatagaagccgtcaaacccggcgcgacactgggcgacgtaggttacgcctgccaacaggttgccgaaaacgccggctattccgtcgtacaggaattctgcggacacggcatcgggcgcggtttccacgaagccccgcaagtgttgcactacggaaaaaaaggacagggccccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtgaccgaaaccggctacgaaatcctcaccgtcagccccgcctccggcaaaccctgaaaccggacgtatccgccccataaaaacaaacaatgccgtctgaaagaaacggcagatatgatatataatataaaaacaggcttgacccggcacattacgaaaacaaagcaaatcggaatttgccccgcaaccagacaaacttaaaggaagttttatgaaaatatttgaaaatatagaagatgttaaagccatccgtaaaaagaccgggctgaaccagatagacttctggggcaaggtcggcgttacccagtccggaggatcgcgctacgaaaccggccgcaaaatgcccaaacccgtacgcgaactgctccgcctcgtccatatcgaatgcatcgatttggcgaaagtcaacaaaaaagatatggaaatcgccgccctgttgaaaaaacaccatcccgacctgtatgccgagttgtccaaacagaccaagtccgaaagaaaaaaacaaagttaaaccgcaacctccggatgcccgacagtttttcatttccgaaaaacgcaaacaatgccgtctgaaacaccggacaggtcgccgtatcccgcctgccgcccctgcctcaaaccgccgaaccgcccgaacccgcctttttacaaactttatccaatttcctgtttatttcgggatacgccgacattagaatgtcaaacagctcgaaacgggcaaactccacatccatccaaaggaataaaaatgaaacttctgaccaccgcaatcctgtcttccgcaatcgcgctcagcagtatggctgccgccgctggcacggacaaccccactgttgcaaaaaaaaccgtcagctacgtctgccagcaaggtaaaaaagtcaaagtaacctacggcttcaacaaacagggtctgaccacatacgcttccgccgtcatcaacggcaaacgcgtgcaaatgcctgtcaatttggacaaatccgacaatgtggaaacattctacggcaaagaaggcggttatgttttgggtaccggcgtgatggatggcaaatcctaccgcaaacagcccattatgattaccgcacctgacaaccaaatcgtcttcaaagactgttccccacgttaatcaggcaacaaaaaacagcgttttcagaaatgaaaacgctgtttttttgaccgttccattattcacaaaagggaaaaaacgattacctgccccgtgtatcaaaacctgccctgccggatgaagggcataaccggcagggacggcgtcaacaccatatgggggtacggcttttcttgaaagattcggcttaaatatccaatactttcgcggtataggcgataatttcatccgccctttcagggttttcgttcaacttgatgccgtaacccggtaccagctctttcagacggtcttcccaagacggggcgcgctcggggaagcattggtgcatcagccggatcatcagcggcacagcggtcgatgcgcccggcgacgcgcccagcaatgcggcgagtgagccgtcggcgtgggcgacaatctccgtaccaaactggagcacgccgcctttttcggagtcttttttaatgatttggacgcgttgccctgcggtgatgagttcccagtcgtcggggtttgcctcggggtagtattccagcagggaggcgaagcgttcttctttggttttacgcaattcgcccagcaggtatttggtcagcggcatattcgcccagccggcgcacagcataggatagaggttgtccatatggatggacagcggcaaatccataagcgagccttgcttgaggaagttggaacggaagcctgcgtaagggccgaacataaggtggcgtttgccgtccacgttgcgtgtgtcgaggtgcgggacggacatcggcggcgcgccgacggaagcctgcccgtacactttggcgttgtgttgttcggcggtttcggggttgctgttgcggaagaacaggccggacacggggaagccgccgtagcctttgccttcggggatgccggatttttgcagcagggtcagcgcgccgccgcccgcgccgaggaagaggaagcgggtacggagggtgagctgcccgtcggggttgcgggtatcggcggttttgagcacccacgcgccgtcggattcgcgtttgatgtcttcgacgtggcggttgaactcggtttttacgcccttgccctgcaaatatttcaccatttggcgcgtcagccgtccgaaatcgacatccgtaccttcggcggagtagttggcggcgacgggttggttttcgtcccggccgcgcatcatcagcggagcccaatcggaaattttgttccgatcggtggaaaattccatattttcaaaaagtttttgggttttaaacgcgtcataacgtttttgaagataagaacaatggtcttcattcatcaccaaagacatatgcggcacggcattgatgaaggaattgtcttccaacttgccttccgcgaccagcgtcgcccaaaactggcggctgacatgaaactgttcggcaatattgagggcgcgcgccggatcgataatcccatttgcacccaacggcgcatagttcaattcgcacagcgcggaatgccccgtgccggcgttgttccacgcgtttgacgattccaacgccacatcttccaagcgttcaatcagggtgatttcccaagacggttcgagttctttgagcaaaacgcccaaagtcgcgctcataatgccgccgcccaccaagacaacgtctgtcgcttcagccatggtttactcctaaaaaacaggcatcttctgcccttatggttatttgccgtactacaaacgcctgaatcgcaaaagcagggaaaaccggcaatggtgtgtgtccgagtatgctgtttcggggttggaatgcgttgcaagcatggcttccgacaccgcttcaggggcttgtaatatgttatcgtgaatgtagtggattttactgggaaatgcaaagtttttctgtcgcccgccaagtcgggaaactgcgaaatgaaaaataaaaatagttatttatctatatatatcaaatttttaatagataaaaaatcaaaattgtttatatattaatttttaaaagattgtcagcatattgcgttaagttttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaatttgaaaatactgcctcacacctgcacgccataccctgccaacctgccggtcaggatttccctgtttttgcaccaatcttccctcagcatactgtacacgaccgtatcgcgcacactgccgtctttacggagcatatgcatacgcagcacgccgtctttttccgcacccagccgttcgatggcacgttgcgaggcaaggttcagaatatccgtgcgccatcccacgcaacggcaagccaaaacatcaaatgcggaatccaacagcatgattttgcaacaggtgtttatccgtgtccgccgtgccgatgccgcataccatgtgaatccgatatccaaacgcggaatctgcggttcaaaatgataatacgccgttgtcccgaccaccctgcccgcctcttcatcgacaaccgcaaacgccaaacgcgttgccaatgctgtcccgatatagtctgccaccctatccggatggggcgcggacgttacccccagcttccaaacctccccatcgcaaaccgcctcgcgcaaacccgtttcatgatgcacatccaacggttcgagacgaacgccgcccaacgacaagaccggcagtattatcttttccgacatccttttctcccaatattccgccttcagacggcatttccgcccggaatgccgtctgaacggctaaaaacacaatatccccgcctccgacacaaaaccgtccaaagaccggtcgtgcgcctcgaccggcagcctgtccaccaactggcaggcaaagcccacgcccacggtttttgcctgcaaacggtatttcatcgctgaaagcgtcgcatcgtaatagccgcctgcctgtcccaagcggtagcccagcctgtccataccgaccactggcacaagcaggaggttcaaatcatgcacacgctttttccgacctgcaaactgagggacatgcagcttcgccctaccgcgcttgcgttcttgttttactccatcggcaggatacggcgtaaaccacatccgccgcgaacgcggttcgatataaggcaggtagagttccgcaccgcgtttttgcgccgcgcggacaaagccgtccaaacgcaattccttgcccatcggccaatacacgccgattttccgcccttttttaatataacgtttgagcaggtggttgatttttaccgttgccgccgcccgcacgtcccgccccatttgcgaacgccgcccgcgcaattcgcggcgcagggcgcgtttttcctcgttcctcatttcagacggcctttcaggattgcggtagaatgttgcgattataacgattttgttaacattcaaacaggacgcacacaatgtggcacatcgtcgccatcggctatctttttgttgccgttatgtattccgccgcgcagccgagtattgcgcgcgccttgatttatttggttttttgggcggtgctgcccaccgtgttcacggttttcaccattaccgtccgccgccgcaaccacctgatgaggcagcaggaacaggcggaatccgaacagcagcgcgcacaacggcaaaaagacagcggcacaaaaccctgaatcccttttcagacggcatcttatccgctataatccgtcagttttccatttcggaaacacactattttttaaaacttatgcccactttcgccgaagggtgcttgacaataggcgtgacctatcaagttctatgcgattgaatgtgtgctcttaaccctttcaaggaaataaaatgtctcaaattactatgcgtcagatgattgaagccggtgttcacttcggccaccaaacccgtttctggaacccgaaaatggcacaatacattttcggtgcgcgcaacaaaatccatatcgtcaacctggaaaaaaccctgccgatgttccaagacgcgcaagaagccgtacgtcgtctggttgccaacaaaggtacagtattgttcgtaggtaccaaacgccaagcccgcgacatcatccgcgaagaagcgacccgcgccggtatgcctttcgtcgattaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgatgttgaaaaactggaacgttctttgggcggtatcaaaaacatgaaaggcctgcctgacgcgattttcgttatcgataccggctaccaaaaaggtactctggttgaagctgaaaaattgggcatccctgttatcgccgtagtcgataccaacaacagccccgacggcgtgaaatacgttatccccggcaacgacgactccgccaaagccatccgcctgtactgccgcggcatcgctgacgcagttttggaaggcaaaaaccaagcgctgcaagaaaccgtagccgctgcccaagaagccgctgccgagtaatccggcaaaccgaagaggggcgttatgccccttttctcaaatatgccgtctgaacgtccgttcgcggcacacgattcccgaatgcggaaaatcctttccgtatttcccaaaaatctaggagattcaaaatggcagaaattactgcaaaaatggttgccgacctgcgcgccgctaccggcctgggcatgatggaatgcaaaaaagccttggttgaagccgaaggcaacttcgacaaagccgaagaaatcctgcgtatcaaatccggtgcgaaagccggtaaactggccggccgtaccgctgccgaaggcgtattggcttacgcgatcaacggcaatgtcggcgcattggtcgaagtaaactgcgaaaccgacttcgttgctaaagacgcgggcttcgtagaatttgccaacttcgttgcgaaaactgctgccgagaaaaaaccggcttctgttgaagaactgagcgaactggttgaagcagaacgcaaagccatcatcgccaaattgggcgagaatatgtctgtccgtcgcttccaagtgatcgacactgccaaccaactggttgcctacatccacggcgcattggcgaccgaaggcgtattggttgagtacaaaggctctgaagacgtagcacgcaaaatcggtatgcatattgttgccgctaaaccacaatgcgtaagcgaagccgaagtagatgccgaaaccgttgaaaaagaacgccacatctacaccgagcaagccatcgcttccggcaaacctgccgacatcgccgctaaaatggttgaaggccgcatccgtaaattcttggctgaaatcactctgaacggccaagcattcgtgatgaaccccgatcaaactgttgcccaattctctaaagaaaacggcactgaagtgatcagcttcgtacgctacaaagtaggcgatggtattgagaaaaaagccgtcgattacgcagccgaagttgctgccgctgctaaagtgtaaggcacttatgaaaaagaaagcacctggattccaaacgaatcagggtgcttttttttgagaaaaccgtttacggtacctattttaagacgaccgaatattcagaccgtcttaaaacaaaacaataataaaccgacacaccctatcattaatattccgaccgttggaaattcagacggcccaactccgaccgacgacattcaagaaagcaaggtatccatgacacagcaaatcaaatacaaacgcgtattactgaaactctccggcgaatccctgatgggttccgatccgttcggcatcaatcacgataccatcgttcaaactgtcggcgaaattgccgaagtcgttaaaatgggcgtgcaagtcggtattgttgtcggcggcggcaatattttccggggcgtatccgcccaagcaggcagcatggatcgcgccaccgccgactacatgggcatgatggcgaccgtgatgaacgcgttggcactcaaagacgcatttgaaactttaggcatcaaagcgcgcgtacaatccgcactgtctatgcagcaaatcgctgaaacctacgcccgccccaaagccatccaatatttggaagaaggcaaagtcgtgatttttgccgccggtaccggtaacccgttcttcacgaccgacactgccgccgcattgcgcggtgcggaaatgaactgcgacgtgatgctcaaagccaccaacgtcgacggtgtgtacaccgcagacccgaaaaaagacccgtccgccacgcgctacgaaaccattacttttgacgaagccttgttgaaaaacctcaaagtcatggacgcgaccgctttcgccctctgccgcgaacgcaagctcaatattgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggattaaatttaaaccagtacggcgttgcctcgccttgccgtactggtttaaatttaatccactatatttacaattttgatacaatttgtttttcatcaaaggagaaaatctatgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttgattcacactaccataaccgcttgctaccaaggaaaacaaaatgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaagaatgaaaaaacagtaatttttcatttttgaaactaatctaatttttagcagccgtaggtcggattctcgaatccgatattttccaacagcggcatttcggaaacgatagatgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcatcaattccgccagacaatgggctgatgcccatccgaatataacagcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgatttataggaaaaagccatgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaacttaacaacccaaatttttgtcagagcctagtgcaaattacaactatgattctattgtagccgaaatgaaagaaaaaaatcatgggttggcgacagggttgatgttgttaatatgcctgatggagcacctactagtatggataacacgcgtattatggcagcacgtgaagcaggagtaaaagtggaagcgaatgttcataattttaatgaccgattatcatcaaaagagagaatcaggtttaagcatgatggtattgagcctcaaacttggggagaagctatccagctacgaattagaaagcaagaaacacaaaaaggagttccagaagggtggagcaaaagatttcctaacggaagtatttatgatgtaaaggtacttaggaaatgataaaacaaaatagttttgttccgtatcctgaagcaatgcttcctaaaggatttaaatatccgcaaagttatttaaaattagctcaatccactcatgccattaactacgatgaacaatattcttttccttggtggtttgaaaatgcagaaagcaatatatcagaagtaattgacatttattttgaaataactggcattccaaacctattaccttttgctagaaaccaagagtgggctgcctgttttgatatttcagataaatcaggtaatcctaaaattatagtagttaatttagataatacaaaatattacgagacttttgaaaattttgatacttggctaaaagaagctgaaaatgatggttggtagcaaccgtaggtcggattctcgaatccgacatttttcaacagcggcatttcggaaacgatagacgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcattaattccgccagacaatgggctgatgcccatccgaatataactgcaacagcccaaactgccctttccgtagcagaagccgcaactacggtttggggcggtaaaaaagtaaaccttaacccgaccaaatgggattgggttaaaaataccggctataaaacacctgctgcccgccctatgcagactttagatggggagatggcaggtgggaataagccaccaaaaccaagtacgcagcaacaccctacacactctgataacaatatcggcttacctgcctcatatgttaaacctgatacatctatttctccgacaggaacaattcaagaccgcatcagatggacaaagtccaagtttcctactgagaaatctttaaatggacatttcaaagctcatggaaaagaatttggcgatataaccattgaagactaccaaaaaatggcgtctgatttgttatcaaaacagacatcggacaagatattaggttatcagacggaacatagacgagtgcgctatgatatcaataacaatatctatgttttggccaatccaaaaacattcaaaatcaaaacaatgtttaaaccaaacttaggaaagaagtattatgatggagaattcaaaaaagacatgggaaattgacggagaaatatggctacattgtcctgtttgcggaactgaagttatggactatgatatctgtgacgtttgtcagtggcaaaatacaggagaaactaatatagatggtggccctaatgaaatgacacttgcggaggcgaaagaagcttacgcaaaaggcttaccaatcagataaataagcacctagagaaatcaatgatgacggaatcccatggttacctatcaaataatttacctgttaaaatcataaatgatattatttatgcaacccagttagtcgaagatttggttttaggaaaaataaaaattgttgattttttaaaatcatataacaatttttattgttggcttggttttgatgagttgcctcaatctgagaaaataaaattcctaagctatcttaatatattaagtattcataaagaaatacaagatgaaactgtgaatagggtttataccgattgaaaaatagtagatagagattaacatgttaaatgaaatttttgaaatttattcgagacaaggggaatctttgataggaattggaattagagaagccgcattacccgtccctattgcaatagatatattaaatttatttatcaatgagagaatacttgtattggggggagatatttatatcaagaaagataattatttttatcaaacatatgataattggtattacgagggaagtaatttatttaacagtatcgacaaagcaatgcattatttatctcaaataaaattagagaatgcatacgtatcttttgtgttgaaatttatctaacaaaggaagcacaagaatagatttatagtaaaacatcaagatgttgaaaatgctgggttttaatccaacctacactgaccggctcagatacagccgctcagcagactctacaaggtattaatgatttaggaaatttaagtccggaagcacaacttgctgccgcgagcctattacaggacagtgcttttgcggtaaaaaacggcattaattccgccagacaatgggctgatgcccatccgaatataactgcaacagcccaaactgccctttccgtagcagaggccgcaggtacggtttggcgcggtaaaaaagtagaacttaacccgactaaatgggattgggttaaaaataccggctataaaaaacctgctgcccgccctatgcagactgtagacggggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttagcaaaagacggttgggttaagcgtgttcaaaacgtaaacaaaattgaaatacattacattgaaaactcaagaaccggtgagaaaacagattttaagtttaaggattagtcatgtttttagatgatgtaaatgtttttttagatgatttaaatgtttttttagatgatttaaatactaatccaatcactgacgaatggtatatgtccaattttgccgataaacatattaaaattttggaaagttacgaagcctttgatattctaaaacaatttgttgattacatgattgaagaatatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttagataaactatcaatatagaaggaaatccttggaaaaaataaaatgataatcgaacacaatggaaatatacataaaatagccagaatgactggaaataaaaataattttttagaaataatcctatcagatattcatgaaaacataaaaatcaaaccattaactataaaagtaaaaggagagaatgttataaatatccttcctgaggaagttagtttttatgtaaaacaaggtgttgatttaatttatgaaaaatataaacggaaattctttatctccgaaatttctttttgccaatcagatagccggccttcaagtatctacgcttttcttacatttcacttgcttgaagatattattaaaaatgaatccccatccaactacacctgactggctaatagcaggtatgaaccgtgtattcatatcaatataagattaattacggcagaatttgatgaaattagacaaaaacttatcgtaagattttatttagacagagaagtaactgatgatggcaaagaagatatggaaacagcacgaacagaattacttccaggaggatatgcttcatctctggtagtttgacagatttgaccgcttcataaacttagaacattaattaatgatgataatgtttatatgattggttctaaggatagcaaaagcaaattcagaaggaacatgaatggctatttatgacttaaacgaaatagccgtaggtcggattctcgaatccgacattttccaacagcggcatttcggaaacgatagatgcgtcaaatatttttgtcggatacaaatatccgacctacatctctgcgcagcaaactttacaaggtattaatgatttaggaaatttaagtccgaaagcacaacttgctgccgcaagcgcattataggacagtacttttgcggtaaaagacggtatcaattccgccagacaatgggctgatgcccatccgaatataactgcaacagcccaaactgcccttgccgtagcagaggccgcaggtacggtttggagaggtaaaaaagtagaacttaacccgaccaaataggattgggttaaaaataacggctataaaacacctgctgcccgccctatgcagacgttggacggtgagatggcaggaggaaacaagccagttgttaaatctatcagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaatgaaaaaaaatatttttcacaatgtaagcctttatgaaataatcttttccgataatggaaatacccttacattatcttttacagatacaattgaaggtaattatttcggatatatcaaatgcagtaatattttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaatagtaactgctttcccagcagccgtagcaactgtatttttacccgacggggtaaaaatacagttgctacatctctgcgcagcagactctacaaggtattaataattcaggaaaattaagcccggaagcacaacttgctgccgcgagcatattacaggacagtgcttttgcggtaaaagacggcatcaattccgccagacaatgggctgatgcccatccgaatataacagcaacagcccaaactgcccttgccgtagcagaggccgcaggtacggtttggagaggtaaaaaagtagaacttaacccgaccaaatgggattgggttaaaaataccggctataaaaaacctgctgttcgccatatgcagactaaggcgttaggtacggtagatgaaattggcgatacagtacagcaggttgggaaacaggctagcggacaaaaaaccagcggtggtaatcctgcgattgatagcgacccctatagcccgagtagtgtggcagctcgcatagaagccggtaaggcgcgcagtgatttacaaatcaaagacattttgagcaatactactcaaaggagtaaaacaaaaggtcccgctgttcagtatgataaagtgggggattacaatgacgcactaaatgattttaatagtctgaatgttcgaaatgtacaaacacgtcctaatggaacgataacgggcaatttacctgatgggcgtgcggttaatgctcgtaatgatagtagtggtggagaaccaacacttgaaataacaattagtaataaccgaaaaataaaaatcagatatggaaatacacgataaattatgaaattaaaaagcttagatttcccaactggctatttctattttgataatgcagcaataaactctgataaagtagaagttatagcagttggttatagaaatacggataaaaccataaaaatttttattgaagatgttattcattttagggttgttgatgaatcgtattttatagatacttttatggatttaatttcggaagatgcagatagagctttgcttcatgaaaatggtggtcaatctttttttgaacttcttgatgagtgttatgcggaatggatattgaaagaaagttattttcctttgaatagagaattctttaaatactatatttttatgtttgagcaaacattcatagaaataattggttctagtgcaacgtattcaattattgagggctagcgtaagatgagtaataagttgcctatctttctttcaggcagcctgaaaataaaactacccaagttgatggtgtacctgtatcagtgaagggaaattttgttgatggtaaatttcgcattggtacggcaacaatgaaatcattttaaattgagctagaaatgaacctagaaaattatgaaaacattttaataaaattacttttttatcataacaacttagtaaatgaatattcttattttattgaaaataaaaatttatttaaaatagtatctcgaacgaaaacgagtaagggcttttttttcactatagaaaaaccattaaattttctaagcaaaaaaacttattttgagtttaattttaaatatttacactcagggaaagaacgctttggttcgtttatgtgctggataaatactaatttaatggaatttgagggggttttttttaacgacctgctccctgataatatgataataaataacttttttgaaataaatgattaacgatacaccaataaaaattggtggggtaaccgtatggatgatattcgcggcatcatccaaggtgcggttaatcctttaatttacaaggtaagcaagcaaaagattatttacaacaacaaactcatatcaggaacttagacaaatgaatgaacacaacctgttaattttctgtttaaaagacaatgtttcaattagtgaatatactgaaatgattgattgggcttataaaaacattcaatctgaaacagttgtagaaattacggaaaatcaaattattgaatatcaaaatcgtggattatggagacttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttttgagactaatccaatttttagtaatattgatgcagagcaagcagcattagatgccgcaaacatggggagaagctattcaatttagaattaaaaaacaaattgaaaatgaactagcaccaccaaattggtctacccagtttcctaatggtagtatttatgatcctaaggtaacgaaatgattattcaaaatgaatttaatttatatcctagtaatatgcttcctgaaaggttttgttatcctgaaaagtatgttcgtatctctaacgatacatctttaataccttatattcagccacataattttcactggtggtttgagaattatggaacagaaggggcagaagtagcttatatatttagaaattctatcctgcctgatttaaatcttatcccattcgctagtaatggagaatgggaagcttattttgatggtaatgatgtaacaggaaattctagggttattgtcattaatttagataatatagaaaaccatgaattttttaatagttttgaagattggcttgaattagcaattaaggatacttggtaagcagctatctataaagagatgaggctgccctggacaactaggataaactcgattttactaattgttttaaaatggaacaagaacttttatttcactgttgttaaaacgccattcgcactcctttaaatacagctcaaaatgcgctttgggaatgccgttaaacttgcgtaaatgacgttttgcttgattccaaaagttctcagttccattaatatggttttgtcgttcggcaaaatgtgtgctgtgattgatacggaaatggctaaattcgcccgcatccaatacatcatagccacgataacaaaatgagtttattttgtttataccgtcttagacgactttctctcatagggataattctaacttaatttgaatttccctagtgatctagggcagcccctaaattaataaagcagcacaactccttttgccgatgttccggactgtcaaacgactgttcctcatgccacatctccatcaaggtacggataacccgctccgccttaccgttggtctgcggacaagcaaatcgggcaagcctccaaccaatcccattatcataacaagctgcaccgaaagcatgttggacggctctttatattacctatcattgtcagagtaaacgtactcaatcaggtacaagcaggggtcggacagatgttcggtcagaaacttggcagcactgtctgcggttttgtccggcaaaatggcagagtataaaaatcgtcaatagcgacaaacaggtaatctcgtttatcagcggccttctgtcctttgagcaacaacaaccgatcggtatcaggatgcacaaaacctcccggggacaacctgccttttacggctttaagtgcacggtaaatagtgacgcggctgacttagtggcagcatactggggaggtgagtgtttttgtgtatatttttattttggtattcccttagaaatactgtaaacaacgctaccggacggcctgcagggcttcgcgcacgcttgctttgagttctgcgccgaagcgtctgcccaagattctgccgaaatcgtccttcggagtgtaatccaccacatcgggggctttgaccacgtctcgcgccacgctgtaaatattgccgagtccgtccaccagcccgactttcagcgcatccgcgcctgtgtacacgcgaccgctgaacacgtcgggatattgtcggaatttgaggcggccgccgcgtccggttttgacggctttgatgaactcgccgtgtatgccggtcagcatttcttcccagatttttgactgttcgggcgtttcgggcgaaaacggatcgcccatgcctttgttgctgcctgcaattttaaccctgcgtttcacgccgattttttccatcaggccggtcgcgtcgaaactgctgccgataacgccgatgctgccgacgatgctggacgggtcggcatagattttgtccgccgccgccgcgatgtagtagcagccggacgcgcacatatcttccgccacgagataaacgggaatgccggggtgctgcgccttcagacggcgtatttcttcaaaagcggtgttggacacgacgggcgaaccgccggggctgttggcgcggatgacgatggcttttgcctgcgggtttttgtaggcggcctccataccgtctttgagttttttgacctggtcttctacaccgttgccgatttcgccgtacagattgacgactgcggtatgcggcgtgttgcccgccaactgcaatgcggcttcgtcttttcggaaaatgcctgcaatcagggcaaccagaatcagggtgctgacggcgcgccagatgtttttccacatccgctccctgcgcctgtcctgataggcggacaacagcacttcgcgcatgatgtcgcgctcccataaggtttcccccgcattttttgcttcgggtgcttcgttttctcttctgattcggtattgcatggttttccttaaatattgtccgatttgggcaaacggttttcagtttacccgatttttcagctctgctcccaatccgtccaagctgtgcaacacttccgcccacgccgcgtccaaaaggttgacggcttctccttcggctttgatgccgaactcaatgtgcggtttgacctgcgtgccgtctgaatgcgtccaaccgacgctgggcaggctgtacgaacgcacgccgggataagtttgctcgatatgctccataagcggcgtaatgcgcgattcgggctgctcaaacacatacacgctgcggctgccgcgttcggtttggttgaagcggtcggcgtaataagtttccaatacccattccgccatcgggtgcgccatcacaggaaagccggggaagaaataatgctcgcggatagaaaatccggcgatgttgttaaacggattgggcaccaattccgcgccttcgggaaaatctgccattttcaggcgttgggcgtgttccggcgaatcaagcggctcgccgcgtttctgggttatgccttcgataaacttggcggcttcagaatggcggacgacgggcaaatccaaagcagcggctgcggcttggcgggtgtggtcgtcgggcgtggcgccgataccgccggtaacgaaagttggcatgccgtctgaaaagctgcggcgcagttgcctgaccagcaaatcgggttcgtcgggcaggtattgcacctgattgagcttcagccctttggattcgagcagggatttgaaaaaggcgaaatgcttgtcttggctgctgccgtgtaagatttcgtcgccgatgatgatgaggttgaacgcgttcatagatggtttctttaccgatgccgtctgaaaatgtcgatggtgctgtgatttgttccctctcccgtgggagagggttagggagagggtcgagcttgcgtttttcaggcagcgtttgcttaaggcctgctgtctgtaccctctccccaaccctcccccgcaggggagggagtcaggttgaggatggcgtaaagaccgtctgaaaagattttcagcgaaacgggcaaagcttcttttcagacagccttaacggctgacaatgggttatatttataagataatgaactccttttttcaagtccgaaggatacccttatgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataaggtttgctgttttacatcattagcaacttaaggggtcgtctgaaaagatgatcccttatgttaaaaggaatcctatgaaagaatacaaagtcatcatttatcaggaaagcctgttgtccagcctgtttttcggcgcggcaaaggtcaaccccatcaaattcagcgagttcctcaataaacaaacccccgaaggctggcgggttgtaacgatggaaaaagatttgcgccgtatgctgctgtttttcaaacgcgaggcctacgtcgtcattttggagcgggatcgtgtttaagctcggcgtttatacctgtctcggactgtttgccggctgggtgctgctgctgatcgtgcaactctggttttcttttctcgaagcggaattgttcttcaaaatcacactgactatggcggggctgtttgtcatcatcctcgccgccttactggtatgcggtcagtatttttccgaaaagaaaatgaaagacgacgggtttatcaactgatgcggacttgaaccggacccgcgacccaaacatcacaatgccgtctgaacgccctcgcttcagacggcatcaacatcaatcctgctcttttttgccggcaaacacgccgaatccgcccttttccgcatctgtcgggcgatagctgtattttcccgccacttcctcgccggccgggccgtaaaactttccggaaacatccccgctgccattttccgtccaagtccccttaaagccgtttccatcgatggcggctttgaatttttgcgtacccatatgcaaatcatcgccgctgtcgataatgccgtccacagatttgctgccgaaatcgacttttgcggcaaacctgcccctggtcgggtacggacggccgttttccgtatggaaatgcagtacttcgccgttgtacacggccgcgcccgcaagcatttcgccttttgccggttcgccttgaacacgaagggcatacgatccgccgggcaatttttccgccccgtaagtcagataccggtaattcccttcgggcgcgaagatattgccggaatgccccgtcaggctgaccgcttccccatcgacaatcagcgtatccgcctgattgacgggaatcagcggcatctcggccggaagcgaccgcctcgaccgtgcagaacgcctaaatcgcgcaaatgaagtgggtttaggtttataaaagataatatattgattgattcccttcatctgcacactatcggcaaccaaaccgacaaatttatcattcttcccatctttcttgtaattacttattttgtctgcatcacttaatttttcaaattctgattttagctgtacttcttcatccaagaaattattgccactacaagaatcgcctttacagtgggtcaacgttatattttgcgacggcccgtcaatcaaaacgccattagccaaatcaacccttccaaaattgctaccgccattcgcaggtgcagggtttgacgcggggatgggatctgaagaaccggcggcttgattgtttccggcttgatttgcaccttgggcagccgtattgccggcattttgcccgcctgccgacggatcgtccccctgcattccgtccgccgcatttgccatatccggttggtttgccggctgagacgattccccggcatccgttgcttgattttccatatttccggcaagcatattcggatccggggtgtgattcggtgtcgaactatctgtaccggcggcattttgcggcatatcattttgtgccacctcgtcttcatttttgggattatccgctgttaccgcaccgccattgcctgtattttcttccgaaaccgccgccatatcttgactgccttgtgcggatggcgcgccctgtccttgagaacctgcctgtggcgcatcttcctttgcctctgtctctttttcagaaacaacaggggcggcaggttttgacagcgtgtccgccgacttgacatcgggcgatccgccaccgccgcccccgcaggctgaaagggcaaaaatacaagccattgcgattacgctgcgtttaaacatcatcatctccttcatcgtatttcctttttggtttaaaccccgccacttggacatccgtccttcggggcggtggaatcagctttatttgggaagagcgcaacctttccaaatcagggcgacacatagggctgtgctttatgtgccgccctgtgtgttgaaacatattcaataaatattgtttccgccgtatgcctataaaattgtaaaaatatgccgtctgaacgccaaacgggcttcagacggcatagcttggtttattccgcccggttcctctgtcggcccaaatcggcggcagcggtaaacaaaacgtcggtcgaagagttcagcgcagtttccgccgaatcctgaatcacgccgataatgaagccgacggcaaccacctgcatggccacatcgttatcgataccgaacaggctgcacgccaaaggaatcagcagcaacgagccaccggccacaccggatgcaccgcacgcgctaacggtagccaccaggctcagcagcagggcagtggcgaagtcaaccgtaatgccttgcgtgtgcgccgcagccatcgccaaaacggtaatggtgattgccgcaccggccatattgatggttgcacccaatggaatggagatggagtaagtgtcttcgtgcaaacccagctttttcgccaatgccatgttcacagggatattggcggcggaagaacgggtaaagaaggcataaacgccactttcacgcaggcaggtaaacaccagcgggaaagggttgcggcggattttccaccacacgatggcgggattgaccgccagcgcgataaacgccatacagcccaacagcactgcaagcagcttcgcgtaccccgccagcgcgccgaaacccgtctccgcgattgtggacgacaccagcccgaaaatgcccaaaggggcaaaacggataatccatttcacgacggtggaaaccgcttccgccaaatcggcaacgacctgccgcgtaacgtccgaaccgtgattccgcaacgccgcgcccaaaaccaaagcccaagccaaaatgccgatatagttggcattggcaatcgcgttaatcgggttggcgaccaggttcatcagcagcgatttcaatacttccacaatgccggaaggcggcgcggcggacacatcgcccgcgcccgccaaaacaatgtgcgtcgggaaaaccataccggcgatgacggcggtcagggctgcggaaaacgtaccgatgaggtaaaggacgataatcggcctgatatgcgccttgttgcctttttggtgctgcgcgattgtggccgccaccaaaataaataccaaaaccggcgcgaccgctttgagcgcaccgacaaacaggctgccgaacaagcctgccgccaagcccagttgcggggaaaccgaaccgattacgatgcccaacgccaaaccggcggcaatctgcctgaccaggctgacgcggccgatcgcatgaaataaggatttgccgaacgccataattcttccttatgttgtgatatgttaaaaaatgttgtattttaaaagaaaactcattctctgtgtttttttttattttccggctgtattttatagtggattaacaaaaatcaggacaaggcgacgaagccgcagacagtacaaacagtacggaaccgattcacttggtgcttcagcaccttagagaatcgttctctttgagctaaggcgaggcaacgccgtactggtttttgttaatccactataaggttgcgttgatttgccctatgcagtagtgccggacaggctttgctttatcattcggcgcgacggtttaatttattgaacgaaaataaatttatttaatcctgcctattttccgacactattccgaaacgcagcctgttttccatatgcggattagaaacaaaataccttaaaacaagcagatacatttccggcgggccgcaacctccgaaataccggcggcagtatgccgtctgaagcgtcccgccccgtccgaacagtgttaaaatcgaaagccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaaaccgatatggccacttcagacggcattgcagcaaaccattttgaaacagacattatgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataagcggttttcagacggcgcgccgccaaaccggacatttgaaaacctgcttttccaccgtccgccgccgccgtccgcctgcaagggaacagaatcgatatagtgaattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcgaaagcgggaatctaggacgcagggttaagaaaacctacatcccgtcattcccgcgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcaaaagcgggaatctagaatctcggactttcagataatctttgaatattgctgttgttctaaggtctagattcccgcctgcgcgggaatgacgattcataagtttcccgaaattccaacataaccgaaacctgacagtaaccgtagcaactgaaccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagccgcagacagtacaaatagtacggaaccgattcactcggtgcttcagcaccttagagaatcgttctctttgagctaaggcgaggcaacgccgtactggtttttgttaatcctctataatgcgcccttcggcgtggcggatatataaggaagtgattttccatctaagtaaaaaccgccctatcggataagcccttaacagaaaaggctttacccgcgccgtatcggaacacatcctctaaaatacaatccgttgaattgaaaaaaatataaaaacatccgcccgcgaaaaacggcagcgcgtcgtttgacaaagaatgaaaatatcggttaaaaaccgattttcatacaaaaaacaccgctgccgtccgcatccgtttcagacggtattgagagaaaatcttttaggagaacctttatgtcccggcatcccgcccccaccggagaaaaaacattcttcggccaccccttccagctttccaccctcttccatatcgaattgtgggaacgtttttcattttacggaatgcagggcatcctgctgatttacctctactacaccgccgacaaaggcggcttgggcatagacaaaaccctcgccggcggcattgtcggcgcatacagcggcagcgtgtacctgtccaccattttgggggcgtggtttgccgaccgagtatggggtgcggaaaaaaccctcttcctctcgggcatcgtcgtgatgctcggacacatcgtccttgccgccgccccgggcctgtacggccttttaatcgggctgatattcatcgcattgggcagcggcggcgtgaaatctacggccagttctatggtgggcgcattatacgaacaggacgaaatgcgcccgctgcgcgatgcgggattttccattttctacatcgccatcaacatcggcggcttcctaggcccgctgctgaccggcctactgcaggaaaacatcggtttccattatggtttcggcgcggcggcggtcggtatggcattcggcttgtggcgttattccctgggacgtaaaaacctgccccaccccaccgtcccccatccgctttcaaaaggacagggcaaaactgcggccgccgtcggcatcgccctcatcgccgcacttgcaaccgccatcaaaaccgggcttgtcaacctcgacaatttctccggcatcctattatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttaccgtgcccgtcgcttggaaagattctatgcaaagcctgtgggtcatcctgttttccggactgatggcggcaatgtggacaaaaatggggcgcaaacagcccaaaaccccgctgaaattcgctatggcggtatttgttaccggcgcgtcgtttttgggattcgtcccctttatttcctccggtacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctatcggctgctgttctacatcggcgcagccacaggcttcctgctgctcctgctcgtccccaaattgaacaaaatgctcgaaggcacagactaagtcccgccccgatgccgtctgaacccttcagacggcatttttccgcataatgaaaccaaaccgtttccacccgacaggacaggctcccgcccaaccggaaggcagcctgccgattgtcatttgaataacgcaagggaaagccgttgatttccgtttgtatggaaacagtttggtttcattggaaaaaggcattttgtccgactaaattagtgctgcatcaacgaaatatatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgttaatccactataaaaacacaacctaaataaaaatgccgtctgaaccatatttcaggtttcagacgacatttgcgtgtcggatgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtgaggaatccaaaacatacgaacggatttggctgccccaacctacatcggatttaccttcttccaacgcctgtttctcttcattgcgtttgcgcatttccaattcatacagtttggacttcaacatttccatcgcagcggctttgttggcgtgttgcgaacggtcgttttgacattgcaccacaatccccgtcggctcgtgggtaatgcgcacggcggagtcggttttattgatgtgctgaccgcccgcacccgatgcgcgataggtgtcgatgcgcaaatcggcggggttgatttcgatttcgatggaatcgtcgatttcagggtaaacgaacacggaggcaaacgaggtatggcgtttgttgttcgagtcaaacggcgagtaacgcaccaagcggtgaacgccggtttcggtacgcagcaaaccataagcgtattcgccttccacacggatggtggcgcggttgatgcctgcgatttcgccgtcgtcttcttcaaggatttcgattctgaagcctttgcgctcggcgtagcggctgtacatacggaacagcatacccgcccagtcttccgcttccgtaccgcccgcgcctgcggtgatgtcgataaagcagttgttcgggtcggcgggctggttgaacatccgtttgaactccaaatccgccatctgtttttccagccccgctacgtcttcctgcacggcggcaaaaccttcttcgtcgttttcttcgacggtcatttcaatcagcatgcggttgtcttcgatgcccgaagcgatgttgtcgagcgtcaacacgatgccttcgaggattttgcgctctttgccgatttcttgggcgcgtttcgggtcgttccaaagttcggggtcttcggaaagaccgataacttcttccaatcggtctttcttaccctgataatccatataaactcggatgtcttcgctgcgcttttccaaatcgttcagggtattgttgagctggttgattacttcggcttccatgattcttttgttctttcaaaattttaggggcgtattgtacgggattcgggtatttttttctatggataaagccttctggaaacacgttcagacggcatagcgtcaataacggtatgccgccagtttgcgtttgatttcaggcaatgcggcacgtgctgcctcctcacccaaccggatggcgcgttttttctgatcgaatccgccgactgcacccaaatccaaaacctgcggtttgataaccacatccgcctgccccaactcattttgcaacgcagaaacgctcattacgttcagcgtctgatcgagataagagaagaaaccttggctgatgtttttgcccggacgggcggaaatatcgacggcaatcacgaaattcgccccctgccgccgggcggcactgacgggcacgggctgcgacagaccgccgtcaacatatgtatgcctgccgatgataacgggttggaacacattgggaatggcggcggaagcgcgcacagcctgcccggcattcccctgattgaaagcgacggccttgccggtttcaaaatcagtagcaacggcggcaaatttgatgggaaactgctgaatctgcctgccgccgacttttcggttgatgtaattttgcagcttttcgcctttgataaaaccactggtggacaaggttaaatcgaccaaatcggttttgcctaaaatttcggcttccaattcgaggcggtcgggcgacatacccgatgcaaaaaggctgccgacaatcgaacctgccgatgtgccggtaaccaccttcacaggaataccgttttctttcaaaaccttaataatacctacatgggcaaatcctttagatgcgccgccaccgagtgccaaaccgaccactgcggcgggtttggcggtttgcaccggcttgcggacagcattatttcccgccgtgccgcaggcggcaagcaacgcggcggcggcgattgccaaaagcggtctgatttttgaaaacgttaccatattttccattcctttatatatcgcaccccgtcaaaaagagggattgcttttcttaacacccccctttgacagccaagcaaatgggggctttgttaagtcatcatcaaaattaatatttcttttttttttcctttacggaaattatatttgaaggcatactatccaaggcgggaattatctcacaacaccgccgttatccaaatatcccgcctttttccctttctttccatcaaaatactttctttttatattcattaacttgttaaatcattggctgccgggtgtcagtttttccgacaaaatccgtctaatggggtatcaacagaaccaaaacaggaacacttatgaaaatcggaacaacttggcagacggcatccgctatgctggttttgcgtctgtttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtattgttgcttttgggtttggcaacgcgtctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaacggttttgcccccgatgccgtctgaaacaagattgattcagtcgtggaatctgactttaaacattccaaccttatctcgttaacttgatattttgaaaaggaaatgacatgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataatcccaccccttcaaaccaagccgcgtttttcagtaaaatgcggcttttttaacggcaaacaaagattttttaacaagcacatcattcttttgtgccatccgaaccgggtaaaaatatgattcaacacgcaggcttgggctaccgccgcgacttggcggaagactttctctcgctttccgaaaacagcccgatatgctttatcgaagccgcaccggaaaactggctgaaaatgggcggctgggcgcgcaaacagtttgaccgtgtggcggaacggctgccgctggcgttgcacggattgtctatgtcgctgggcgggcaagcaccgctggatactgatttgatagacggcatcaaagaaatgatgcgccgttacgattgcacgtttttctccgaccatttgagctactgccacgacggcggtcatctttacgatttgttgccgctgccctttaccgaggaaatggtgcatcatacggcgcggcgtatccgcgaagtgcaagaccgtttgggctgccgcatcgccgtggaaaacacgtcctactatctgcattccccgcttgccgagatgaacgaggtcgagttcctcaacgccgtcgcacgtgaggccgattgcggcattcatctggatgtgaacaatatctacgtcaacgccgtcaatcacggtctgctgtcgccggaggcttttttggaaaatgtggatgcagagcgcgtgtgctatatccatattgccggacatgacgtggaaacgccggaattgttgattgatacacatggcgcggcagttttgccgactgtttgggacttgctcgaacttgcctatgccaagctgccgacgattccgcccaccctgttggaacgcgattttaatttcccgcctttttccgaactcgaagccgaagtcgccaaaatcgccgattatcaaacgcgtgccggaaaggaatgccgccgtgcagcctgaaacctccgcccaataccagcaccgtttcgcccaagccatacgcgggggcgaagccgcagacggtctgccgcaagaccgactgaacgtctatatccgcctgatacgcaacaatatctacagctttatcgaccgttgttataccgaaacgctgcaatactttgaccgcgaagaatggggccgtctgaaagaaggtttcgtccgcgacgcgtgcgcccaaacgccctattttcaagaaatccccggcgagttcctccaatattgccaaagcctgccgcttttagacggcattttggcactgatggattttgaatatacccaattgctggcagaagttgctcaaattccggatattcccgacattcattattcaaatgacagcaaatacacaccttcccctgcggcctttatccggcaatatcgatatgatgttaccgatgatttgcatgaagcggaaacagccttgttaatatggcgaaacgccgaagatgatgtgatgtaccaaacattggacggcttcgatatgatgctgctagaaataatggggttctccgcgctttcgtttgacaccctcgcccaaacccttgtcgaatttatgcctgaggacgataattggaaaaatattttgcttgggaaatggtcaggctggactgaacaaaggattatcatcccctccttgtccgccatatccgaaaatatggaagacaattccccgggccaaaaccatctatccgcataaaattaccttgttcccgatactatgccgctacccgacctgaccgatgccgaattaatagagtcgcgtaaactgcttctgcattttgcgcggcttcagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcggaaggcagaggaaagtctttaccacactggatgacgagctactggatgaagcatttgaaagccatttttcccaaaacgggcattggacgcaggaagggcagccgcaacattggaacactccggaaaaatcattaaacaacaacgaattccaaaaaattctgcaaagctgcctatacaacctgcctgaaaacaccgcacgggtatttaccctgaaggaaatactcggtttttcatccgacgaaatacaacaaatgtgcggtatcagcacgtccaactaccacaccattatgcaccgcgcccgagaatcattgcgccaatgcctgcaaatcaaatggttcaaccaagaaaacccgaagtaaacgttatgaaaaaatgccgcgatatcgccctgcttctttccaaacatcaggaccgggaaaccaccccgggcgagaagatttccatatacacacacctgctgttctgtccgtattgccgtgaatataaaagacaacttcaaaccatcaaaagatcactggcaaaaacaaccagaacttcaaaataaatgccgtctgaaaaggcttcagacggcataagctgacggaaacaaatcaaaccgatttactgttatctgcagttcatccataatacacacttcaaaagcagcatatttccccatacggaatgtataaatacgcaaaatacgaaggctgcatcaatttgccatatttgctttatttgccttatttcacagacggcgctacccctcccgcccaacccgttctttctgaatgagcagatttcaatgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctgattgcaacttatacacaaacttacccacaaaccttatcataaaaatgccgtctgaaatactgaaatatcagcatttcagacggcattttgccattccctgaaaattatccacaaagttatccacattattttttaaaaccggcttccatccgaaatatagtggattaacaaaaatcaggacaaggcgacgaagccgcagacagtacaaatagtacggcaaggcgaggcaacgccgtactggtttaaatttaatccactatataaactcgctatacaatttcactatccaaacgtaaattgttccattgatacacaaaactgcttacccccataattttgataaagcatttcttacattcccggctccgtcccgtaaccaacacagcggcggattcgcatttgaagtgcaactttccctaacagaaaaaggccagtatgcggtagcatacgacctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagagcctctaaaaaataatcgcttgttttgacaccgatacactcatatagtggattaacaaaaatcaggacaaggcgacgaagccgcagacagtacaaatagtacggcaaggcgaggcaacgccgtactggtttaaatttaatccactatacaaatacagaaactcaagaaaataaccttgtgtattgaccatctcaagcaattcagaaaaatcaagaaattttctgaccgtaaacaaacgtttccctaaaaaaacgatgtcttcaaaaatatcgaacaaatagagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaaataatcatcttcggcgttttcatttttatggattaaaacaacacgggaaaaatctgttttcagatgcttgcccgcttgattgttcggattattgtccggaacgacaaaaccgtcctcaaaattaaagcagacgttgcgtccttctacctttatctctgtgcaataacaatcatgtagagaaatgctatccgaaaaattttttctttgtgtatgcaaaaaaagttttcattcaagtacccatatctaacgcaaacgtttacctgtttccccgtcaataatctgactcggcgatttctgcctgccgattctcccaccaacaatccacacatcgcgtccgaattgccttctgacttccctctccgtccgacacgcgcgtttgcctgcgcggttgcacgaagtcgagaccaaaggcgtttgcaaagcctgacacaagcggcgcgcacctacatgggcgggaaccctgaccgccaacttgctgcgctgtttcccgcgtaactcgggtaagacacaggatttggcggataataggaacgttttaggggcgggccattcttttctaagcatatcctgaagattttcagacggcatttgaagtaaaggctgcaattgttcaaattgattcccgatgacaatcatacccttgtgttgcggtctttttttcaaatgcgccaacttaccgagtgctttggctaatgtcggaagacaccccaagccataacaagattcggtcggataagcgaccaaaccaccttttttcaaataaacgcttaacttacgttgcgctgatgctgcgataattctcggaaataacataatataaaataccgtctgaagcacattagtcatacttggcttcagacggcatcatcctctttctaattaacggttaatcgctttatcggcaatgtctttacggtattgcatcccgtcgaaactgattttttccaacgcgccatatgccttagctttcgcttgcgccacattatcgcccaatcccacaacacacaatacgcgtccgccgttggtcaatacgtcacctttctcgtttgccgttgtacctgcatggaaaactttgccgatttggttggcagcatccagaccggaaataatatcgccttttttgggcgtttcggggtaattttgcgccgccagtaccacgcccacggcagtttgcgggctccattccgcggttacgctatcgagtttgccgtctattgccgcttcaaccaaatccgataagtcgctgttcagtcggctcataatcggctgggtttcaggatcgccgaaacggcagttaaactcaatcgtatagggtgcaccgctttgatcaatcatcaaacctgcgtacaggaaaccggtgaactcatgcccctccgctttcatccctgctacggtcggcaaaataatttcattcatcgcgcgttcgtacacaacaggcgttaccacaggcgcagggctgtacgcacccataccgcccgtattcagacctttgtcgccgtctaaaagacgcttgtggtcttggctggttgccataggcagtacattattgccatcaaccatgacgataaaactcgcttcttcgccttgcaggaaatcttcaattacaacacgcgcgccggcattgcccattttgttgtccagcagcatatcatcaatcgcagcatgcgcttcatccaaagtcatcgccacaatcacgcctttacctgccgccaaaccatcggctttgataacgataggcgcacctttctgattgacgtaatcatgtgcggcatcggcgttttcaaaggtttgatattgcgcggtcggaatattgtatttcgccataaatgctttggcgaaatctttggaactttccaactgcgccgcatattgtgtcggaccgaatatttttagtcctgcagcacggaaatcatccacaatacctgccgccaaaggcgcttcagggccgacgacggtaaaaacaatattttctttacgacagaattcaatcaaatcctgatgcgcagtcaagtcgatgttttgcaacttgggttcaatcgctgtaccggcattaccaggcgcaacaaatactgtttccactttaggcgactgcgccaatttccaagccagcgcgtgttcgcgaccgccattaccgataaccagcagtttcataccatctccttgacaaatatgtacttttaacgaaaactcgatacaaagggacttttatcccatctgaagaaattttagtagaatcaaacaaaagaccgcttcattccactctgcaacctattcaacttatccataaattaaaaaaggacaagcaaccatgcaaaaacgtattgatgaaatccaaagcaaataccgcgaatggtgtcatttactaccgcaactggaagaagacatccgccgttggaaacatgtcgtcactttaattcgcgacatggacaatttctatacccacgagtatcaggcgtgtcatcaggctattgaagacggggtagaactggatttgagtacggaaggcgaatacagcattatgagtgaagatgcgctatggaacgcgctgggcgaattccatcaattggcttggttatatttgcgctccagcgtcgatgccttagacaaatatacacaagaagattagtcagcgaagaggtcgtctgaaataccatcacaaagcatttcagacgacctttcattcaaaaggcttttccgtatttacttcaatctgccgagtattcttccaagccgcaacacaggcctcataatttaccaacgacaaactgaccgtcaatcggcaatccaactgcaaatcccgctccaatatatccgcctgatattgtttggcaatgcgtatcgcttcattcaaaaacggatattcacatttcagccaaacagttttttcaatattcttttcaactacttctgcaactgccaacgcttgagccgtcgcctctttgtacgcatgtatcagacctggaacacctaacaaagtaccaccgaaatagcggacgaccacaaccaaaacgtcggtaatacccaccgaatcaatctgtcccaaaattggtcgtccagcacttcctgatggctctccatcatcgttggcacgaaattgcacaccatccacacccaaacgataggcatagcaccagtgtcgtgctttatgatgctcttcctttaacggatcgaggtattttttcacatcagccaatgtccgaatcggataggcaaatgcaataaaacggctgcctttatctttaaactcagcctgcgtcaaggaagtaatggttttataagtcgtaatcatgctgaaatgttttcagacgacctcattaataacaaggtcgtctgaaagtttcacgtgaaacatcaatttttcaatacttctgttaattgtggaacgatttcaaataaatcgccaaccaatccgtaatcggctacattgaaaatcggcgcatcagcatctttattgattgcaacaatcaccttactgtcttgcataccggcaacgtgttgaattgcacctgaaataccgattgcaaaatagagttgcggcgcaaccactttaccggtttgtccgacttgagcatcgtttggcgcatattcggcatcaactgctgcacgggatgcaccgattgccgcacctaaaacatccgccaacggtgtcagcacttcattgaatttttccgcactacccaacgcacgaccaccggaaacaatcacttttgcctgagtcagttcaggacgatcggaatgggaaagctgacggttaacaaaacgactcaggttttgggcaggggttgcttcaacattaattacctcagcattaccaccttgcgccgccactgcgtcaaaaaccgtcgcacggaaggtcagcaccaatttttctgaatcagcttgcacggtttcaaatgcattacccgcataaatggggcgcacaaaagtcgtgttatccacaatttcggtcaaatcagaaatttgcggtacgtctaataaggctgctacgcggggcaaaaggtttttaccgaatgtggttgccgttgctgcaacatagcggtaatcggccgccaatttaacaaccagcggagccaactcttcagccaaaccttcggcataatgagcagcatctgcaaccaaaacttttttcacccccgctacttgcttcgcgaattccactacagcagatgcgccgtttccggcaaccaataaatcgactttgcccagtttggcggcagcggtaacagcatgcaaagtggtaggattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccataatattggggagtttgacaaagcgcggctcgttcaaacgcaaatccgcgctgataacagcaggcagtttcaatgcgatggtttcttcgccgccatcgatttcccgcacaatctgcacttcgtcgccttcaatttgtactttggacgcgaacgtaccttgcgccgcattcagcaaagctgccagcatttgcgccacttgattggcatcatcatcaatcgcttgtttgcccaaaaagaaaatttgcggattttctttgtccgcaacggctttcagcaacttagcaacggccagagactccagtttagtatcggtttcaacatgaatggcacggtcggcacccatcgccaaagctgtacgcaaggtttcttcgcattttttctcacccaaagaaaccgctacgatttcgcttacttttccggcttctttcaaacggacagcttcttccacagcgatttcgtcaaacggattcatcgacattttgacattgccgatatccacatccgaaccatcggcttttacacgaactttgacgttgtagtccactacgcgctttactgcgaccagtgctttcattgaaccctcctaaaaagaacgctgctttcaccatccagcgaaaccaaaccttcttccctataaaaccaaatccgttttccttaaaaacgaattcattcaaaaatctttcggataatgcttgccgattataccatttttaaagcatttactcagactagcggatatacattcctgtatctaataaattggaaaatatcatgccgccatatcagttttagacgaccctttagcctttatctgctgcaacacaatccatcagcgcttgataaaccaaatctgcggtcggaatctgcccgatattgcccaaattttttgcaattggcgaaacctgaacgcctgttttaatcggatcggtatcggtataaatgccgaccacaggtttttccaaggcatttgccaaatgcagcaaaccggtatccacgccgacaattccgaccgcgtatttcagcagatacgctgcctgcaataaatttattttgtcgcacacaatagcaaacggcagcccatctgcaatttgtttggcacgcgttttttcatcttcatttccccaaggcaggtaaatattgcattgctgttcttcattcaacttttgcagcaacgaccgccagttttccacaggccataacttactgtcccgactggtcgcatgcaaagccgcataatacggctgcgctaaatttttcagacggcctgcttcaggaacagtcaagccaaatacctgcgtttccggcattacatacccaaatacttgggcaaacagttcacggttgcgccaaacggcattttttcccttcggtacagcgtatgtttttacatacgccaaagcagcccatccctcgcgcgcactgtttttatccaaaccacaaatcggggattttgccattttagcgaaacacgcgcttttaatcagaccttgactgtccaatacgaaatcaaatacttcctgccgcaaagtctgtttcagatgacccatttcccgccaagtttcagcccgaaagagatgtttgcgccattgccgccatttcatcacatggattttttttacaaacggatgcaggcgcgcaatatctgcaaatccagcctcacatagccaatgcagttctacatcaggacattgtcgcgccaaatcttcgattgcgggcaaagtgtgaattaaatcgcccatactagacaagcggacaagcaaaattttcatatttaggaagggggtttcacgtgaaacaattttaacttattgattattaatatatttatttatttcatcagcgttttttaagatgattgccccagcagaatgcatttcctgccatgctgtttcgatggtttccggcgcaataccccgacaagccgcttcattgacgacaacctgccaacgaccgcctttgagtaactgcaaaaccgttgttttaacacaataatccgtagctaacccaccgataataaccgtatccgtattttgacaacgcagccattcaatcagccctgtgcttagtttttcctcaatatcgtgaaaacacgcgccgtaaggatgcaattcaggatcaacacctttccaaacgcaataatcgtattctttagcagaaggcagcccgtccaataattcatagccgcgcgtaccgaccatcgcatgagccacccaagtcaaatccgcatcaggcaaacctgtcggcttcaacatatcaacagggttatccacaagccatttcgctaccatatgatgcgcatctttcgtcatcacgcgcaaatccgccaaagcggcttgcgcattcaactcctcgacaatcaaatgcccctcgttcacgggcagttcgtcaggacacagtggcgtaaacgttttttgtgcatcaacatcaatggaaacaatcatctcattatttcaacgcgattaaaatgccctgtattataacaaattactgcccaaaagcggtaaaaccgattgtgataagataaggtttttccaaaaaacttatccacaaccttatgacttataccattacccccatcggcaccgcccgctcgccctacaaacagaaattcggcatcgcccgccagcccggtttggtctccgccgcaaaagcctgcatcgagctgaatcccaaattcaccgcagacagcgtgcgcgggctggaagatttcgattatgtgtggataagttttatttttcacggcgtattggatgaaggctgggcgcaaatggtgcgcccgccacggctcggcggcaaacaaaaaatgggcgtgttcgccacgcgcagcccccaccgccccaaccatctcggactctcgctcctgaaactcgaacgcatcgaaaccggcaaacccgtccgcctctattgcagcggcgcagacctgctggacggcacaccgattgtggacatcaaaccttatatcccctttgtcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcagattacgaagtcagatttcaaatcgaggaaaaccgtgcaaccgttattgatctttccccaaccccgctttaaatcgggcaaaaatccggttttgccgcatagcagttgaacaaacggctgttgtttgttcgccataagccgcaatatcaagttatagcggattaaatttaaatcaggacaaggcaacgaagccgcagacagtacaaatagtacggcaaggcgagataacgccgtactggtttaaatttaatccactatacagataaacaatgccgtctgaacgcaatgtgttcagacggcatttacttatccacaggtttgttcaagccttagattttgcctgcgaagtattccaaagtgcggacgagttggcaggtgtaggacatttcgttgtcgtaccaggcaacggttttcaccaattgtttgccgcccacggtcatcacgcgggtttgggtcgcatcgaagagcgagccgtattcgatgccgacaacgtcggaagaaacgatttgatcttcgttgtagccgtaagattcgctggcggcggctttcatcgcggcgttgatttcttctttggttacagggcgttcgaggatggaaaccaattcggtcagcgagccgctggcaacagggacgcgttgggcggagccgtcgagtttgccgttcaattcggggataaccagaccgatggccttggcggcaccggtgctgttgggcacgatgttgagcgcggcggctcgggcgcggcgcaaatcgcctttgcggtgcggcgcgtcaagggtgttttggtcgccggtgtaggcgtggatggtggtcatcagaccttcgactacgccgaactctttttgcaggactgccgccatcggggcaaggcagttggtggtgcaggaagcggcggagataacggtttcgctgccgtccaaaatgtcttggtttacgccatatacgacggttttcacatcattgccgccgggtgcggaaatcacgactttgcgcgcgccggccctgatgtgtgcttcggctttggttttattggtaaagaagccggtacattcgaggatgacatccacacccaactcgccccaaggcaattcttcgggattcggattggcaaaaactttgatctctttgccgtttaccacgatggcatcgtcttttaattcggcagtaccttggaaacggccttgtgtgctgtcgtatttgaaaaggtgcagcagcatttcggcaggggtcaggtcgttgacggcgacgacttcgatgtcgtgggctttttcaatttgacgcaatgcgaggcggccgatgcggccgaaaccgttaatcgctactttaatgctcatgtatatactccaagctgtgaaacgaaatttcaatacctgtattgtattctgaaataaagttacattccactattacatctaactacttgccgcttatttgatatagatgaattttactgtttgcacagatttccaaaacttttaccatcaatatttgaatttaaaattttaatgatgattttgatgattgccaacctgcttgtgcgtaagtagcaaatatccaatattttcattacctttttgtcaaataagtttgagtttaagacttgctgtataagacagataagcgtggatgttttttgacttaataatatttctgtggataactttgctgttttcctagttgtctccacaaccttattgacaggcttacggtcagtctcattccgtcgaagacaaaaccttttgctacaataccgttttcctaatgataaggcagccccatgtccaaatccgccgtttccccaatgatgcagcaatacctcggcatcaaagcgcaacataccgacaaactggtgttttaccgtatgggcgatttttacgagatgtttttcgacgatgcggtagaagcggcaaaacttttggatattaccctgaccacgcgcggacaggtggatggcgagccggtcaaaatggcaggcgtgccgtttcacgccgccgaacaatatctggcgcgcctggtcaagttgggcaaaagcgtggcgatttgcgaacaggtcggcgaagtcggcgcgggcaaagggcctgtggagcgcaaagtcgtgcgcatcgtaacgcccggcacgctgaccgattccgcattgctggaagacaaggaaaccaaccgcatcgttgccgtgtcccccgacaaaaaatacatcggtttggcgtgggcatcgctgcaaagcggcgaattcaaaaccaagctgacaactgtggataaattggacgacgaactggcgcgcctgcaggcggcggaaattctgttgcctgacagtaaaaacgcaccgcaacttcagacggcatcgggtgttacgcgcctgaacgcgtggcagtttgccgccgacgcgggggaaaaactgctgacggaatatttcggctgccaggatttgcgcggcttcggtttggacggcaaagaacacgccgttgcgattggcgcggcaggtgcactgttgaactatatccgtctgacgcaaaacctgatgccgcaacatttggacggcctgtcgctcgaaaccgacagccaatatatcggtatggatgccgccacgcgccgcaatctcgaaatcacgcaaaccctctccggcaaaaaatcgccgaccctgatgtccacgctcgacctttgcgctacccatatgggcagccgcctcttggctctctggctgcaccaccctttacgcaaccgcgcccacatccgagcgcgccaagaagccgttgccgcgctggaaagccaatacaaacccctccagtgccgtctgaaaagcattgccgacatcgaacgcatcgccgcccgtattgccgtgggtaacgcccgcccgcgcgacctcgccgccctgcgcgacagcctgtttgccctgtccgaaatcgaattgtccgccgagtgcagcagtctcttaggaaccctcaaagccgttttcccggaaaacctatccacagccgaacagctccgccaagccattttgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacacttaaagtcgagttcaaccgcgttcacggcttttacattgaattgtccaaaacccaagccgaacaagcacctgccgactaccaacgccggcaaacccttaaaaacgccgaacgcttcatcacgccggaactgaaagcctttgaagacaaagtgctgactgctcaagagcaagccctcgccttagaaaaacaactctttgacggcgtattgaaaaaccttcagacggcattgccgcagcttcaaaaagccgccaaagccgccgccgcgctggacgtgttgtccacattttcagccttggcaaaagagcggaacttcgtccgccccgagtttgccgactatccggttatccacatcgaaaacggccgccatcccgttgtcgaacagcaggtacgccacttcaccgccaaccacaccgaccttgaccacaaacaccgcctcatgctgctcaccggccccaatatgggcggcaaatccacctacatgcgccaagtcgcgctgattgttttattggcacacaccggctgttttgtgcctgccgatgccgccacaatcgggcccatcgatcaaatcttcacccgcatcggcgcatcggacgacctcgcctccaaccgctccactttcatggtcgaaatgagcgaaaccgcctacatcctgcatcacgccaccgaacaaagccttgttttaatggacgaagtcggacgtggtacttccactttcgacggcctcgccctcgcgcacgccgttgccgaacacctgctgcaaaaaaacaaatccttcagcctgtttgctacccactatttcgagctgacctacctgcccgaagcccacaccgccgccgtcaatatgcacctttccgcgctcgaacagggacaggacatcgttttcctgcaccaaatccaaccgggtcccgccggtaaaagctacggcattgccgtcgccaaactcgccggcctgcctgtacgcgcattgaaatccgcccaaaagcatttgaacggactggaaaaccaagccgccgcgaaccgtccccaactggatattttcagtaccatgccgtctgaaaaaggagatgaaccgaatgtgggcaactttgtggataaagcagaggaaaaacattttgaaggtatattggcagcagccttggaaaaactcgatcccgacagcctgaccccgcgcgaagcattgtcagaactgtaccgtctgaaagatttgtgcaaatccgtatcttaatttccgttgtcggaacagcatcaaaccatatggaaaaatctgtggataaacattatctgacaggaaatttccaaacataaaaaatgccgtccgaacagctcagacggcatccgtccattcggcttaaaccttatccacatccaaacgcataaccgtaacccattcaccgttatggaaatgtcgcccgacaaccacccagccgaatgattcataaaatatttgcacatcaggcgtataaagatacaagaactttatccccagcgaacgcgctgcgcctatgcagtgggcgaccagcctcctgccaatgccttttccgcgatattcaggtaaaacaaagacatcccccaaccaatattcataccgtggaaaactttccatatcatgccgcttgaccgcagccgaacccaacaggattccggaatcatccacagccgcaaatgccagcggcagttcgtcatccttcaaacacctgccgtaataggcatgaatcttatccacagaagaccacggttcaaatccgtgccactcctcaaacaacgcctgaaccaacctgccgatatgcccggctttcagccgtgtaatgaaaacagtattgtccacaaagagggaattcatcggtcaattccccgacgccttcgttccccctgcgccgtaaaccgcattccaagcatggtccaaacgcactccgatttgcctcaaatcttcagcctgccgggctttttgcgccattgctgcaggaatttccgcttccaaacgggcgatgtctgcctgagccgtctgcaaacgccggcgcgcatcttccaaatccgactgcatcccgatgatttttccgtccagattgttttgcttttgcaataaggcgcggtaaccggattggatgctgagcagattgtcttcagcatcccctgcccatacgcttgtagaaaaaacaaccatcagaaaataaaatatttttttcatttttaacttccatttaaatgctgtctgaagccgtattccgacatcagacggcatcgcccacgcctgtggataacttaagcgcggatgcgtttcaacacttcttctttgccgattaatgccaacacagcatcgacgctgggggttttcgccgtaccgcagacggcaaggcgcaggggcatgccgagtttgcccattttaatgccttcttcgtcgcagaagggtttgaagaggtcgtggatggcttcggcattccagtcttccagcccttcgaggcgttcggcaaagcgcagcatacgggcggcggcttcatcgtcccagtgtttctgcacgtctgcttcggcaggcgtttgtttgacgtagaagtagaagcactcgtcggcaagcgtgttcaagtcttgggggcggtctttgaccagttccaacacatcttccaaagcaggtttttcggtttcatgaatatcgcgcaacgcaaggcggggtttgacgagttcggcgagtttgccgttgggtgtgattttgatgtgttcgccgttgatccagtagagttttttcaagtccatacggcttggagacggggaaacgtctttcaaatcaaaccattcgatgaattgttccattgtgaagaattcatcgtcgccgtgcgcccagcccaagcgtgccagatagttgagcatcgcttcgggcaggatgcccattgcgccgaaatcggtaatggcaacggtatcgccgctgcgtttggagatttttttgccttgttcgttaagaatcatcggcaggtggccgtattcgggcaggttcgcgtcgatggcttttaagatgttgatttgtttcggcgtgttgttcacatggtcgtcgccgcggataacgtgggtaacgcccatgtcgtagtcgtctacgacaacgcagaagttgtaggtcggcgtaccgtcggcgcgggcgataatcaggtcatcgagtgcttcgttggggatggagatttcgcctttgaccaagtctgtccatttggtcacaccgtccaaaggcgttttgaaacggacaacgggttgtacgtcggacgggatttcgggcagggttttacctacttccggacgccagcggcggtcgtaagtcgccgagccttctttttcggctttctcacgcatggcttccagctcttctttgctgcaatagcagtagtaggcatggcctttttctaaaagttcggcaatgacctctttgtagcggtcgaaacggcgagtttggtaaacgacgttgtcggcgttgtcgtaattgagaccgacccatttcatgccgtcgaggatgatgttgacggattcggcggtagaacgcgccaagtcggtgtcttcaatacgtaataggaactcgcctttatgatggcgggcaaacgcccatgaaaacaaggcggtgcgcacgccgccgatgtgcaggtagccggtggggctgggggcgaaacgggttttgacggtcatgatggctccgaaatctttgaaagcgtttattttactggttttaccgtgcttgggcatcaaaaatgccgtctgaaccctgcctgcggataaagtttcagacggcattttccttgttttcaatgcttcggcacgcggaacagtgtatcacgcgccgccgaccgaattccttcgggattgcgtccaaaaaaaagttcaatgaaacagctaattgaaaaaatcccgcccccatttttccaaacggtagagggataacgcatatccctcttgcagcataaagatttttttcttatttcccgcatcaaaccgcgtggtcggcgtggcagacatataaacgcggacacccaaatcctccgccatttccgccgcccgcgccaaatggtagggatcgctgacaatcaccacgctggcaataccgttggcacgcaaaaccggacggatgttgttcaggttttcataagtgttgcgcgaagtgttttcaaacaggatgttgcgcgccggaaccccctgtttgagtgcgtaccgccgcccgacctcggcttcggtcatatagccttttttggtccggcctcccgtaaacacgattttgcctaccctgcggctctgataaagtgcgatggcatggttgatgcgttcgcggaaaacaggagaagggcgtttgtcccacgcggcggcgcccaacaccagcgcggcatccgcccggacatacggcggcaaaacctgcccacccgtccgataaaccgcccaaacggatgaggcaaacaccagcaaaagcggaaaaacactcaaacagaaaccgcccaacaggtaatagcgcaagccgttgcggctgcaaaacagccgtttgttcacaataccgcttcgatattttccagcggtctgccgacagccgccttaccgtttgccaaaacaatcggacgctccaacagggcgggatgatcggcgatggcacgcagcagcgcgtcattgtccaaattggggttgtccaaacccaattccttatacaaatcatctttcacgcgcatcatcccgcgcgccgatgccaagcccaatttgttgaaaatatccttcaattcggacaagtcgggcggcgtatccaaatatttgaccacttcggcagcaatgccgcgttcttccaatagggacaaggcggcacgcgatttgctgcaacgcggattgtggaaaattttgatttcaggcatgacatttccttgcttctcgacaatccccttattatcggcttacacagggttttactcaatatcccgcctacaaccgtaccaaacggtttacaatacccgaatcgacatacaaaggacaaaacgatgaaatacttgaatcttgccgcaatcacccttgccgccacatttgccgcacataccgcctcggcagacgaactggccggatggaaagacaacaccccgcaaagcctgcaatcgctcaaagcccccgtacgcatcgtcaacctttgggcgacttggtgcggcccgtgccgaaaagagatgcctgccatgtccaaatggtacaaagcgcagaaaaaaggcagcgtcgatatggtcggcatcgcgctcgacacatccgacaatatcggcaacttcctcaaacaaactcctgtttcctacccgatttggcgttacaccggggcgaacagccgaaactttatgaaaacctacggaaacactgtcggcgtactgccctttaccgtcgtcgaagcaccgaaatgcggatacaggcagaccattaccggggaggtaaacgaaaaaagcctgaccgacgccgtcaaactcgcccattcaaaatgccgttaaacgccggatgccgtctgaagccgcttcagatggcatttttcttttccacccgcctgccggtgcaaacttatccactatctaaaaacaggcggaatctttataatcggcactgtcttacctattgttcagacggcatatccctgcggacgcaaccgcccgaaacgatatgccgcccttccttacaggacctcctatgatccgtttcgaacaagtttccaaaacctatcccggcggttttgaagccctgaaaaacgtcagcttccaaatcaacaaaggcgaaatgatatttatcgcgggacactccggttcgggcaaatccaccatcctcaaactgatttcgggcattaccaagccgagcaggggcaaaatcctgtttaacgggcaggacctcggcacattgtccgacaaccaaatcggctttatgcgccaacacatcggcatcgtgttccaagaccacaaaatcctctacgaccgcaacgtcctgcaaaacgtcatcctgccgcttcggattatcggctatccgccgcgcaaagccgaagagcgtgcccgcatcgccatcgaaaaagtcggcctgaaaggacgagaattggacgatcccgtaaccctctccggcggtgaacaacaacgcctgtgcatcgcccgcgccgtcgttcaccagcccggcctgctgattgccgacgaaccctccgccaacctcgaccgcgcctacgcgctcgatattatggaattgttcaaaaccttccacgaagcgggaactaccgtcatcgttgccgcacatgacgaaaccctgatggcggactacggacaccgcatcctgcgcctctcgaaaggacgactcgcatgagcatcatccactacctctcgctgcacgtcgaatccgcgcgcaccgcgctcaagcagctcctgcgccaacccttcggcacactgcttaccctcatgatgctcgccgtcgcgatgaccctgccgctgtttatgcatctgggcatccaaagcgggcaaagcgtgttgggcaaactcaacgagtcgccgcaaatcacaatctatatggaaacctccgccgcacaaagcgacagcgataccgtccgcagcctgctggcgcgcgacaaacggctcgacaacatccgcttcatcggcaaagaagacggtctggaagaattacagtccaatcttgaccaaaatctgatttccatgcttgacggcaaccccctgccggatgtctttatcgttacccccgacccggcaaccacgcccgcccaaatgcaggcaatctaccgagacattaccaaactgcctatggtcgaatccgcgtctatggataccgaatgggtgcaaacgctgtaccaaatcaacgagttcatccgcaaaattttgtggtttctttccctgacgctggggatggcgttcgtccttgtcgcacacaacaccatccgcctgcaaatcctcagccgcaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgcccattggtcgatgccattttcaaaccctacggacttaatatcggctggcggttcttctacgctggcgaactcgggctggtgttcggcttcgtcatcgcgttgggcgtattcggcgcgtggcttgccaccacccagcacctgctcggcttcaaagccaaaaaataaaacaccgtcaaaaatgccgtccgaacccgttttcagacggcatttcaatttgccagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcagacggcattttttttatatcaaaccgcttacgcgccgcgtttttccaaagcggctacggcaggcagctctttgccttccaagaactcaaggaacgcgccgccgccggtggagatgtagccgatttgttcggtaacgccgaatttggcaatcgccgccagcgtgtcgccgccgcccgcaatcgagaacgctttgctttgggcaatggcttcggcaagggctttcgtaccgcctgcgaattggtcaaactcgaacacgccgaccggcccgttccaaacgaccgtaccggcggctttaagcaaatcggcaagcgcggcagcggatttcggaccgatgtccaaaatcatctcgtcttcggcaacgtcggcaatgtctttcaccacagcttccgcatcggcggcaatgtctttcaccacagcttccgcatcggcggcaaaggctttggcaacgacgacatcggtcggcagcggcacagaaccgccttttgccgccattttcgccataatttttttggattcttccaccaaatcgtgttccgccaaagatttgccgatggctttgccttccgccaacaggaaggtgtttgcgataccgccgccgacgatgagttggtcgactttgtccgccagcgattcgaggatggtcagcttggtggacactttgctgccggcaacgatggcaaccatcgggcgcgcgggctgtttcaaggctttgcccaaagcgtcgagttcgcccgccatcaatacgccggcgcaggcaacgggcgcggcttgggcgacggcttcggtcgaggcttgggcgcggtgggcggttccgaacgcgtcattgacgaacacgtcgcacaaagaagcgtaggctttacccagttccaaatcgtttttcttctcgcctttgttgatgcgcacgttttgcagcatgacgacatcgcccgcgttcagggcgggtttgttttcacgccagtcgttcaatactttcacgtctttgcccaacaggctgcccaagtgcgcggcaacgggggcgacatcgtcttcggggtggaactcgccttcggtcgggcggccgagatgggtcatcacgataacggacgcaccgttgtccacgcagtatttaatggacgcgagcgaggcgcggatacgggtgtcgtcgctgattttgccgtctttgaacggtacgttcatatcggcgcggatgaggacggttttgccctgcacgttttgttcggtcagttttaaaaatgccataatcagtccttttcaatcagtgtttgcgatacggaaacaattgatgccgtctgaaggcttcagacggcatcgcaacccgatcagccggatacgcgctcgattttcgcgccgacgctgccgagttttttttcaatattttcataaccgcgatccaagtggtaaatctgttcgaccacggtttcgcctcgcgccgccaaaccggcgataacgaggctggcggacgcacgcaaatccgtcgccttgacgactgcgccggaaagctgttccacaccctgcacaaatgccgtattgccctcggttgtgatgttcgcccccatccggttcaactcggggacgtgcataaagcggttttcaaaaatcgtttccaccacgcggcagcttccctccgccacggcattcaatgccataaactgcgcctgcatatccgtggggaagccggggtggacgaccgtgcggatgtccaccgccttcggacgctgccgcatatcgatggcgatccaatcgtcgcccgcctcaatcaccgcacctgcctcaaccagtttgtccaacaccacttccatcgttttcggcgcggcattccgcaaaaccaccctgccaccggttatcgccaccgcgcacaggaacgtccccgcctcgatccggtcggggacgacgctgtgttcgcagccttgcagctcgtccaccccttccacaatcattgtggacgtaccgatgccgctgattttcgcgcccattttgaccaggcattccgccaaatcgaccacttcaggctcaatggcgcagttttccaaaaccgtcgtaccttccgccagcgtcgccgccatcagcaggttttccgtgccgccgacggtaacgacatccatcgccacgcgcgtacctttgagtttgcctttggctttgacgtaaccgtgttcgataacaatctcagcacccatcgcttccaagcctttcaaatgctgatcgacggggcgcgaaccgatggcgcagccgcccggcaggctgacttgcgcctcgccgaaacgcgccagcgtcgggcccagcaccaaaatcgaagcgcgcatcgttcggaccaactcgtaaggggcgcaggtattgtttaccgtaccgccgttgatttcaaattcgctgatattgtcggtcaggacgcgcgcgcccatcccctgaagcagcttttgcgtggttttcacatctgccagcatagggacgtttttcaggcgcaacgtacccgatgtcagcaaacccgcgcacatcagcggcaatgccgcgtttttcgcgcccgagaccgttatttccccgttgagcgggccgtttgcggagattttcagtttgtccacgtttgttctttcctggtgggtacttgtatagtgaattaacaaaaatcgggacaaggcggcgaagccgcagacagtacagatagtacagaaccgattcacttggtgcttcagcaccttagagaatcgttctctttgagctaaggcgaggcaataccgtactggtttttgttaatccactataatatttcaattctcgggacaacgcataaagcatcacccgatgaaggttgcagaggcggaattataagggattttcgggaaaaatacggaagccgcaccaaagaatttgacgaaatgccgcgctttccgaacaaggattgtcggaagacaaaaaagccgagttttgaaaactcagcttttttgctttatctggtgggtcgtgagcgattcgaacgctcgaccaacggattaaaagtccgctgctctaccggctgagctaacgacccgataagtttggaattttacagaccggccgaaaccctgtcaagccccttgcgggcggacgggcgttatatccgcttatcggcctgtttttttcgtataaaccaaagaagtcaacaccgatgcacccaatgcgccgaacacgaccgacagcgaaacggaaatcgggatatgcacccaatgcattaccagcattttcacaccgataaaacccaacacgaatgccaatccatatttcaggaagataaagcgttccgccacatccgccagcaggaaatacatcgcccgcaagcccagaattgcgaaaatattggaagtcagcacgataaacggatcggtggtaacggcaaagacggcggggatgctgtccacggcaaacacgacatcgctcaattcaatcatgaccagcaccaaaaacagcggcgtggcgatttttttgccgttttcgacggtaaaaaatttctcgccgtgaaattccgtgccgaccggaacgactttcttgacggtattcagcagcctgctgtttgccaaatcctctttctcatcgccttcgggcttcatcatgtgtataccagtatagagcaggaacgcgccaaacagatacagaatccactcaaactgctgaaccagtgccgcgccgacgaaaatcatgacggtgcgcaataccaatgcgcccaatacgccgtacagcagcacgcggtgctgaaactgtggtgcgactttgaagtagccgaatatcatcaggaacacgaaaatattgtcgactgccaacgatttttccaaaatgtagccggtaaagaattccaatactttttcttttgcgactgccgcgccgtagccgggattgccggcgagttcaaaatacagccagcccgcgaacaggcaggatacggcaacccacaagccgctccatgccaaggcttctttgacgccgactttatggctgccgtttttcttcagcgaaaacatatccaaggcaatcatgaccagcactgccgcaaaaaaaacgccgtaaaacaacggcgaccygatgccgggatattctgtcatggttcaatctcctgatttgaaatgtaattgtgttaccagctgatataaaacatcgcttttgccaaaaagacaatcagcagcatatgggtaaagacgacggcgtgtatgtatttcgaccaaccgaccgtcagtgtggaacgcgccattttgacgacggcgatggcgaagtgcgccaatacgctgaacgccaacaggattttcagcgtcagcatcgtaccgaaggaagtggcaaacggttcgcccaatatagaaagatagcggtttgccgccatcacgatgccgctggcgaacagcagtccgaccacaaacggcatcaccctgacggcgcggtaagacattgccttttccacttcgcgccgcgcctcgcgcgacacccgtcccgtatgcaggacggacaaaaccagcacttcaaaaaacacgccgccgacaaaggcaatagcgcaatacagatgaacgatgtgcgcgacggcataaatactcatacgatgctccaaacggaaaactcggatacggattgtatcactatcgcccccgatatccgcataccgcttcccgcaccgcctcggcgattctcgcgcccgctccgcgatgttgtgcgataaagccgtccacgcgcgcctgcatctgcatcccccccccctcggacgataaggttttttcaacggcttcccgccacgcatccgccgattcgacttgaaccgccgcacccgatgccaaggcgtgtcggcaggcttcggaaaaattgtaggttgaaaagccgaatatcgtcggaacgccgcaggaaagcggttcgatgatgttctgacaacccgaatcgaccagactgccgccgacaaaagcgacatcggcgcacaggtaatacgcatacagctcgcccatactgtcgcctatccacacctgcgtatcaggttcgaccggcaaaccgtcgctgcgccgctgaaccttaaacccgaagcgttttgccgtttcaaataccgtctgaaaatgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtaggttgtcgaagcggtatctccgcccttgcccgtccagttggtatggaaaaactcaccgcgcggtttgtcggtgcgctcgtaagtgtgcgcgccgaagtagtcgcgctgtgcctgcaagaggttggcaggcagacgttcggtcgtgtagccgtccaagaacgtaatcgccgaagccatgcagggcatagggatgccgcattcgaccgccttggcaaccaccttgcgccacgccggcaggcagttttccaaaatatttttgaaatacggatccgcacccaagaacaccaaatcgggattgttttcatacgcgtcgcggatattgcttaagaatgcgctgcgaatgatgcacccctcgcgccacagcagcgcagtgttgccgtagtccaaatcccagccgtagctttcgcccgcttcgcggatcagcataaagccttgtgcgtaggaaatgattttagatgcaagcagggcctgtctcaacgcctcgacccattcttgtttgccgccttcgacgggcgtaacggttcgggcgaacagtttgccggtctgcacgcgctgttctttgaacgacgaaacgcagcgggcgaatacggcttcggaaatcagcgtcagcggaatacccaaatccaaagcattgatgcccgtccatttgcctgtacctttttgccctgccgtatcgaggattttctcgaccagcggttcgccgccttcgtccttatagcccaaaattgccgctgtgatttcaatcagataagaatccagctcggttttgttccactcggcaaacacgcggtacatttcgtcgtaagacagccccaagccgtctttcatgaactggtacgcttcgcaaatcaactgcatatcgccatattcgatgccgttatgcaccattttgacaaaatgccccgcaccgtctttgccgacccagtcgcaacacggttcgccctgcgacgttttggcggcaatcgcctgaaaaatcggcttgaccgcatcccaagcgcgcttatccccgcccggcataatggacggcccgcgccgcgccccttcttccccgccggacacgcccgcgccgacaaacaaaatccctttttcagcaaggtaatgtgtccgccgtgtcgtgtcggggtaattggcattgccgccgtcgataaggatgtcgccttcttccaacagcggaagcagttgttcgataaattcgtcaaccaccgaaccggcacgaaccatcatcataatttttcgcggtttttccagcttatcgaccaaatcttgcaaagaatacgcgccgataatattagttccttttgccgcgccgtttaaaaattcgtccaccttggcagtcgtgcggttgtaggcaaccaccttaaatccgcaatcgttcatattcaaaatcaggttttgccccataaccgccaaaccgattacaccaatatcgccgttcattgcaggaagctccgttatagatttaatttatcgaccgcaactctacccgatttacacttgtttaacaatccttaactttttaattttttgaaaagatgcctttacgctttgctgtaccgttttgctgaagggttataaataaaatataaaatttaaataataaaacgatgattatattgataggagaaattttctgtgggtaacttttttttattttaaaaatcatcaggatttcttttttttagggtgtcggtaaggcggattcccttttgtgcatacctgtggattgtttttcatgaagaatagtttttgtggacagtttgcttgttgtgcaaatggcatcctacttttctttaccgaatggctgccgatgtctttaagaaccggaatactgtggaggtttgagaggaaagtgtgtttggaacttgtggaaatggtcaggtgtcggcacgaatgtcttatttctgcatatcggcagagtgcgcatccgaatttgtgtataagtggtggaaaaaatgagatttgcgggtaaatctcacaatatttcagtcagataactttggattgcttgtgtataagtaaactttcggatggggatacgtaacggaaacctgtaccgcgtcattcccacgaacctacattccgtcattcccacgaaagtgggaatgatgaaattttgagttttaggaatttatcgggagcaacagaaaccgctccgccgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatccagaccttagaacaacagcaatattcaaaggttatctgaaagtccgagattctggattcccactttcgtgggaatgacgggattttaggtttctgattttggttttctgtttttgtgggaatgatgaaattttgagttttaggaatttaccggaaaaaacagaaaccgctccgccgtcattcccgcgcaggcgggaatccagaccttagaataacagcaatattcaaagattatctgaaagtccgggattctagattcccactttcgtgggaatgacggcatcagtctgccgtttacagcacggtttctttagattttacgttctagattcccgcctgcgcgggaatgacgaatccatccatacgaaaacctgcaccacgtcattcccacgaacctacatcccgtcattcccacaaaaacagaaacctcaaatcccgtcattcccgcgcaggcgggaatctagacttgtcggtgcggacgcttatcggataaaacggtttcttgagattccgcgtcctggattcccactttcgcgggaatgacgaattttaggtttctgttttggttttttgtccttgtaggaatgatgaaaatttaagttttaggaatttaccggaaaaaatagaaagcgttatccacaagttctgatgttcagctcgtgaaatgcgtcgggcaaatcatcgctgtcggcaaattccacccggtcgtaagccgtttcgtctgccaaaaccgcgcgcaagagtgcgttgttgatggcgtgtcccgatttgtagccttcaaatgcgccgacaatcggatgtccgacgatatacaaatcaccgatggcatcaaggattttgtggcgcacaaactcatcgggatagcgcaagccttcaggattcaggacatccgtgtcgtcaatcacgatggcgttgttcaaattgccgcccaaacccagattgtgggcgcgcatcatttccacttcgtgcataaagccgaaagtgcgcgcgcgcgcgatttcgtcgatgtaggatttgccggcgaaatcgatttcaaaagtgggcgagctgcggttgaaaaccggatggtcgaattcgatggtcagcgttaccttaaagccgtcatacggcgtaaagcgcacccatttgcccgcttctttgatttcgacaggcttgaggattttcaaaaaacgcttttgcgccttttgatcgaccacgcccgcatcttgcaaaaggtaaataaacggcaggctggagccgtccataatcgggatttcgggcgcgttcagctcaatcagcgcattgtcgatgccgtaggcggacagcgcggacataatgtgttcgatcgtgccgacgcgcacgcctttgtcggtaacgatggtggaggaaaggcgggtatcgttgatcaaataaggggtcagcttgatttgttcgcccatctcgccgtccaaatcggtacggcggaaggaaatcccgctgttttcaggcgcggggtgcagggtcagcgcgacgcgttcgcccgaatgcagcccgacgccggtaacgctgatggatttcgccaaagttctttgcagcataaaccgcttccttatcaagggggtaagttttggaataatacgataaaaccggaaaaacaggctatgtttttccatagtatttgccaatgtatccgttttcaatacgtaagccgcataaaaatgtatagtggattaacaaaaatcaagacaaggcgacgaacccacccccctcctgaaaaacgcaaaaaatgccgtccgaaaacctttcggacggcattttcgcgtaaaccgtcattcccacaaggacaaaaaaccaaaacagaaaaccaaaaacagcaacctaaaattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcggcttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgtaaccggccggttgccgtcattcccgcgcaggcgggaatctagacattcaatgctaaggcaatttatcgggaatgactgaaactcaaaaagctggattcccactttcgtgggaatgacgcggtgcaggtttccgtacggatagcttcgtcattcccgagtaggcgggaatctagtccgcttgttcggtaaatgagagggcggattgcgcgcctgtcagataaaccacgtgtttaaacgggcggcaatgaggtacgcgcagagccttgaagcgcaatcgatatattattttcagccaaaacggacgcccccgcttgccttgcaaacctttaaaaaggaagccacccggattaatccgagtggccgtggaaaatcacttaccgcttgatttatttaaaatttatggtataatttaccttagctggcatcacttgcgtcgcggcaggttgacggcaggtgcttggtgtcaatcttcttaccgttggcggcggcggcggcggtaacgtcgtcgttggcggctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaagtgttgttgccgggccattcgccgtgattcaggtaatactcggtaacggctgatttttgaccttcggccaaaagaatggcttcggaaacttgtgcgcgggctgtgtagtcttgataagcaggaagggcgactgccgccaaaatgccgacgatggcaatcacaatcatcagctcgataagggtaaaacctttttgaagggtgttcataaaattactcctaattggaaaggaaatgcctcaagcttacgccatcggcattatgcaatgtatttgaccatcggtattttgttgcgatacctgtgtattataaagcaagattggtaccaagtttgtattttgaggtgaaaatttatgcgtttatctctatgtaattgtttttattttacattttctttcgtttggcgtggtttgagtaattagggggttgccgttttttgtcagcagtgttgaaaattgtcagttttagtgccgattttcggcacttttttattggcgtggggtatctctattggcatggggcatcgggtgtgttgattgggtcggaatttgagatttttgaatttgcgcggtagcatagggtgggttgggtgggaaattttaaatttaatttttaaaaatttccgttttcttggaaagtgattgaaatcggcgcgtggtgttcctgtgcaaccggcagttgaatcatcgcggcaggtttccgtgcggatggcttcgtcattcccgcgcaggcgggaatccagccttgttggtacggaaacttatcgggaaaacggtttcttgagattttacgttctggattcccactttcgcgggaatgacgcggtgcaggtttccgtatggatagcttcgtcattcccgcgcaggcgggaatccaggtctgtcggcacggaaacttatcgggtaaaaaggtttcttgagatttttcgtcctggattcccactttcgtgggaatgacgggatgtaggttcgtgggaatgacggtttaggtatttttatagaaagccgtaggtggtgtttctatgcaaacgacagatgaatcatcgcggcaggttgacggcaggtgcttggtgtcgattttgtcggtgccggtggcggcggcggtaacggcgtcgtctttggcgttgtcggcgcgcgtaaccggcagtccgcagaaccattttaccgaaccggcttgacgcttggcccacagggagagttttttgcctttgatttcgttgtttacgttgcttgaagccatttgggcggtaacgacgccgtttttgacttcaacgcttttaacatatttgcctttgatgtcggcggaggttgccacgccggcagaactgttgttgccgggccattcgccgtgattcaggtaatactctgtgacggctgatttttgaccttcagccaaaagaatggcttcgtcattcccgcgcaggcgggaatctaggtctgtcggcacggaaacttatcgggaaaacagtttcttgagattttgcgttctggattcccgctttcgcgggaatgacgggattaaagtttcaaaatttattctaaataactgaaattcaacgaactagattcccactttcgtgggaatgacgaattttaggttgctgtttttgtgggaatgatgaaattttaagttttaggaatttatcgaaaaaacagaaaccgctccgccgtcattcccgcgcaggcgggaatccagcctcgtcggtacggaaacttatcgggtaaaaaggtttctctagtttggtgtcgattttcttgtcgatgctgttgacggcaggtgcttggtgtcgatctgcttgccgttggcggcggtgtcggctttgacggcgtcggcgctggcgttgtcgcgcttaaccggctgtccgtagaaccattttaccgaaccgtcttgacgcttggcccacagggagagttttttgccttggatttctttgtttacgccgcttgaaagcattgtggcggtaacgacgccgtttttgacttcaactttctcaacatatttgcctttgatgttggcggaggttgccacgccggcagaactgttgttgccgggccattcgccgtgattcaggtaatactcggtgacggctgatttttgaccttcagccaaaagaatggcttcgtcattcccgcgcaggcgggaatctagaccttagaacaacagcaatattcaaagattatctgaaagtccgggattctagattcccactttcgtgggaatgacgaattttaggttgctgtttttggttttctgtttttgagggaatgatgaaattttaagttttaggaatttatcagaaaaaacagaaaccgctccgccgtcattcccgcgcaggcgggaatccaggtctgtcggtacggaaacttatcgggtaaaacggtttctctagtttggtgtcgattttcttgtcggtgctgttgacggcaggtgcttggtgttgatgttggcggtgcccttgccggtggcggcggtgacggcgtcgtctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaactgttgtcgccgggccattcgccgtgattcaggtaatactcggtaacggctgatttttgaccttcgaccaaaaggatagcttcgtcattcccgcgcaggcgggaatccagccttgtcggtacggaaacttatcgggtaaaacggtttctttagattttgcgttctggattcccactttcgtgggaatgacgggattaaagtttcaaaatttattctaaataactgaaactcaacgaactagattcccgcttttgcgggaatgacgaattttaggtttctgttttgggttttctgtttttgagggaatgatgaaattttaggtttctgtttttggttttctgtccttgtgggaatgatgaaattttaagttttaggaatttatcggaaaaaacagaaaccgctccgccgtcattcccgcgcaggcgggaatccagcctcgtcggtgcggaaacttatcgggaaaacggtttctttagattttacgttctggattcctactttcgtgggaaagacgaattttaggtttctgtttttggttttctgtccttgtgggaatgatgaaaatttaagttttaggaatttatcggaaaaaacagaaaccgctctgccgtcattcccgcaaaagcgggaatccagcctcgtcggtgcggaaacttatcgggtaaaaaggtttctttagtttggtgtcgattttgtcggtgccggtggcggcggcaacgtcgtctttggcgttgtcggcgcgcgtaaccggctgtccgcagaaccattttaccgaaccggcttgacgcttggcccacagggagagttttttgcctttgatttcgttgtttacgccggttgaaagcattgtggcggtaacgacgccgtttttgacttcaacttccttaacatatttgcctttgattgttgaagaagatgccacgccggcggcatcattaaatcccgtcattcccactttcgtgggaatgacgggattaaagtttcaaaatttattctaaataactgaaactcaacgaactagattcccgcttttgcgggaatgacgaattttaggttgctgtttttggttttctgtccttgcgggaatgatgaaattttaagttttaggaatttatcgaaaaaacagaaaccgctccgccgtcattcccgcgcaggcgggaatccagcctcgtcggtgcggaaacttatcgggaaaacggtttcttgagattttgcgttctggattcccgctttcgtgggaatgacggtttaggtatttttatagaaagccgtaggtggtgtttctatgcaaacgacagatgaagcgtcgcggcaggttgacggcaggtgcttggtgttgatgttgtcggcggtcttggcggcggcggcgacggtgtcggctttggcgtcggtgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgttgccgggccattcgccgtgattcaggtaatactctgtgacggctgatttttgaccttcggccaaaaggatagcttcgtcattcccgcgcaggcgggaatccaggtctgtcggtacggaaacttatcgggtaaaacggtttctttagattttgcgttctggattcccactttcgcgggaatgacgggattaaagtttcaaaatttattctaaataactgaaaccaacgaactagattcccacttttgcgggaatgacgaagtttttctgccatttgccgtgattcgggcaatactcggtaacggctgattttttgaaagtgtttgaaatcggcgcgtggtgtttctatgcaaccggtagatgaatcatcgcggcaggttgacggcaggtgcttggtgttgattttgtcgtcggtcttgccgttggcggcggcgacgtcggtggcggtggcggtggcggtgtcgttgcgcgtaaccggctgtccgcagaaccatttgaccgaaccgttttgacgcttggcccacagggagagttttttgcctttgatttctttgtttacgccgcttgaaagcattgtggcggtaacgacgccgtttttgacttcaactttctcaacatatttgcctttgatgtcggaggaggatgccacgccggcggcatcattaaatcccgtcattcccgcaaaagcgggaatctagaactcaggaccggagaaacctttttacccgataagtttccgtgccgacagacctagattcccgcctgcgtgggaatgatgggattaaagtttcaaaatttattctaaataactgaaactcaacgaactagattcccgcttttgcgggaatgacgaattttaggtttctgtttgtgggtttctgttcttgtgggaatgatgaaattttaagttttaggaatttatcggaaaaaacagaaaccgctccgccgtcattcccgcgcaggcgggaatccagccttgtcggtacggaaacttatcgggtaaaaaggtttctctagtttggtgtcgattttcttgtcggtgctgttgacggcaggtgcttggtgttgattttgtcggtgtcgggtgtggcggcggtgacttcgtcggtgccggctttggcgttggcggcgttgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgtttttcggccattcgccgtgattcgggtaatactcgggtgtttttgtgcaaacggcagatgctgcgtcgcggcaggttgacggcaggtgcttggtgttggttttcttgttgccggtgttgtcggcggcgacggtgtcgtcggtgccggcgcgcgtaaccggctgtccgcagaaccattttaccgaaccgttttgacgcttggcccacagggagagttttttgccttggatttctttgtttacgccgcttgaaagcattgtggcggtaacgacgccgtttgcgactgtaacttccttaacatattttcctttgattttagaggaggatgccacgccggcggcatcattaaatcccgtcattcccacgaaagtgggaatctagaactcaggaccggagaaacctttttacccgataagtttccgtgccgacagacctggattcccgcctgcgcgggaatgacgaagtttttcggccattcgccgtgattcgggcaatactcgggtgttttgtgcaaacggcagatgctgcgtcgcggcaggttgacggcaggtgcttggtgtcaatcttcttaccgttggcggcggcggcggcggtaacgtcgtcgttggcggctttggcgttgtcgcgctcaaccggctgtccgcagaaccattttaccgaaccggcttgacgcttggcccacagggagagttttctgcctttgatttctttgtttacgccgcttgaagccattatgtcagacggtattgcccgggcagctttattcgtacactttcagcagctcgacttcaaatatcaaagtggcgtgcgggggaatcacgccgcccgcgccgtgtgcgccgtagcccatttccgaagggatggtcagcttgcgtttgccgccttccttcatgccgccgaagccttcgtcccagcctttgatgacttgtccgacaccgagcgtgatggtcagcggctggcggcggtcgaggctggagtcgaatttggttccgttttccagccaacctgtgtaatgcacggtaatctctttgcctttaactgcttcttttccgaagccttcttgcaagtcttcaataatcaggccgcccatatttgtcctttcgttgcttgttggtcaaaacggcaagggtaacataccgt

SEQ ID NO: 37787 - DNA, 27671 bp, Neisseria meningitidis
aattaataataattatcattatattaatatgtacagataatatcaagccgtttttatagtgaattaacaaaaatcaggacaaggcgacgagccgcagacagtacagatacattccgtcattcccacgaacctacatcccgtcattcccacgaacctgcaccacgtcattcccacgaaagtgggaatccagttcgttcggtttcgcttgttttaagtttcgggtaacttctacttcgtcattcccacgaacctgcatcccgtcattcccacgaaagtgggaatccaggacgcaaaatctcaagaaaccgttttacctgataagtttccgcactgacagacctagattcccgcctgcgcgggaatgacgggatttgagattgcggcatttatcgggagcaacagaagccgctctgccgtcattcccacgaaagtgggaatccagttcgttcggtttcgcttgttttaagtttcgggtaacttccacttcgtcattcccacgaaagtgggaatccagttttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgaacctacattccgtcattcccacgaaagtgggaatccagttcgttcggtttcgcttgttttaagtttcgggtaacttccacttcgtcattcccacgaacctgcatcccgtcattcccactaaagtgggaatccaggacgcaaaatctcaagaaaccgttttacctgataagtttccgcactgacagacctagattcccgccttatatgatgcgctctatcaaaggggcgcattaattttcttaacattcccctttgacagccaagtgaaaggggcttttttatgtcagcagtaaatgtaatattttcctgttcttattggagaatatttaaaaaatcagattcttgtgttttgtgtttttatcagttcagacatggcgaaccgcataaactcattaatcaagagaatttttcaaagctttatcaggcgttcgattatatagattcggttggttcgaattttccagtgattatcacaacggatggttgtggtcttttttgttgatctttaaaagtttgtcaggatttggctttcggtcgttgaccgtcgtacgcgctttagcgcggaagacgggaaacggctgaaagccccccccttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaaaggaaatcaaaatgtttaatcaaactcaaactgtaacttatcctgcaacttttttgggagccaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcaggcagacgactatttattgtcgtcccttcctcctactgttacccaggacggaaaaatcatcaggccggaaagggtgggcgataaatggattttgaacggaaagccggttacgttgtcttatccggaatgttccaattttgagcagataaagcaaggttcttatgtcggttcgacggttctaattctgtttgtagtcatttacggtttcaggcttctgattaattttttaaaagacataggcaaggttgggactgattgatgattatagatttctggtttcttctcggtttcttcttggctttgtctgttgcttggctgttttggtaacggttggtagaatcggctttttagagtgttttaaaaggtccgaattatgtttatttctgaatatcatttagttaaatttcaaactgattcacatatttatagagatttaccacaagcgttaatttattatagggaattgattagaaaaggggtttttaaaacttcgttttcatttgatatttttaggaatttctttcatcgttatgatagagattttatagaaattcaattccctgattcttctacattattaattaaattagatgaagcaaaatgttatgtttattatcctagggcgaaattttttaaagattatcctatgctttagtttttttgtatctaaatttgcattggcatcagtaaatgctccgggtaaatttgatagggttgaagtttatgatgatggcagatatttaggtattcgaggttcagatgacaaaagaagaagaatttggaaaggtgtatttgatagagaatcgggaagatatttaacttcagaagctcaagatttaaaagttaggcatgtatctactggagcatcaagtacgggtaaagttagttcggttgtatcttcatcagtttcccgcgctggcgtattggcgggggtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatagttgcacatttgattggaacggcggagattgtgtggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgttccccctgcccccgcggcgtcgcaagtgagactgggggtgcgggggctagtccccgcaaagcctttcagcttcggaagccacggccgaaaggcaggcgcagcactgccggtctgagcggaagccaggctacaggcaggcgcagcaccgccgagctaggcggaagccaggctacaggcaggcgaagcaccgccggttgggcggaagccacggccgaaaggcagggcgaagcaccgccaggcttaggcggaagccacggccgaaaggcaggcgaagtaccgccggtctgggcggaagccatggtaaaaggcaggcgaagcaccgccgggcttcagtaacctttgttcaggcagggggaggatgtccgtaaagaatcgtaaaggcggggttttttcgcctttatgattctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggatttgagattgcggcatttatcgggagcaacagaagccgctccgccgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaacctacattccgtcattcccacgaaagtgggaatccagttttttgagtttcagtcattcccgataaattgccttagcattgaatgtctagattcccgcctgcgcgggaatgacgggattttaagttggggtcatttattggaaaaagcagaaaccgctccgccgtcattcccacgaaagtgggaatccagttttttgagtttcagtcatttccgataaattgccttagcattgaatgtctagattcccgcctgagcgggaatgacgaatccatccgtacggaaacctgcaccacgtcattcccacgaacctgcatcccgtcattcccacgaaagcgggaatccagttcgttcggtttcgcttgttttaagtttcgggtaacttctacttcgtcattcccgcgcaggcgggaatccagtgcgttgagtttcagctatttagaataaattttgaaactctaatcgcgtcattcccacgaaagtgggaatccagttttttgagtttcagtcatttccgataaattgccttagcattgaatgtctagattcccgcctgcgcgggaatgacgaatccatccatacggaaacctgcaccacgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaaagtgggaatccagctttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagctttttgagtttcagtcattcccgataaattgccttagcattgaatgtctagattcccgcctgcgcgggaatgacgaatccatccatacggaaacctgcaccacgtcattcccacgaacctgcatcccgtcattcccacgaaagtgggaatctagttcgttcggtttcgcttgttttaagtttcgggtaacttccacttcgtcattcccgcgcaggcgggaatccagtttcttgagtttcagtcatttccgataaattgccttagcattgaatgtctagattcccgcctgcgcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacggcggagcggtttctgttttttccggtaaatacccacaagctaaaatcccgttattttcacaaaaacagaaaaccaaaaacagaaacctgaaattcgtcattcccacgaacctacatcccgtcattcccacgaaagtgggaatccagttttttgagtttcagtcatttccgataaattgcctcagcattgaatgtctggattcccgcctgcgcgggaatgacggcggagcggtttctattttttccggtaaatacccacaagctaaaatcctgttattttcacaaaaacagaaaaccaaaaacagaaacctgaaattcgtcattcccgcgcaggcgggaatctggttcgttcggtttcgcttgttttaagtttcgggtaacttccacttcgtcattcccgcgcaggcgggaatccagtgcgttgagtttcagctatttagaataaattttgaaactctaatcccgtcattcccacgaaagtgggaatccagttttttgagtttcagtcattcccgataaattgccttagcattgaatgtctagattcccgcctgcgcgggaatgacggctgcagatgcccgactgtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatactgtaatcagggatgctcagttcgtcgaaacggcaaaacaggttgaagtcgatgcgggtgatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcatgagaaatctcctaaatgtcttggtgggaatttaggggattttggggaattttgcaaaggtctcaacttgagtttcacgccccgcttaacaatattcagttggtaaatattagataaaaccataaaaattaaattgatggcttttataatccccgatttgcgaaaatgccgtctgaaagtcttcattcaggctttcagacggcattttgatcatcaagtaacgctttatcaggcttttttattgttcaacgcagctttgacaaacgcggtgaacaaaggatgccctttgcgcggattggaggtaaactcggggtggaactggcaggcgaagaaccaaggatggttcggcagttcgatggtttcgaccaagcgttcgcgtccggcagatacaccgccgatgaccaaacctgcctgttccagtgtaggaacgtagttgttgttgacttcgtagcggtggcggtggcgttcgcggatatgtccgctgccgtagattttggcggcgaggctgcctgctttcaattcgacttcttgcgcgcccaaacgcatcgtgccgcccaaatcggtggattcgtcgcgggtttcgacgctgccgtcggcagtttgccattcgtcaatcagggcaacgactggcgcggcgcatttgaggtcgaactcggtggaattcgcgcctttcaagcctgccacgtcgcgggcgtattcgatcagcgcaatctgcataccgaggcagatgcccaagtatggcacgttgttttcgcgggcgtagcgcacggcggcgattttgccttccacaccgcgcgaaccgaaaccgccgggaacgaggatggcgtccatgtctttaagcatggaaacgtcgcccttgtttttctcgatgttttcgctgtcgacaaaggtaatctgcacgtcggtttcggtgtgaatgcctgcgtgtttcaaggcttcgatcagcgatttgtaggactcggtcaaatcgacgtatttgccgaccatggcgattttgacggtgtgtttcgggttttggatggcgtggacgatttttttccacgcggtcaaatccgcctgctgcacattaagctgcaactgctcggtaatgatgttgtcgatgccttggtcgtgcagcatttcggggcattcgtagatgctgtccacatcgtagctgccgacaatcgcgcgttcttccacgttgcagaacaaggcgattttgcggcgttcgtccgcaggcattgtcctgtccatacggcaaatcaggatgtcgggttgcaaaccgatgctcaacatttctttaacggtgtgctgggtcggcttggttttgatttcgcctgcggcggcgatgtaggggacgtagctcaagtgggcaaacaaggtgttgttgcgccccaactggcttcgcatctggcggatggcttccaaaaacggcagcgattcgatgtcgccgaccgtgccgccaatttcgacaatcgccacatcgtaacctgccgcgccttcgtggatgcgtcgtttgatttcgtcggtaatgtgcggaatgacttgaaccgtaccgccgaggtagtcgccccgtcgttctttggcgataacgttttcgtacacctgtcccgtgctgaagctgttgcggcgggtcatcgtggaatcgataaagcgttcgtagtgtcccaagtcgaggtcggtttccgcgccgtcgtcggttacgaacacttcgccgtgttggaacgggctcatcgtgccgggatcgacgttgatataaggatcgagcttgagcatggtaacgttcaagccgcgcgattcgaggatggcggcaatagaagcggcggcgatacctttacccagtgaggagacaacgccgccggtgacgaaaatgaatttggtcataatgaaatacccgtattggaatgcgtgattttaacgtgaagcgcgcggttctggcaaacggacggatgccgtctgaacgatggacggctgttttcagacggcatcttttctttatttcccggtactttgccgcaactcgcggcgcaggattttgccgacgttggacttgggcaactcgtcgcggaattcgatatttttcggtactttatatgcggttaattcggtgcggcaaaaagcgataagttcttctttggtcaaagacgggtcttttttgacgacgaatactttgagtgcctcgccggttttttcgtcgggaacgccgatacaggcgacttccatgactttgccgtgatgcgcgatgacttcctcgatttcgttcggataaacattgaatccggaaacaacgacgaggtctttcttacgatcgaccagcttcaaccagcctttttcgtccatgacggcaatatcgccggtttccaagaagccgcgcgcgtctatggctttggcggtttcttcggggcggttccagtagccttgcatcacttgagggccttttacccacaattcgcccggctgcccgacggggacttctttgccgtttgcgtcgcgcagttcgacttcggtggacgagacgggcaaaccgatgctgccgctgtatgattcgatgtttaaggggttgcagcacacgccggggctggcttcggtcagaccgtaggcttcgacgatgggcgtgccggtgatttttttccatttttcggcaacggctttttgggtcgccataccgccgcccaaagtcagccgcaattctgaaaaatcgacttcggcaaaatcaggacggttaaccatcgcgttaaacagcgtgttcacgccgataaatacattaacccgctgttttttcagttctccgataaagcctttcatatcgcgcgggttggtaatcaggatgattttcgagccggcattggcaaaaatcatcagattcacggttaaggcaaaaatatggtacagcggcaaggcggcgataacggtttctttgccctcgcgcaactggtttttaatccattcttttgcctgaagcatattggcgcagatgttgccgtgactcagcaccgcccctttggcaacacctgtcgtgccgcccgtgtattgcaacagcgcggtatcttcgcggtttaatgcgacaggttggaaaacgtgcttcgccccttctttcaatgccgtctgaaaggaaacggtttcccgaatacggtattcgggcaccattttcttgattttccggatgacgaaattgatcagcgaacctttaagcagcccgaacatttcgccgacggaggctacgatgacgtgtttgatctgcgtgcgcggcagcaccagctccagcgtgttggcgaaattttccaaaacgatgatggcggtcgcgccgctgtctttcaactgatgctccagctcgcgcggggtatagagcggattggtgttcaccgctaccaaacctgcctgcaaaatgccgaaaagggcaaccggatattgcagtacattgggcaacattattgccacgcgctctcctcgaggcaatttaaggacgttttgcagataagaagcaaaatctgttgccagtttgccggtttcggcataagtcagcgtcttacccatgttttgaaaagcaggttggtcggcaaatttttccacgctttggcggaatacgtcgctgacggaattgtattgcgtgatgtcgatttcggcactgacgcccttctcgtagctgtctaaccagattttttccataggtatcggtctttaaagtggaattgagcggaacaatgccgtctgaaaaccgtttcagacggcattacctttatcgtgtgatgatgacgggtttgtcggtcgtttggatgataccgccgcccaaacagatatcgccgtcgtacagcacggcggactgacccggcgtaaccgcccattgcggttcgtcaaacaccagctcggcggtttcatcatccaaatagcgcaactcacaaggcgcgtccgccatacggtaacgcgttttgcaggtatagcgtcctgccttcgggcgttcgggcagcgtgaaactcaaatcgttcatcacaaggctgcgggtataaagcagcggatggtcgtgtccttgcacgacaatcagttcgtttttcgtcaaatctttagccgcaacaaaccacggttcgcccgcgccgccaatgcccaaacctttgcgctgtccgagcgtgtagaacatcagcccgacgtgttcgccgacggttttcccttcgggcgtaaccattttaccattgtcggtcggcaggtatttctgcagaaactcgcgaaacgggcgttcgccgatgaaacagatgcccgtgctgtcttttttagcggcggtcggcagtttgaactcggcggcaaggcggcgcacttcgggtttttccaaaccgcccaacggaaaaatcgcgcgctcgagttggaaaggcttgaggcggtagaggaaatagctttggtctttgtttcgatccaaacctttgagcaggtaatgcacgccgttgcgaacttctttgcgcgcatagtggccggtggcgatggtatccgcgccctgccctacggcgtagtccaaaaagcatttgaatttgatttcggcgttgcacaacacatccggattcggcgtgcgccccgcactgtattcctgaagaaaataagcaaagactttgtctttatattgcgcggcgaaattaacgatgtcgatatcgatgccgataatatcggcaacggcgatggcatcgaacgaatcctgtttgatgctgcaatattcgtcgttgtcgtcgtcttcccagttctgcatgaacacaccgcgcacttgataaccctgctgcttgagcagggcggcggttacggaagaatcgacaccgccggagagcccgacgatgatattggaagggtttgctgtcgtattcatgcgtagaatatggttggaaacggcggtttttaaaggcggattttaacacattttaaaggcgggcataaaaatgccgtctgaaagcccgggctttttcagacggcatttcaaacattttcagcagattagtgctgatgcgcttcgccgtggtgatgaccgtggttcattgccggcatcggcgcgattttgacttccagttggacggtttgcgctttggcgtttttaaatttcagggtaacgggaattttatcgccctcttttaattgttttttcaaacccataaacatcacatgatagctgccgggtttgagttcggtaacggatttcgcttccaaaggcacgccgccttcgacttcgcgcatccgcatcacgccgttgtcgttgatgtgggtatgcacttcgacgcggtcggcaacggggctgcttccgccgagcaaaaagtcttgtttggcttcgtcgttgtggattttcatgaacgcgccgcctattttcataccttcgacggtggtgcgcgcccagccgtcctcaacgtggactccggcggcggaaaccgcgcctgccaaacctgccatcatcacggccgccaataattttttcatctttctgctccttataatatcagacggggaatgtgcttaatcttatagcggattaacaaaaaccagtacagcgttgcctcgccttagctcaaagagaacgattctctaaggtgctgaagcaccaagtggatcggttccgtactatttgtactgtctgcggcttcgtcgccttgtcctgatttttgttaatccactatacatacaaatactgcctggaaatttgatgtagattaagtgaataataaataccacatactaatcctaaaggattacaaatcctgctgcaagcgttttacccgaacagggcagacagccaaaccgccgccaacatcagcatcgcgaacaattgtgcggcagaacctgcgtctttggcgagtttggccagctcgtgtttttcggtcgaagtatgatcgacggcagcttcgacggcggtgttgaacagttcgacaatgaccgacacaaaagacgcgataatcaacggcaggcggacggcggtttcggaaacccaaaaaaatgccgcgcacaccagcagtacgttcagccacaaaacctgacggaatgccgcttcgtaacggtaggcggcggcgatgccgtctatcgaatagccgaatgcgttaatgacgcgcctgatgccgcctttgccttttttttctgccgcgtaggaggaaggttccatcggtatcctttcaaaatgttctcaatatagtggattaacaaaaacctgtacggcgttgccccgccttagctcaaagagaacgattctctaaggtgctgaagcaccgagtgaatcggttccgtactatttgtactgtctgcagcttcgccgccttgtcctgatttttgttaatccactatatataccgtctgaaaacggggcggcggggtgtccgtacggtattaagcgtatccctgccggctgagagaaaaccctgcctgcccaatcaaaccaggcggttgtgaagcaaaagcctttcagacggcatcggtttaacgtaccgaccacgcggcaacggcatcggcaaacattgccgccacatcgaaacctttttgtttcataatttcttggaatccggtcgggctggttacgttgacttcggtcaggttgctgccgataacgtccaaaccggccagcaggatgccgcgccgtttgagttcgggggcgagcgtttcggcaatttcgcggtcgcgtccgcccaattcctgcgccacgccgcgcccgcctgccgcaaggttgccgcgtgtttcgccgttttgcgggatacgcgccaaagcataggggacgacttcgccgccgataatcaggatgcgtttgtcaccgtgtacgatttcgggaatgtagcgttgcgccataatggtgcgggaatcaagctgcatcagggtttcgaggatgctgccgatgttggggtctttttcggtcaggcggaaaattcccataccgcccatgccgtcgagcggtttgatgatgatgtcgccgtgttctttcaaaaatgtgcggacatcggcggaacgggtcgttaccagcgtgggcgcgataaagcggctgaagttcaaaatcgccagtttttcattaaagtcgcgcatcgcctgtccgctgttaaagaccttcgcgccctgctgttccgccagcgtcagtaattgggtggcgtagaggtattgcatatcgaacggcggatcggtacgcataatcacggcatcaaatgcttccaatgccgtctgaactttgtcggcagatttgaaccacgcatgatcatcatcgttttttgcacccaaaaattcaaatgccgatgcctgcgccgttaccaaaccgccgtttacagacaattccccgctcaatgtgtgaaacagccgccagccgcgttttgccatttcgcgcatcatcgcgtaggtggtgtctttataggttttgaaacttgccatcgggtcggcgataaagaggactttcatcatatttcctttccggtgtgccgaatgtgccgcatttcgcgggtaaaggagaaattccgcccgaacaatattcagacggcagggatggggttttacttaggctgccaagagtctttcagcgttaccgtgcggttaaacaccggcgtgtctttgccgtggtctttacggtcggttacgaagtagccgatacgctcgaactgccaacggctttctgccggcaaatctttggcggcaggttcggcgtaggcggtgatttccttgacggattccggattgaggaaatcggtgaacggcaggtattcgccgtcttcgccgcgcacggcatcgggacgctcgacggtaaagaggcggtcgtacagacggactttgatttcggcggcgtgttcggcggaaacccaatgaatcacgcctttaactttacggccttctggatttttgcccaaggtgtcgtggtcgatgctgcatttgagttcaaccacattgcctgcttcgtctttgacgacttcatcgcacttgatgacatagccgtggcgcaagcgtacttcgccgccgggaatcaggcgtttgaagcctttgggcggattttcggcaaagtcgtcggcttcaatatagatggtttgggaaataggtacttcgcgctcgcccatttcctcgtggttcggatggaacgcggcacggcggctttgggttctgccggtttcaaagttggtcagggtcactttgagcgggttcaacaccgccatcaggcgtggggcggaattttccaactcttcgcgaatcgcgccttccaacacgctcatatcgacgatgttttcagatttggaaataccggcgcgtttggcaaacaggcgcagcccttcgggcgtgtagccgcgtcggcgcataccggaaatggtcggcatacgcggatcgtcccagccggaaacgtgtttttccacaaccaactgattcaatttccgtttggaggtaatggtgtacaaaagctccaaacgggaaaactcgtattggcgcggacgggtggcatgcggcgcaggaatgttgtccaacacacagtcgtacagcggacggtgtgcttcgaattcgagcgtacacaaggaatgcgtgatgccttcgatggcatcggagatgcaatgcgtgtagtcgtacatcgggtagatacaccatttgtcgccggtgttgtggtgatgggcgcggcggatgcggtagatgacggggtcgcgcatattgatgttgcccgatgccatgtcgattttcaggcgcagggttttgctgccgtcggggaactcgccgtttttcatgcgtgtgaacaggtcgaggttttcttcgacgctgcggtcgcggtaagggctgtttttacccgcttcggtcagcgtaccgcggtattcgcgcatttcttcgggcgtcaaatcatcgacatacgctttgccgtctttaatcaaaccgacggcgtagtcataaagctggtcgaaatagttggaagcgaaacgcggctcgcccgcccaatggaaaccgagccactcgacatcttctttgatggcgttgacgtattcgtcgttttctttttcggggttggtatcgtcaaaacgcaggttgcacaagccgtcgtaaatatacgccaaaccgaagttcaggcagatggatttggcgtgtccgatgtgcaggtagccgttgggttcgggcgggaaacgggtttggacagctgtatgtttgccgctttcgaggtcttcttcgatgatggtgcggataaaatggttgtccgcaaattggtctttattgagcatagttttctttgaacagatggcttcagacggcattggaatgattccgtatgccgtctgaagcggtttgggaatgtgtttattgtacccgacttgcgcgctttgacatagcgttcagacggcatcggcaatcaagcattccacccccgcctctttcagcatcttctgcatcgcggtatcgggcagccggtcggtaaatactttgtcaaacgccgtaatgtcgccgagcctgaccagcgcgttgctgcggaatttactgtggtccacgccgaggaagcggacgcgcgcattggcaatcatcgcctgcatcacgctgacttctttgtagtcgtcgtccaaaagcgaaccgtcgctttccacgccgtgcgtactcatcacggcataatcgactttgaactggttgataaaatcgacggttgccacgccggtaataccgccgtccaaagggcggacgactccggaagtgatgatgaccgtataatccgtccgcgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgcctccttgcatcgggatgccgattttaccgcgttcaacccaaagcggaaaacaccaccatcagaaacggggcggcgatattgaccaccacgccgaagctgaccgctaccggcacgacttccaaaccgcccgcaccctgaatcacgggcaatgtaaaatccatactggtcgcaccgccaacccccaccgccgcatctggaaaacgcttcatcagcagcgggataaatgccagtgcaaacagctctcgtgccaaatcgttcagcagcatgatgctgccccataccgcgccgtaagcctcggtcatgaccaaacccgagagggaataccaaccgaagccggaagccatcgccaaacctttcgtccacgacacaccgtctgtcgatgcggcaaacagcagcccgcccgaaagagatgaaagcataaaccagaccgacaaccgaatacccctgcggttgaccaaaacctgccgcaacgatacgccgctgcttttgagctgtacgccgatgaggaacaccagcagcatcagacaatacatgcccgcgctttcagacggcatccaaatatcgcgcatcagtttgccgaatgcaaatccgagcagcacgcatccgagctgccccacactgcccgacacgccgaccgaaacgcccttccctttcccctttatccgccacgggaataactttcccaacactgccaaagcaagcaggttcgccccgaccgtacaaacaaacagccacagaaccgtcaacgccatatcgtccaaccgcgaacccaaatcctccacgcgcgacaacgagacgccgatcagcagcagcacagcatacaccaagaccgatagcaccttatccaaagcgggcaggtaaggcttgggcacacggataaaaaatccggcaaacatcggtatcaataccgaaagcaacgtcatcaggctgtccatctactgctctcctttattgccgcatgatatgtgcggtttaaaaattgccgtctgaaaattgcagatacccgcatccatatttcagacggcatcaggttcgccattaaaaaaccgcctgaaggttcaggcggcttatccgctccggcattcaatcttccaaagtcttttccaaacgctccatacagttgcccaaatggcggcgcaggattttgaccacgcggttgcgcctgcccgccagcagcaggtcgaggatttcgcggtgttcggaatgcgtatgcgtattgatggcgtgtttttcctcgcgatgcacgcccgccacggcgacaatcagggaagaccgcgcgcacagcgtattcataatgtcgaacagcacatcgttgcccaccaggcgcgccagttcgacgtggaaggcattggacaggcggttccagccgacgcggtcgcccctgccggaggcctcttcttcgcgccgtatcatcgcataaagcggcttgaggcgcgtttccaaatccggcaaatctgcgaggatattcaaaatcatcgtctccatttcgatgcgcgcattgaacacatcctgcatttctttcaaatcgggaacgtggacgaacgcgcccctgttgggttgcaaatcgacaatcttgtcgtgcgccaaaagcgacagcgcgccgcggacggtgttgcgcgaacacaccatctgacggcaaagttcggattcggtcagctttttgccgggcagcagcacctgatcggtaatgccgtccaaaatcagggcgtaaacacggaacagctccgaatcgtgccgctcttcgagaatcagggaagacgtggtcggcgcatggataatgtcgtcgttttcaaagttcatgatgttttccgtatttttacgctttcaaattttttaagatgttttaaggcggctgtgtttcaaatcgtgtcagaggaattaaagcattgcacaaatttattttatagtggattaacaaaaatcaggacaaggcgacgaagccgcagacagtacaaatagtacggaaccgattcacttggtgcttcagcaccttagagaatcgttctctttgagccaaggcgaggcaacgccgtactggtttttgttaatccactataattcaataaattaatatatggcttaaaataacgggattctcgcctcccgcccgcccgcagaagcaggcggatatcattttaaaacgcggcatttaaaatttgaccgaaaattgttgacaatccggaatcaagtctgcacaataccccgacaagtccaagtattataaaggctgaataaagaggaaacagcaggcagatatattcgggaggtgcagtccgaatatatctgcttttttatgcgcctccggattgcctgccgcacctttcccttcagacggtatcagccgtttccccataatgccgcccgatgcctatttatctgccccggcaatttcaaaactgtgggtaatctttgccgctttgcccaacataatcgaagccgaacagtatttttcggcagacatctgaacggcgcgctcaatggccgattctttcaaatcatgcccgaatactttgaaatggatgtggatttcggtaaacacgcgcggcgcatcgtccgcccgtttcgccgtaaccgtcgcacggcagtcagtcactttctgacgctgtttttcggcaatcatcaccacatcgatgctcgaacagcccgccacgcccaacagcagcatttccaaagggctgggcccgcgcttagccttaccttctgccgccgacccctccataacgacgctgtgcccgccttccgtcgtgccgacaaaacacatcccgtctatccattttgatgtaacctgcatggtgtcattcctgaaaatagcgttaaaaccgctttgcatatggcgttattgtaaacaatttcaagcggcttatgcagaaatatggacaaaacggcaaaaaaacacttgaaaaccgatttacggtttggctgcctggccgttgatctgcaccgatttgagtttcagcgtataggttttgccgtcgtcggtatagccgatttgtgccggaatattgttcagggacggtgcgaagaaatacattaccgcatcgtcgccgcgccgcacccgatatttgacgacttcggtttccacgccgcctatgctgtattttcctgtacccgccttattcaaaccgccgacggaataaagttttttgccgttggtgattttcagccccggggggagtttcgcgtcatttgccgccaactgccaggcaagcgtgaacaaatccatagccttggggctttgctcggttttgctctcgcccgctttgccgtaagttacgctgccgtcggcgaatttggcttccgcatacagtttgcccctgcgtatgtctctatagtaggtagggtgcagggtattgccgacaaccgtaccgccggactcgaaacggatattgtatagcggcactttaatcgtcgaaacgattttgtaagcattgccgctgcgttcaaatgtcatcgtggcgggaatgccgtagctgccggaatagtgcagcacggcggattggggcagccctgccgcatacgcgcacggcagggcggcggacaaaatggcggcggaaaatatatttttaaaagtcttcatcatttgctcccgcccggtttacgccgtcagaaaacgggcggcatcggcgttttccgaatttctgacgcggtttccctcaataatcaggcggccggcggcaaaatcggcaacggctttcggataaagtttatgctcgacagccaaaacccgtgcggcaatatcgtctgccgtatcgccgtcgagtatcggcacaaccccttgcgatacaatcgggccgcaatccagttcggcagtaacgaaatggatggtgcagccggcaacgcggcagcccgcctccaaagcgcgttcgtgcgtatgaagtccggtaaacgagggaaggatggacgggtgaatgttcatcagcctgccttcgtaacgggcgcaaaactcgggggtcagaatccgcataaaacctgccaaaaccaccaagtcgggttgatatgcgtcgattttctccatcatggcggtatcgaaggcaagccgggatgtaaagtttttatgattcaggctatcggtcgggatgccgcgttcggccgcccattgcaaaccggcagccgtttcgctgttgctcaacacggcggcaatgcggacgttgtgaatggcggcattgacgattgcctgcatattgctgccgcgtccagaaatcaggatgacgatgtttttcataatggtgcgcttttgaaagggatgccgtctgaaccgctgtttggtggtttcagacggcatttgccgtaaaaatgcccgaaaacctgtttcgggcatggattcggacttaatttacttttttgatgtcgacttgagccggctgcttggcgggcgcgttttcgggtgcgccgattttgaccagtttcacatcaaataccaaagtggcgttcggaccgattttgtcgcccgcaccctgttcgcggtaggcaaggttggacgggatgtagaacgtggcttcgccgccttctttcagaagctgtacgccttcggtccaacccggaatcacttggctcaaagggaaggtgaccgggccgccgttggctttgctgctgtcgaataccgtaccgtcaatcaggcggccttcgtattccacggtaacgatgtcgtctttggtcggctgtttgccttcgccctgtttggtgattttgtattgcaggccggaagcagtggtcttcacgccgtctttggcggcattttctttcagaaaggcttcgcctttttctttattggccttcgcgtccgccttgtgtttttctacggctttagcctgttgttcctgaaggaatttcatcatgacttcctgagcctgctcttcggtcattttgatttctttgccgtcatacactgcctgcatggcttcggtaaagactttcaaatcgatttccgcgccctgttccttcatttgcttcagggagcgtccgatgtccacgcccatcgcatagcttgcctgctgcatcgtgctgccgatcgaagaggtgtcgccctgcgcggaagaagcggcggcaggttcggatgcagatgcgggggcggcttcttttttgccgcaggcggaaagtgccaaagtcggcggg

SEQ ID NO: 37788 - DNA, 916 bp, Neisseria meningitidis
  misc_feature (1)..(916): N is any nucleotide
cgttttcatcaccaaatgctgcgtcaggttgtggaactcggcgcgactgatgcttgtgtcgattgccatgccgtctgaaagcgtcgcctgaatgcgcgcttcggtttgcgtggttaattgttctttggcggcgcggacgagcgagagcaggagttggctgtcttgttcgttgagttgggagagtccgttttgttcgagcaggcggcagaacaggcggtggtcgaaatcgtcgccgcccaacgcgctgttgccgccggtggctttgacttcaaacagtcctttggtcagttgcaatacggatacgtcgaatgtgccgccccctaagtcgtacacgacaaacgtgccttccgaggcgttgtccagcccgtatgcgattgcggcggcggtgggttcgttgagcaggcgcaatacgttcaaacccgccagacgcgcggcatctttggtggcctggcgttgggcatcgtcgaaataggcggggacggtaatcaccacgccgaccaaatcgccgcccaaggtttcttcggcgcgcgatttaagggttttgaggakttccgccgacacttcgacaggcgttttcaccccctgccgcgtatgcagttcgataacgcgttgattgtcgccgaaacggtaaggcaggtagtgcgtattttnaggcggcgcacggcgttgcgttcttccatcagacgcgaatcggcaacgcgggtntcggggtgggcgcaaaacgggcatttcatcgggttcgtcctcctatgtcgtctgaagttcagacggcgacgccgcgggcgggcnatttccagaccttcttcggcactcatatagacggggttttcgggacggtcgtgtcggacgatgttgccttcgcggaacatgaccagtttgtncacggcaagttgggaccatgattcntcgcgggtca
